United States Patent 10,221,454 (METHODS AND COMPOSITIONS FOR SCREENING AND TREATING DEVELOPMENTAL DISORDERS) - sequence listing, part 5

SEQ ID NO: 82 - DNA, 1460669 bp, Homo sapiens
acaggactggagggcttgaggaatgtggtggtccctctcttcgttgtttctgccccctgaggttgtgctttctcagggatatgcactctgcacttccattcctgcagtgaaattaactcgagcttggcaggtaagtctttcggctcacctttaaaaagaaaagatatgtgagctgcggtgggggtgggctgttccccatttgccttacattggatgtattttattggtgcaaagtggtatttggaagcttaaatgtggggcagaggtttgaagtagccaaatgaactctgtggccctgagagaagagaaaggataaccaaaagaaagggaaggggactcaggcatttttctcctaataaatctctaatttttcttggaaattttgcctccaggccgatgcctggccccagaacagggtctttggcatgagttatagctgtgatgttccctattttcctttttttttttttttttaagttgtcgctgcatgggagcaggcagacagaaacagggttgcatgttgtcaatacaggctgcagaagtcaataagcagccagacagggaatgaaattggaggaggcagctatagatttcttaggttatttcttgtgagtttttcagaacttgtgtgattcaggcttgtcagatactattttgagctgggctgagacaaacacattcccctagtgcaccagatattgcctgcagcctcccaatttctggaggcacctgggtcggctttcttgggggcaagggaatgtccaaggaaaggtcaggaatgagggaattggaaactatgatgggaaaaacaactgttttactgctctagaatctaacagaaatcataatgtcaccctggagataattattatgctgttagtgatcggcttgagaccagggactgtgcctcattcaattcactgcttggatcagagtgaatactcaataaatgtacaatgattaaatgttagtatcaaaatacatacttttgggataagctcggattgatattctgggttctgcttagaatgataagatggagtaataagggagagtaatgttgattggtagataattatgaagaaatgagttctgttaaatagtagattaatatctgcaagtggaattattagacaaggacacacaaacacagggtctctctgcctgcctatcgtctgtctactttcatctctgtcttgtgtttcacttgattccagaagaatttcaggcagcttatgggacaagtttaatgaaaattaacatcattagggataaaaatgacaaaatatataggcttcatccagcaattgatcttctgtggttctacagtgacatggactacagataactgaaatgtaagggttactgtaacttcatttaagcatttattttaacctcttcttccactaatctcatgcttgatgctacaaacctagagtaaagtagatgaatgttctggccctgctgtgggtcccagtgaggtaaaactagcaaagggcagataacagtcatgcaggggattgagtcatacatggagggttgaatgttttgccctttggaggtgataaagcagataattgggtggctcttctccattccataggctgggctgctctgtcatagcttcacagtgctttgcttactttttctttcccctatttgaaactgaatcaggaagatcatatttcccttccgatcctgcttaataaaatattctattattttctcagctgcaaaagtacactattatcactgatcattccctcctcatctcagagtgtttgtcactggccacagtttatatacaagctatacaggctgcctggaacttgaattggctttagagtggatgctggggaaggggcgggggggttccgggtatctgatgaattcctgcaactgcagggctgggagcctggcggggagccaaggggattgtggacagatgctatgcttgctgggtcgacctggctcagctaatattcccagacttggagctgggggacacattcatttcattcaacccatacaaaaatatggacttaatatcaactatgtgtacggcatggaattcttggcatactcagggtgtcaaacccaggagtccctgttccccaagtagctgactctgctacccacatagcaggtgctgttacattgtctagtttatttctcttggatgggaaaataattttatcctattcacaaatgaggaaaccgagactcacatattatgcaccatgcctaacattgcaggtagtgaatggatgaatcatgagggaaactgtttacttcaactgtactgcacatctgtaagaaaagacattcaggaaagacttttacaagacagtgcatgctaagggctaggaagtttggtgagagatggctcccatggagaagtagaaattaagatgggctttgaagcatgagcagatgacaaaaaagcccaatccaaactggcttaaacagcaagggggtggttattggctcatgtgattgagaagatcaatgtgaccaaggtctggatatttctgtcttgtgtctcctaccgagttggctttatcctcaattcagctacctaaagtcctctggaccctacccccccggaagctgaaggatgactgcgggagtttcagtcccctacatagttcctggggccactttctctcattagccacaactgtggctgggggtagacaggagacagtttattctgtaccctctactaaacagcataggtaagactaatagagaataaattttgcaaaaggaaaatctgggtagaagaaggggaacgaatggttggtagcccactaatgtcccatagcagaggatttagagaggcaaggggagcagaaatcctcacagcacaagcactggtagcagtggagggtgggtaggcctgagttagaagttaagatgccagtcttctgatgttcctgggaatagatgttttggccagctatgtcttattaccagtgcccactgatcccaaaactaccttgctgcatgctgatagcgtcctcctagacctcagaggttggaggtgggggtgagagggtcttagtttactaaggtagaaatcagtgaactggtagggtcagatcatgtcagtggaaatgatcccaagattccctgactggtctgaggctgcatataccctgcactctaatagcccattgatgtcagctcttggctacctgctccagtgaaactcgggtcctaaaagtcaacaggtgctcagtgataaagcagggtacaaggagacaaagagagggtcttagggactgggatccttttgaatggtcctaagaagatatgacatttgttgtttcactaactcctaccaactcatgcctaggtttgctcaaagggcttttgtttctggaggcatatcctgaggtcctgagtgggaagcttagagcttggcccattaaaacagagagctcatttttctttcttttccagaaaagcaaagaagcatcatgggtaatgaaaaaaaaatactgcactaggaggaaccaggagacatgagtttggcctgggatctacatgtactgattcctgtttgactttgtataagcttctttaatttctgctactaagccccctatcaaggtgtttttgttgttgttgttttttctcttatttcctcagatagaattattttatagtcaagctttgttattctagcaaagaaacctggggttatgctttggaaggccatttttttcctgtgtttgaaccaaattgaatttagcaggtgcaaagggctgcagaagagacttggcaattgatagaattatagccaggattcagagggccctcaggagtcctaggcattgactctttgagccctgtgctgaaatcacctctcaagctttcctctatccaggctcttctcttgtgtgtgtaacaccatgccatgcccagccacacttgggaataatctcagattccgtatctttacctctctttttaattttgctgctcagcctctctgtgctgccttcacacatcccattagtcaacgaagtcgtattgattttatatccaaattcctcttaaacccacaccatcttgttcatccccatgttccagtgctgctcctccctcactggactcttataattgctgctttactgtgcatgggatatgagaggtcctccataaatagcatttgaacaaatgcagaatgagataataacacaagtgaaatgacgtgaaacaggcctgagttctcaatcttctacttatatgggatagacatgggttggtatttctagaaataattataggaaagaactaggttcttttgtagtcaactcaccacgtgtctgaagttaccttatttccatctcatgaagatgtttaacaagttcatgtgaaacaaactgtttctactgggaagaccatgtccaagtcttcccacattctgatggaggtgccacaccctcccctgcttctctagggtctcattttaccatcctcattttgccagcctctgggaaacctgatctaagcctatgcaatgctaaaagtgcctgcttaacagcttggaagggaggagaggcaatttatttgctcaactgaattacctgtttacacttctgatctccaaagcatatgtcagaacaagaagagaatagaagaaattgttaacattgcatggaactagggagtccacatataagagaaatttatcacatgaaaatgcttgctttctttggtggtgaatctctttcaccatcagaattgcctccctcctgtcatttaccttgcaacaaattttcctttacaatatctttactcagggtgcctttcctctgaaaacagaaacacctagttgacatctcaccactttgctgctttggttgcagcctagtgatggaatgacaagcccactccataggtgcctctgaatagcttatttcagggagctgcaagacaactatttgctcagaaaattctcacgagggtgatggttttcaaagcaggaaggagagggaattcctggtacacttcccctctgcattgctggagaaatgaagaaacacttgaaggcaaagtcataagtcaggttgaagatggtttctggtggagtggtttggagatttcatctcaagttgagagctgtcctggaatagcttctacctgacttgtttatttctcagctattaatagaaactaacagagtgaggatggtccaggaatctctcccataatgtcctacttcaggacttgaaattctgttagaaattcaattttaatatcatgggataaaacataaatgcatgaatctctttgcagaacccctgccaagggacagccttcaataaatacttacgaagctggacactaggctggttgctacaaatacaaagaaaagcaagtcatatcatttcctaccaaggagctcacaacctggatgatgatgccaattctaagactaacaagaacaggtactagcgtagatggtggtttctatatgctaggtaccattctatgtgctttatgtgctgaagtcattgcattatcacaacaagcctataagactcttaaccctgttttacaggtgaggaaactgggacactgtcttgttaagtgtcttgcctgaagtcacaggattaacatgtacaaggcactatgagagcagagagaaaagaggcgtggtcagggagtaagggagatacatgtacagaccactgatgtggactcatcatctccataactgcccctttgcccttcctttgcattcaaaattattatctctctctcgttcaatttagctatttctatgaaggggtgaaaatccctaacctcttgatatgaatttagcattcaaaggcacctgagatgaggaaggcagaaagtgttcagtataatttgggtctgcttcctgatttttctcaggtttggtcaagaggctgaaaagcaaatagaatgcaatggcaggcacacacacataaggagcttattgaaaagatagatctcaatttctagtatttccaccaggcattatgaccctgacacctttttcagttatggtactctatcagggttactttgattataagtgacaggaaaacccaacccaaactgccttaagccaaaggaaattttagagggtcccataaggagaaagtctaggggttgctctgggtctaggaataccttgatacaagatctcatgtaatattgccgggttttctgttctcttctttgaacttagttctcctcctcttgcctcatgatcacaaaattgatgcagcagctccaacccttactttacttagcttctgtctagggggagatataacagttacttttctgaattatcagaaagagtcctgggcttttctatcgttggccctattaagttacctgcctgtttctagatcagtaactgtgcccatggaaataaactacactgattagcttaggccaatgggtataagaataaatgaaagtggagaaccagtaagtctctgaggaaattcagtttacgctggagaatggtagtgacatcttcaatggaagcttcttgagtgacctatgttatagctctgttagatggcgtggtccctccagggctaacagcatctataatacctatgtttccttattctcctccttacctatcagtatgtctgctctatgctcaggagtattccacagtggctcagtggcatgaataataggaaataatgtctaaatggactataagacataagctggctttttcaatggcccttaagtttcttaactcctgagccagggttcttcttcagaccagagggacctggaacatctttggtcctacagatggtgttggttgggtatcagcatatggggagatacgtgggtgggaggagctgatgtcagaaggcctgagttggaacattggattacaatcaaaggaaaaatcttgagccttcaattgatgaaaaaacctccttagttgaaaaatgcaaaactctggcagactccttctgaggatgatgaagaaaagacaaaactctctgaaataattaaaactccgcaggagggatattattatatatggggttactagaaggggagtcaggattagggttgggattaggggagttattagacagggagtcagggcctcctgccatgggaacttcttgtcagtgatttcttcccttggccctgagataggcagcttggtggagaaggcttatacttcttagctgggtgaccttggataattcacttaatctcgctgggtctagatttcataatctgtaaatgaggataataggaagaccaagttcatgaagaaattatgaaaattaaatgaaaatgttaggtagttatgttcaaactcatgcaagcttggccaatagccaaccatttggtcaacattagtttcagttattttctccctgtctgtaaactctagagtttacaaactcaacaatttggaggtttttcttcccacgcagcacatgacttcacaacactaagcatgtcgatagtgaattaacttgtcattattgtatgggttttattattatgtttgcttttgaattagtattttgagcagttgcatcaaatcacagaacagtggaggggttctgattaagctgagcctttccctgctgcagcacaggccctgggtgagggccatttgtattaggatccctgccttgcccctgactagccagatcactttggtctctgacctcagtgtcctgattagtccacatggggataataataccttcccacaaggttattgtgagaatttgagacaattcctagaaagcctggttcttttatgagctgtgtattcattcattgtcagtgcccactctgtgggattttgcaatttaaaacatcacttccatgcatggctgtctctggaagggtataggcccagaggacctcatctggtgatggggaagccccctaaattgctcatacgtatacatgtaaaatcaaaatccaccagtgcagttctccctgcacctccccctatccaagcatggggccagggtggctgccagattgttttttccaagggttgaccctgttttcatgctcctgtgatttacttacagaagggattatcacattggatgagaggctgaatttcatagacctcaaatgtccttttccaactctgagattttatgtgtctatgttttcatttccaaatagaaaataacccttatcattgctaatggtattcccttaaggaagttacttaatctttctatttctcaatttcttatttgtagaatagaatggattatattccctacatcctaggatgggtgtgagatttaaacaaagaatgcatgtaagatgttcagcacagtgtagtaagacgttaatggtgctcactgatagacatttcttatttgggacataatagagtgacatttcctgactcacttgccattggaaggggctatgtgactaagtctggccagtgagctgtgagcccaataaggtctgtgacttctggatcagggcactgaagtgtgcatgtgtgacttctggcacagcaaccataacattcaacatggtggctgctcagtcagcctgggtcccgagcatcccagccaacataatggcaggtactgtgagagggaaataacttgtggtgtactaaggcacttgaaatttggaggtgtttttttactgttctgtaacttcatctacattgattgatacgcacattgttttatccaagataataataactaatagtacttgggcatttgctatgtgccaggtgagtattggttcacattttgcaataccctagaacatacatattattattaatctcatatttagatggggaaactaaggttagaaatgttaagtaacttacccaaggtcacccagccagtaaggggaagggtggggatttaaacccaggtcacgtgacttcagagcttgagctcttaaccgctgctcacccgactccatagaccaaacctgtggtttcatggtatgatcaactaacattaattctgctttccctttctcttgaactgcatcccctgtagtttcatttggaagtgatttcctttgttggccattactcttcagagtggtggtgaggttgggaagccagcagagtggcctgctgtgggtattgaatgctgatgttgtcataggaagtctctcatttgctttgctttgcttgactactttttggtttttaacctgttatttaagccaaagtatttgatatgggaacaggaagcctcttaagggtaaggaaggcattttgtcttcttacctttgcttgaaggcatcaagatgattgtcttgggtcagagtcagagcctgagatggggattcttctttaagtgatttgttgagggagttcttttggggaaaagctacaaggaagtgagggaggaagagcagggccagggaagctaagcaaagatgtggtatagctgaggtctagctcagcctgatccacagaggagctgagcatgacttgtgacacagagtttgctctgcattgaggcaacagggctaagtttgtttgtttgtttttttggacagagttttactcttgttgcccaggctggagtgcaatggcataatcttggctcaccacaacctccacctactgggttcaagcgattctcctgcctcagctgctggagtagctgggattacaggcatgtgccaccacgcccggctaattttctattttcagtagagacgaggtttctccatgttggtcaggctggtcttgaactcccgacctcaggtggtccggccgaggcctcccaaattgctgggattacaggcatgagccaccgcacctggcctgggctaagcttttatactcctgcatcaggtggttattggccttgggtgtaacctcccagatgtctccaggtgaagtggctcccattagctaaagacaattctgcagagaaggatgaggtgcagcgtaattagcagccaacacctgcagcagttgggggatgagtgcacttgccaggtaaaggagacctggaaggggcaccaaaaacatccactatagtgtttgaggtcagtggcccatctgatacggcttagctctgtgtccccacccaaatttcaccttgaattgtaataatccccatgtgtccatgagagggaccctgtgggaggtaactgaatcatgggggcaggtttttgccatgctgtttttgtgacagtgagtaagtcttatgagatctagtcgttttataaaagagagttcccctgcacatgccctcttgcctgtcagcatgtaagacatgcctttgctcttcctttgccttctgccatgatagtgaggcctccccagccatgtggaactgtgaatccattaaacctttttcctttataaattacccagtcttgggtacgtctttattagcagcatgagaacaggctaatacaccatcctttttggatttgtgatttttttttttctgggggtgatattgtcaagttgagaggaggtagcgaagtgtgtaaggtgtaagtgtagtggtggcatgtggccttgtcagggcctcagcacatgccttttattgacactgaagtgttgtgtgtaggactgtgtaagggcagggtggttgttgtgcacactgtcctgatctttggacctagaactgatacattgtgtctagtcaccaggggagttgtccctttctatctttttagacgggcaagttggctgccaaaaatgtttaggcaattctggtggtgttttcctttctcatgaaataggcggcttcaacctcatagaataagaatcagccactctgcctaacaatattaatactaacaccaatgccctttattaagtgccaggggatttacttgtattaccagatctattcctctccatgaccctgcaagatgggaatcataggatccatttgatggtccagaataataaatattaggaagagtcagcattttgtccaagggcacaccattaaaacagtttgcgtcaaagtagcaaagaaaataaatcacagcatcaaagaacaggagattaagagaaactgaggaaaaaccacacgatctcggaggggtagagaatactatatttataatgaagaagtctgactctttggattaatataaaaatcttgccatgtagcatgtgggagaggagagcaagggaggctcacatgctggagacaggatttggttccaatgctatctgactctaaggctgatacatctttctgtgccatggtgttttaataagcatgtaatttagaaatgtccacccacttacttcggaaccatagatttcattaaaggagagtaaaaacccaggctttggatacagacagacttgagaaacagctctaagatttgggcaaggctggtcttgaactcctgacctctctattcatcctctctatgcctcagtttcctatttgttaaatggggatgatatttagcttgcatgactgtcatatggatgagatgacagcatgtatacaaaatgcctatcatgtaaaaagcacttagtctttaccagttattttaatatattcatgaagaagtttcagttttgtcgaggagaaaagaggctgtgtcagttctttattctctcataacaaactgtcacaacatttggcagcttaaacaataacaatttgttatttcccatgagttgaggggttgactgggtaagccgtccagttagttatatttcatgtaatgttagcttagtcatttatgtggttgcattcagctgtgaacttagctgggcctgggatgtacaggaaggctccttcacaagaccttcacaactcctctccttgctcaattgtctaacccagattcttacatggtgactagatttcaagttctccaaagtggaagcatccctgctgctatggactgaatgtttgtgtccccttgaaattgctatgtcgaagcccttatccccagggtgatggtgtttggaggtaggacatctgggggtcattagagtttgatgaagtcatgacattggagcacttatgatgaaattaatgcttatgaaacgaggaagagatgagatctctgcatgcatgcaccaaggaaggccatgggaggacaaatccagaaacacagctctcaccaagaacccaactatgccggcacactgatctcagacttccaacctgtagaaacatgagatataaatgttcatggtctaatctccatctgctgtactctgttatagcagcctgaactaagacacttgtcttcttaaggtttagcctggaattggtgcaccgtcaattctataagtaaagcaagtcacatggacaatgcggattcaaggggagggaaattaaactcagagtattgttggcagaatggcatgcatgtacttgaaggggaggagtgattggcagccatatttgaagactatctctcttggatacattcatcctagatcattcataaacaaggtgattttatgagaagtttaattcttactgttctgcatttgcagtgcagacatttaccatgatgacttattccctgtagagtgggttaatgttttcagacatggcttcagaggacctggggcttcagttgagccctgaataaaggataggaaattgctatggaaggaaaagaaaagggtctgttgtatgctttgtttttttcactcacatgaaccaggacaaactcagtgtgccttgggtaaggagggtggcgacactgattttaactgtcaaattgatctagagttgtcagatgggataatttaaccctcaaatgaaggtgatttatcctatgtattgtaatcaaatagtcatctaagtcactccccatgagctctggtaaatcacttttagtacatattgaaagtgaccgtattgtattttattgcagaattgcgtcttatagtaataactaatgcatgccattggcttttgctctagcaccgaattacactcacttggaggcacatggatccaggtgggcactgttgcttccatttgcttgtccacagtcagaactgagaggcaggtaggaaaactgtactgctgcagtctttgtagattagctcaattcagagacacctgtggtcttgtgaaatgccaaactttactccagtggcatttgggtcaatgtgaactaggatgggcctagcaattctattaggtgaatgacaagtgctttgtaatgaaacagaaggactttatttaaacagatataaggactggacagaaatcaggcttaaattataccttatctgggctcctgctgtaaccttgtaactggtcttaccacttgtggtctcaagactattttgtcctgcagcccccagagcaatctccctgaaatgcaaggtcaactatgctggcccccggcttaaagccatcatggcttcccaatgcctgtgggatgttgtccacactcttagcttagcttacaaggctctccatagtctggctcctgcccacctgtccagcttcatcttgcgccactgcccattttgaactttccatgctacctacataccgtgattcacttctccacactgttgttcatgtccttctgtctgcctgagatgtgctctcccagcttcctgactctgacctcctttgcctggccaactccttctggtgctggaagatgcaccacaaacatgcccccatgggagcatgcgcagatgctctcaggctgtgctcataatttcctgagtctctcccctcatcatttcacttctcacatagcattattatgacttatttaggcctgtagctctactactagatggactgtgagctccttgaaggcaggaacccatcttaataatatgggtatcccaagaaaccagcacaataactggttggcccagaggagatgctcaataaatgtttgtggtattagtaaatttatgaaaatacctctttgggttgtcacagaagcacatgagcagtggagacaagattctcatcttgaatctgagtctcctttgatctgaggagcttcctgttttgaggttacacatttattttagagacagagtctcactcttgtcccccaggctggagtgcaatggcacgatctggtctcactgcaacctgcacctcctgggttcaagcgattctcctctcttagcctcctgagtagctggaattacaggtgcatgccaccacgcccagctaatttttgtatttttagtagagacagtgttttgccacattggccaggctggtctcaaactcctgacctcagatgatccacccatctcagcctcccaaagtgctgggattacaggcatgagcccccaagcctggcctgaggttgcatatttaggttggaattagtgtgcatgttctccatgaaggtgaaatttgtatggctctgggacctaaaagcctaggcaagggcatagagatatattagcctggggtggactggggaatgttttactagttagcattacgtgagaaattaagcaagtcttacacacatggatttgagacccagaatctgctccatttctggggcttttgtgtgttagaaataagtacagctgattatttcatttatgttggtggatttggggctgccaagcttctctgaagggcccacattttcctttggtactctatttctcattttgcccttagaaataaggaatcttggagtaaattccagaggtggtaggagaagggagaatgcattcccacattggtagctaaggttcataagctcctagaaaagaagggaaagatctctgagcctagaacatgggactcccctttcttactgtaatttgcagacagattggggcaagaaactccatgcagcttggaaacatgtcagagtgtgccttacaaggaaacaaggcaaatacaggaggaaaaaggtaggctgctgtttggtctttagaaacaagcattttcttacatccttttattcccggtatatgtcctatgaaagtcattctggtagcaatggtaatagtactattaataataatgatgtacatatattggatgtgttcaacatgccaggcaccatgccaagctttttacctggcttacttcatttcaatttataactttatgaggcagatacattttcatttctatgttacagatgaggcacagagaggcatagaaacttgcccaagcttggaggagctgggatttcaacttaatctaacacagcactgtatgttctcaagttgtcactatattacctcccaaacaacatttacactaacaagtgcagccaatgtttattgagtgctaactctgtgctgggcacattgccaacctttacatgaagagcctcagttacccctcagcaccatctttggggtgggttattattatccttatttcaaagatcaaacaactgagacttagagattcagtaacatgtccaaggtcacacagctagttcatggtgggacctgagttcattcttaggctgcttgtctcctaagcctctagtccaactttttaatttttttattttattttattttttgatagggtctcactctgtcacccaggctggagtacagtggtgtgatcttggctcactacaactctgcctctcaggcccaagcgattctcctgcctcagcctcctgagtagctgggattacaggtgcttgcctctaccacctggctaatttttgtatttttagtagagatggggtttcaccatgttggccaggcttctcggcctccctgagttctgggattacaggcatgagccaccatgcctggccatagtccaacttttaaattttggtttaggaagtgttttttatcccatccatccagatctccctctcatagtcagttttcacctcttccctggggatacggctcaaggagaactttcatcatcttcaaatgcaaagaccacgtggcaattagagtgtgggggattccaagccccttctggtgattgtggacttgaaaaacagtagtggtaatgaataattaaaggttaaacaaagggaatagttctagagactgggtgaaggggagcctgttttattccactgagtttgaagccagaacaccatgtcttggcactgacatgccttggagacttcgtattgatgatcatggctaactgactctttctcagctctcagtatcattcatagtcaggactttacatgtgtgtgtgtaatgtatatatatctgtgtgcacgtgtgtgcgcgcgcgcgcgcacgcacacacacacacacacacacacacgtaaagtcctgactaccagtgataataatacatagttttttgggggaagaagggatgcctcttgtatgcacagcactcaacttctgcttttgggcagggaagatggaaaaaaaaggtaaaatggggttatttgtcccaagttgacttgacagtctaagcagggggataaggcagatgaatatgtgaacaatgttttggtagattagcttggttagaggattttcaaactttttgaaattataaaacctacaaatatatattttttaaatcacaaaacaaaaccttaatgaatcagtaaaattctcataatctttatacaggaaaggtagtagagaaaagtttatatcagtttgcaactacagatttatgcccttacatatgagtggtagatatgtgaaatatgattattagtaataaagtgaagaggatgttatagagagggatgcaataaaatttatctttttcatcatgttcctcatctgggttaccatgaaactaatgtgaacagtttccagctccaggcaaaacatttacactcctcacctttcagtgctatcatttgttgcatttgggaacaaatgtgcagcttcagggtgagaatggaagaatatataggcaaaagaagagctatgaaatatattaataacgaatattctcacctgaaaactatgaatttcaagatcacacttaaggtccacttcaatttaaaaaatgtcctgaggatctgaataatgacaattggaaaattaaaagagcattgatagcttaagtgccaatgaactcaaggccaagatctcagttttcatgcaaactggtggctctgacttcgttccactgctatagccttggctgaggatcttacaagtgggtttttgaaatggattcgggtggaggctcagggagtgcacctgttacctccatggggcaaaggctcaatgtagggaacttatgagagttggagagcatgatgtgtgctgtgtagacagcacagcatggggacccagcactgccctcatcgacatttctcttagaaaatgtgattacaaggcaggcagatcacaaggtcaagggatcaagaccatcctggccaacatggtgaaaccctgtctctactaaaaatacaaaaattagctgggtgtggtggcatgtgcctgtagtcccagctactcagtaggctgaggcaggagaatctcttgaacccgggaggcggagcttgcagtgagccgagattgtgccattgcactctagcctggtgacagactgagactccatctcaaaaaaaaaaaaaagaaaaaaaagaaaagaaaacgtgattacattgtaggagctggaggattgttactaaatcattcaaaacagcaaaagttaaaaataaaatagcgaccagttaaaaatattccactggtctaacaaggaggatataaataaattatgatgccttatagatataatattaggaatatttttcagccattaaaaactacgttttaggagagtatttaataatggggatattatagataaatacagatagatttaggtataaaatggagactatttctttctttaaagtactttcttgatttttttaagtcagtatatccatctctctttccctagcaaatattctccagagaaacagacaaacatttttcattggccatctctggatataaggtaattttagttttctttctttctttcattttattttttaaaaaagagatggagtctcactatattgctcaggctggcatcaaacttgtgagctcatgcgatctgccctctcagcctaccaatgtgctaggattacaggcacgagccaccacgcctggcctgattttaattttcctatttacatctttctgattaactttttcccttataatcacatattgtctttgcaaccataaaaaaaaagcaacaagcgccagctatttctctagtggcatgttaatcttatgcagtattggaatgggagcaggcagagggcttggtcctagatgctccgtttattagttggctcatggaggataagcctgagcttctgagagtctggggtaaacaagtggccatgccttcctcacaggtccctggaggatcggagaagtgatgtgtgctgtgcaaaggtgaaggtttctagccaaggccactgctggacttgcacttctgcctttctcctgggggtcactttttcactcttcagggcttggctcaaatggtacttccccaggtaaccttccctggcccccacatacgatcaggtttcctctttgaatgcccttgtaacacttcagaactcttatcattgttgcaattttgcattcattcttgaggttattggatgaatgtgtggctcctcctctgaatggtctgtttcgtcacttttgaacatccctccattactggcagatagtagtctctcacaaatgtttggtaaacgaatgaactcttcaatgcaaaggtttagaatcagctggtggggagacagatctagtattttgaggtggttggagggatcatggtgttaaccaagagaaagctcttagcagagtcactgtataatttttttctttgggaaagagtgtgtgcttcaacataccagagagctaaggctttgcactgtaatatgggttaatcaatcaagaaatcaatcaacacctacttatccagtgcagaccatgtgcccagcacaatgctagaggcactaagacttttgggaagtggctttgcctctttctttcagttcacaaaatgaagtggttaagacttgcagaaatcagaagtggaagaatgcaaactgatcagtgattgcaatgactggaaaagggctatgaaacgccagtgcatttgagaccaagcattatggtgatggagtctcacatcctgaaacccagggctaatcctccccaagagagacgtggataggaaaattcccctgataattattgcaaaagtgtcatcttaaaaacaaacaaatatcacaagatgcctccccaaacttgaaagcatgaaacaaaaaagcaaactattcctaatcaggctaattgtagagttagtggctctaaattgtgttggttttgccagttctgccttttggaggtggggacaggggagatttggtttaacttaattagcatttccaactggaaatgtgacaatataactaccctaaactgttgctcagtaaaaatgcagaaggagaattcctcctcagtcacatttatacagaaaccaaggacaggaagagaaagaagacataggctattaggggaaggaatatgtgggctacagatacattcagacgccaaaacttgctgctcattttcaacctctcacctaattttttttctcctcctggaatctatgactataaattcacttctaaggggaaaaaatcagcccatgctcacagcctgctaggagcgcttatacctcccctcctccaaccttccactgcccggtacattattttggaaatttgagcagagttgtctttggaatgacggcgcctcatcaatacagaatttgtgataatctggtccttgggtgggcttgagtttatccacataatggaggtggagtggggagacagaagtatgttaattaagactaaaggcccacaaactcttttcaagtaaagtagccttagctacagctgattcttttctcttagtaaaaacattgataagtttaccaagaccccttgcatgttccctgtctccacatgtgctagaaagtattacgttggtgcaaaagtaattgtaccaataatgcatctgcatttattaagtgtcctttaatgcccacttcactgtagcagtccagttagggactattagcaagggtttatagtattattatgaaagaatctggatactagcagtgagaggaagactttccgcttaaggaaatattgttcccgtaggggcacaaatatatgaacaagcgtctgcaaaaactccaggctagggtcagagcatcttaagtgaattccaggaaagtggtttatagtctagatgaaagagagaaatgcatttagcgggggttcttgaccaaactcaaggctccctctttggatcagagtatggggcctaccttggcgggtgcaggggttcctaggcaggtgggaggtctctatttgtgttgaggttgcagctctcttctccttctacattttatctcctacgtttttgctaccatctggttgttttcttaccacattgttcttgcctctggcctgcagtgggcacccttaagaaaagtccatttagatgtcttctttccttgctagtcttcatgtttgtcagttctgaatttgcatccaatgcctgtcctcagtccctgggccttccccttgatgtcttcaatgtgaaagctattcagccatggggactgtgctcctcccttcaccctcctgtcctccaaggaaaatcaggaagtatctggacagactgttggaacaaagcaaaatatttaagttcctgtcatcgtcccactgtggcttttgatcatttctttcagtagccagtttagtttaattatttatagaaagacattcatagtgctagaggaaatgtcctataaagcatttatcaaagaatgagtctttgtaatctgagacatccccagagcaaaagcaaagtatctgggctgatgattcaggtattacctttggagggaagcaggatgagatttctagagttgctggagtttgaatctctgggttgactcagtagataagcctaaaatctgtaggaggtacaatgcctgtgcacggtcccagtccttccaacaacaaaatgagggggtcattcccatatcatcattatacatggagaaactgaggcacagagaaataaagtacattgcccaaagtttctaaaatacatagtgaagtggaatctagatttagagagaggcagtctggtgtaattgctgtgttcttaatactctggactcctgttgtggacatgctggtcccttggttgttcagtgtctgaggacagtggcttgtctgattttctcagcttcctcgagatggatctacaaattggactgaactacagcctcagaagtttataaggagtttcatcttgataatttggtgggactggaagatgtctttgaccaatagaccagtatccaatgtactcaagatggatcagcctgcttctgccacttcctcgatctttaacttacccaagctatttaatttttgaaagtctctgttttctcacttgtagtttcacagtggtctctcattctgtgttgtgaggataaaagagaagagggagcatgtggaaggcacttggtacatagttaagtgtttcagaaatgtttctagattttagctgaggtcctgtggcatcttagagtattgtccaggaatcttggtggcagtatttcccaaattttagcatgtacaggaatgatctgtgggggaagtgtcaaatctgcatattcccaagccccacccaagtgattcagattggaccaggtggtgctacagtggatgcagccatccagatggcaccactgagaaagctggctcacaggccagcaggggcccctcccaccccttgactaaaccctctgcattccttcagactcttcttaccctgaatggagagtgctagaaacgttcttagtagctttctaaaggctttataaggccaacgagtaataatttggtgatttcagaagcagccctcagaataatatattttctaccccttcccccacccactcttggctcctggccctacctccttcacccctcttcgatttgtaccacagttcgtggcattttctgaacctcagggctcctgtctggctagttatttatttagctgaggaactgcagcacctaattaataggaaattagctgtgagtgtaacatttggcccgtagtcaaggcccaagaagttataaatacgcaccacgtgagtggcctgggcacctgattcttggaagatccagaagtggcacttcctgtgcagttccaggaagtgaagtatgtgctgcataggttgtgggtagccaggagcaggcatcacctgccctgaggccagcaggaccatcctggggagcacaggggcctgtctgcttctccccatttcccagagagctcattgactcttctcaacttagctgtcttttcaaaggccaggtgggagaggacacatcaaggaaatgagagcagaggctggaggggacttaggagagggtatagggtcccttacagggtggcccaagcaccgtgatcctccaaagacactaggtctgctgttgtttcagacacttgcattggcttcttccaggggcacgtgaggtacagcttcatctaacaccttgacagtagggactctgcattgaaggggatctcactgccattcacaggttgcagaggaaggggaaaaatcttttccttctactcttctaggttcctggctggggcccctataacaaaagatggattaagaagagaatagcacacaaaattatttactatgttttatgtaacaggggagccttcataaggtaaccaagatttgaagaacagttaaccctgggtgttttttatggcagtcttgatgaagagtgaaaaggcatggagaaacttgatagggcaaacagtgtgaggtaagcatagtgaactccaggaaatgtagctgggcctgtctggattcctccctgggtccctagtcttggcagataagtatgctcccttcctctgggcacctctcatgtgacctgcttcaggggaaggtcagaaaattcttcctgggttttctcaaatttttttagattaaaatattcaacatgccaaagtgctgtattttggggtagtgtgttctgaaccccatcacagaccatgggaactgagcctagaggaggttagagatcctgcccaaaccagagagaggcagagttcagatttggaataaacatgttcagccctcaagtttgatgctgtttgcagaatctcatagtttcctgattacttcaaaaggaaaatcaggctgggaggagaaaaatgtttttaaaagccccaaggaggaaaagactgagggggaaggaggagcaaaagggtcaaggggaaggtaagggcaagtctaggagttccttaggaggcagcggtgcccccacggaaggaggaggcggtgtctgtgggtcagaggcaaagctattttctctagatttgcttgatttcagttatctcactttcttttttctcaacttcccctgcagggaaataggaactgggcaacctgtctattcccttgtgcgagttaaaaatctgctgataaaagtacctattccaattctaagtgtgtttgttatgagccaaaccctggagggtgggaggagggaggtgcctggttccatggcagagcagggccaggaggtaaagctggttggaggacatcagggaacagaaagcacagagtaagtgaaatattttgccagctttatttaaaagatcgatcgaagcctctttaacacaggcttctacctgagaactggtataatgaatctggcatttatgtgactctggaaggagccttccgaaggaggagaaaaatgtaaaagaaattgcatctttgggtgggtcccagaaggggttgatatgaagaaagaaaataactcattgctgatgtcacagagcagaagatggacatggaggctgcatatcacttagactaagtgggacagagtctcccttggaaagaaaaaatgcctctagtctcactcagggaagcaagttatcaatcagagcccaggctaagaacacagatatcactgatgccctgaaagaaagataatacatcttccttttcccacctctacccattagccagaggcatttcctgaccttccactgaagaagaaaggggtccctcctgatttcttgtcctttgggggatgttaccaattctttactatcccaggcagtgcttaggcaccaaatgactttggagtcagaaagagctgagttcaaacatcacattcctgcctgtgagtttggacatgtttgattatctcttgatgacctcagttttctgatttgtttaaaaatataagataatatctactttacagggtttttaaaaggactaaatgaggtaaaagtcaaaaccacaaacatagcacctgccatgtagttgagacttaagaataataagtattgctgttattgttatgcaaataaaagaatcaagaataatacttggtagccactcaataatcagtttctgttcccttgttaaaggtcacatcagtaatagtgatgctagacattttgtctccctccacaactctcccctaattcaaccctaagccaaaacttaggccaacatcaaccctattcccaacaatatgcccagctgtattccccaatcctaaccccaacctagactaaactataaccccaactctatctcaatttccaactctatcccaactatattattcagggttcttcggagaaacagaaccaataggatgtgtatgtataatatgcctctctcctattgagagagagtgaaagagggagaggggagagagacagtgagagaggacagaagagagatttttattaaaagaaattggctcacgtgattatggaggctgaaaagtcccaagctctacagggtgagttggcaagctggagacccaggaaagctgatgttgtagttctagtctaaagactggcaggtctgagattgaggaagagccagtgtttcagttcaaaggccattagacaggacagattctgtcttactgcgggaggtcagcctttgtgttctattctgctcttcacccaattgcatgaagcctatgcacagtcaatctgttttattcaacctacaaatttaactgttaatctcacccaaaaaaacgccctaacagaaacaactagaataatgtttgttcaagtatctgggtacctgatagcccaatcaactttgcacctaaaattaatcattttaatcatcacaccaatcttatccttaaccctattcccagtgatattacaaccctaaccctaagtctaaccccaacctcagaccaataattactattattattattattttttgagacagagtcttgctctgtcacccaggctagagtacagtggcataatcttggctcactgcaaccctccacctcttgggttcaagcaattctcgtgcctctgcctcctgagtagctggaattaaaagtgtgtgcaaacatatatatatatattttttgtatatttagtagagatggggttttgctatgttggtcaggctggtcttgaactcctgacctcaagcaatccacccgcctcggcctcccaaagtgctgggattacaggcatgagccaccacgcccagtcagtaattactattaaatatgcaacatgtgctagatattgttagttcctcagctttcttctttttagtgtggatacaaatcctactctagttgccaaaacttattaatcaatgtgatgaatccgcatcataaagtcaacttaataatatatctccagagtatggacttgaaagggagctgtgcttggaatagattttactcagatagtcacacaagatgatcagcacctgctttggcatgaggagccactcaggcacacagagggagttctatttgttgtgccagctcctgctccattctcctgaccaagccctgctttaatagggtctgtgtggagttaagatggccagtgatggaggcctgggcacaacaccccagagatgtcttaactcagagaagatagatttgtagaccattaggagctgaaaatatgtgttagtattattactcatatagatcacttagttttctgtcagatttttgtctcagacttatcccctatgatgaaaaggaaacttcttgatttctacaaagattcctactgaatcaatgagcattagaattgaaagggatgggctgagcatggtgggtcatgcctgtaatcccagcactttgggaggccaaggcaggaagattgcttgaggccagatgtttgagagcagcgtaggcaacatagcaagaccccacctctaaaacaaatgtttaaaaaaattagctgggtatggtgttgcacgtctacagtcccagccactcgggaggctaaggtgggaagaccacatgagcccaggaggtcaaggctgcagtgagcagtgatcacaccactgcactctagcctgggtgacagagcaacaccctgtctcaatttttgaaaaatgaaaaagaataattattttatcccattgttctcaactttaaaatcactgatgcttgagtcttgtcttggagcaatccatccatctgtggggtgaaccctgggaattagtatttttagaggcactcttctagcgttactatggctaaatgtttccaccagtctggctaaaacttctcatttcatggatggaaaaagtgagactcaaagaggctaagtgactttcataaaagcagacttgcagggacaaagccagcacctaaggttttataaatactagtccagtgctcttgttcagacaccacattccttctcatcttgtttcctcagatttatagccaaaaacaatgggaccatcagggacccaccttaggaccctcatagcgagtggtcctccagctcagcccatgtgcatccagctgaaaggctttcatacctctgccctgcataggtcttgttcagagaagtgggtgcactgtggcagaaacaattctctactaacccatttggaacaataaagaaataaatcctaatccaccaaccttgaccagacagctgaaggttgtgctcacttggtactgaccttgtaaagatggattgcaattttggggagtcgattttattttgtttttatgtttatttttccttctgggtacctagagttcatattcatcctagagagttctgggaattgcaggtccaatgctattagcatctgcttcattcctctgcctttctgcccaactcccttgttttctaattcttaaaaaatttttctattttttaagacaatttatactgaatgaattgttattttaaaataggtgagtgaaatccaccttaagtactgatttgatgtatttagaaaatatggaggcctctgaagcagaccagcaaggcagcctgtgtatttcccctaggtgtggttccctctttattaccagagggtacataggagattctgcattcatttagtcattcattcaaataatgtttatggatttaattttctttaggtccagggaacttgataggcactaagggaaactaaggtgaattactgtcatcgcttgacctcaagaagcttaaatctaatgggaagggaagaagagtatcctcgaacacccgtactgtatgcaatgtgatgttccctaagggtatggcaataggagtataggaatgagtgggattatttctagctgaggatcagggaaggttctgttgatgatttgacattttagctcagttttggaaaattgatgtgattttgacagaaataagtataaatcttttgtgtaggcaaaggaacagctggagcaaagaaagacaaaggggagggaaagtatgtgcttgtgtgttggggagtatatctttggtcttcatatgataggtaggagggagcatctgaaaaaaaaattatgtgtagacctcacggatgcttatgggttgaaactggctttagtgactggtctacttcctcagttttacagattataaagtaataataataatagcaatatttgaacttaactctcattgcatgctttctataggcagttactgaactacagccattacatgaattttctcattattttcttacaacattccttggaggtaagtattattattatccccactttgcagatgaggaatctaaggctcataggtcagtaagccagtaaaaggcagagttgggatttgaacccaaggctacactctttccgtggccaggattttaaccggggtattcagtactggtgccattatgggggaggaaaagatgatggattcattttggacatgttgagttagaggggcccatgagacctccaggagaagaggtgagtctgaagcttgaagatggaataatttgaaataaaatgaatttgtttctgaaagttgtatcctaacgttggcatattcagaacaccagtcacattgacttgccctgcagaatttccagatgggaattctagcagctcacatgccaaggctgctccttagtgtgtgtatggcttgccagacccatcttccaaagctgcactcaggttttttttttttttgacatgtctcagctcctttctccaccatgtgtgcctgcagtactgtctccttttatctaaaggtgttttgcaacttgaccccttgctgcctgccaaggtttacctctgagaagtatcaagctgttcagcattggctagaacaagctcttctgaccctgtcgacccaacagtgaaaaagtgtcagtgtagggaagcggaagatgttaagcatgtgcatgaggaaggaaatagtttctttccagcaggtgagaagcccagagagttttggtggcctgggcaagctcctatgcctcaggtgaaaaagagaagttcagtaaagctgccttgcctggttttaagttatattgtcttctaattccttcttccctcaccttcctcttgtcctaataccttcaactccaagtctcttgtcatttcctgacagactggcaggtatacctgacagactggtataattgttggaatcaggaatgtctgaccaatggggaaactgtggcagtaaggagtggagaaaacttagtgaagggcttgcagtccatgactaagaacacagacttcacgtgatcctgtaagaagacccgtcagggaagagatctaagggttggagtctgtattattcttctattgctgctgtcacaaattacctcaaacttagtggcttaaaacaagatacgtttattagctcacggttctgtaggtcagaagcaaaagcaggctttgatgagtccccctccttagggtcttacaaggctgcaatcaaggtgttgcctgggtgggctcttatctgcagattctgggaagaacccctatccaagctcaggcctattgttggccaaattctatgcctcacagttatgggattgaagtccccattttttttcttgttgtcagccaagagctactcttagctcctaagggtctcttggattccttgtcacgttgcctacatctttgagtgtagcaatggttcatcaaatcctacttatgcttcaaatctctgatttctgctacttgctggtgaaaatgctctgccttttaaaggctcatgtgattctattgggcccacctagataatcttccttttgccatgtacgttagcttgctaggactgccgtaacaagctgggtggctactgtgtttgaatgtgtcccccaaagtttatatgttgggtacttagtccccaatgcaacaatgtgagagttgggacctttaagaggtgattaggtcacgtgggctgtaccctatgaatggatttgtgtcattatcaagggagaacattagttatcattgaagtaggttcctgatgaaaggatgagtttagctcccttcccttttcttgcgtgcatgctctcttctatcttccactatgggatgatgcagcaagaaggccctcccaagatgtgggctccttgaccttggacttcttagcttccagaaacggtaagaaataaatctctgctctttataaattacccagtctccagtattctattatagcagtacaaaatggactaaaacagtggctcggacaacaaaattttgttgcctcccagttctgaaggctagaagtctgaagtgaagttactgatgctccttgacttacaacgaggtgatgtcctgacaaacccatggtaagttgaaaatattgtaagttgaaaatacatttaatacaccaaacctaccaaacatcatagcttagcccagcctacgttaaacatgctcagaacccttatgttaccttacaattgggcaaaatcataaggcaaatcctgttttacagtaaaatgttgaatatctcatgtaatttatcgaaatgttgtactgaaagtgaaaaacagaatggttgtatgggtgctcaaagtaaggtgactactgaatgcgtaacactttcacaccatcgtaaagctgaaaaattgtcagtcaaatcttcccaagtcagggaccgtctgtattggcaagattgattccttctgagggttgtgagggagggatctgttccaggcctctctttggcttgtagatagatgactgtcttcatatttgtatggtgttttccttgtccaaatttccttttttatcaggacatctagtcatattggatttaggccaaccctaatgaccccatcataactaattacatctgttaccatgtttccaagtaaggacacagcatcctgagatactggggtttaggacttcagcatatgaatttagggggatgcaattaaactcatagcaccatatatcatacataatcataacagtcacatcttatttgctcatactcaaaagggagggatttggacaaaggtgagggtcattggaggtcattcttagaattctgcttgtcaccctgcctctgagtcaggatacctgctcagagggatgtgaggacagctatgatgaataaaaagaatactgctgaccatggtgagaacagctacagaggagtgggtgaaggccatgatcaatgggttgcaagtgaacaagaagtgaagaaaatgcagagactgctccactcaagaagcagctgtggccaagaggaggccaggtggtgagaagagagggaaacagaggtgaataacagttccactaaaatccaagagacctgagcttgctagttgtctagagacaactgacagagaggggcttgcaggcggctaaagccattcaacaatttctggttgtccacatgccccttctatgggaacttgacttggtaccaggtagaggattttgtagaactccacatgttattaaatggcctttgcaaagagacttgtgtgcaatctggctgaattatagttcctttggagattcatgtttgcttacttgtggctctgtaactctcagccttaatatcacagaaatgcatttctatctggtcttcacttccctgattctttaaaaattttatgtgattgttcttggaaggaaagctttggtggaatccagacatagtattggccactattgattgagggtctgctgtatgacaggccctgtgagaagggtgcatgtatattagtccttatttcctttttaccaggtagattgttaccttcatttcacaaatggggaaactgagtctcagaaagcttcagggctgtggctgaggttatagcattgctaagcagtattgctctgcctcctgggttagtcaccgcactcacattaaagacctttttcttctgaaagttggcaattttcttttgtcttgataaatgttattttcctaggatgtacttagagcaataaatgttctgtgaaaacaaaagtgtagtgttcactttctattcccctcccagtcccaaacttctgggcttcccagttcacctatttgagaaattacttagtgaaacattttcatctcccacccagaataattcattgccaggcaaagaacaatgcagagacattacagccagtgagactttttccaaaggtcacacatcgacgtccagggatttgtgatggacacagtgcccaaggcacaacatcacatttgcttctctttctggatgcgtttcatcatgaaagggtttgcaagcctccatctgctgacttgcagtgggctgttccccaaaatgcatgccttgttctcatttccaaggagaattgcaaatcttagaaggtattttaagggaatatgacaggagcaggaacccagagcaattggaattcagagtggtggagtgaagaatcagcaggcatggctgccagagtttgtaggcttgagaagcaatgaattctgccaggagtgagagtgcttggtgaaaaccctggaaagaaaatcacaggttaactgggttttagaggcagtgtaggaatctgtcaggtgggcagcaggtagaaggtgggagagaagaacatctcaggtataggagagatacacaggtttaaatgtcagtgctgtggtgccaagtggctcaagtataattgagtatattagtaatgatgccaaccgcccccgtaataataaacacatacatttttatgtcacctactgtatgtcagggtacattaattatattctaagcacattaattatattaactcgtatattcctcagtgcaaccacacaaggtgaatactgttattatccttgctttacagatcaggaaactgaggcacaaggaggaaaataatcatgccaaagaactatcaatgagcagattggggattttattccagcagtttactctacagcagctctgtccagtggaaatttcagtgatgatggaaatgttttgaatccttgcttttagcaaggaagccaccacccacatgtgctattgagcacttgaaatgtggctcgtgagacacatgaattttacattttaattttgatttattatatttaaatgtagacaggcacatgcggctagtgaggacagtattggacaacacagttagttagagtctgcttatctataaccccctgctgcctttcaaattggggagtgtcaagttgattctgtcatgatagttctagcattaaaaaccaccacaggaatcatggccatcatttatttagctcttatgtgcagggcaacatgctcagtgcttcctgtgggttatttcatgtaatatccatgacaaccttatgggtgatggctaagagcatgaactctggcaggtttgaactaccagtgttcaaaacccagctctgctatttgttagttctgcagccttcagcaagttgcttatcctttctatgcctcagtttcctcatttggaaaatggagtaaataatagcatccccttcatgtggttgttatgatgatcaagaggctgtcctttggaagacagcacagtgcctgacatgggacaaattcagtatctgaaggtattgttattattacccttatactttagatgaagaaaccaaggcatggaaaggtaaagtatcatgctgaaaggtacagctaactgagggagagttggaattcaacccacaggtagcctgatttcaaagttcaggttcttaacaattatatggtggtttatttttttcttttcttttctttttctttttttttttttatttttgagacagagtctcactctgttgcccaggctggagtgcagtggcatgatctcagctcactgcaacctctgcctcctgggttcaagtgattcccttgtctcagtctcctgagtagctgggattacaggcatgcgccatgatgcccggctaagttttgtagttttagtagagacagggtttcctcatgttggccaggctggtcttgaactcctgacctcaagtgatccacctgccttggcctctcaaagtgctgagattacaggtgtgatgagcccagcccatcctgtggtttccgatcacagtttctaaaattgtggtttgtggagaactggtactaaaatgcttcagagtgcttgttgaaaatatgattgcctagactcactaaaaactgttcaattagacttttggggtcagagacctgggaatctgcattttaataaatttcccaggtgatttttcatgaacaccttaactaataataaatcaattaaaaaatttaacggtaagagaagtagaaggagagaccaggttttcagatgtagaagataccctggagagtagggttattctgcaaacagacttaattttagaaagatctttctggtggctggtgttgaagatggacttgataaagaacgtcctgggggtagatgtggggtgtggtgatggggctcattagtacagtgacagagtggacagggagggagggacagattctttggatgttttatagtaaaattgacaggatatggtagattactagaaactgaggagaaggaaaattaattgagaatcaaaaataatcctcaggtttctatgacacctgagtgggtaatgatattattaaccaagatggacaaggaattttggagattcagataaacttgaggacttctttggacatccaggtggagagaatcattaagcagctggaaatttggttttgagttcaaaagaggaatatatagcaaaaataaagtttggtgtcctgtcaacactaggggtggtatgtgacctgtgcagtgggtgagattgtcttggagaaactaagtggcaaggctcagcaactcaaatattgccaagggtgaggggttgaaacaagtgtgtgtagtggcctggtataagagaacaggtgttaagctgcttttattgcagctaatctaataactgcccaatcacacagcttttgaaaacactctatcagccacttagctgtacgacactgccccaagctcttagcctctacacacctggcacctcggggtctaagcctactgggtctgaccctattgagagcactcgggtgctgcccatgccagaagagaaggtcaccaaagcctagcccctgagggacaataacactcgagggctaagaacaggagctagtgaaagaggcataggaaaagtagatagaaaagaagtaggagaacaaggacacagctgtgttggagaggctgaaagaaagaaggatttcaatgagagggttgtcagcaagccacatgccaccaagagctcaagctgaagcctggggagaagttttggcatagacttgacaagctggacgtgcttggtgtcttttgccaccagtagagtaatgggggatggagccagggagggaatgagagtcgcaagtggaggcaaagaacatagattactttcttcagtggggaaaggaatgtgaaggtcacttgcttgagggggagacatggttggcacggggttgtttgtaggataagtggggcttgatcatgtttgtagggagagggaacacagagccagtggggtagaaggatctgaagatagttaaaaaaaatgacttttggatcaaaaccccagaggagggaagaatagtttgtatcttgaaaaaaaccagggtacctctttctttgggctaggaggaaaaggtagagaaaagcttagatctaggggcaagaatttgtaattggaattcttgcaagtgtaaatctaggttgtctgtttaaaacaagggcattggtgaagaacaaggataaacgtggtaatgtctacagcacattgagcatctgcacctgtgtgccaggcattgtttagcgctctttgggaattgtcttttttattcctgaaaggcaaatgtaattggcatacccattttacagcccacaaagagaagttaattgcctgtggtcacgcagctagtaagtggttgagctgagatcagatcccaggaagtctgagttcagagcttgctgtagctgctatacagtgtaataaagcagcaataatgatgacttgcattctcatagtactttttttcttaaaactttatccctattttacaggtgtggaaaccaaggcagaatttttacaggtgtggaaaccaaggcgaaatttgctcaactcatcacgcatcttggtagggtcagagctaggactggagctggggtctcttactttctagtcctgttctgcttcccaggaagcgaacacccacaagtagctcctgagtaaattatgttgcatttctgacatctcattccctctcttcctccttctattccagtctgcctactcctaccctgatctggaccccaggccccaaatgccaggaaggtggcctggcacctgctccttccttttggctggaatctttgtcctcccacatgagggcattgcccgcattccccaccaccactgccttgccttagtatgaggggcctcatgcaggcaagcagtggagtagaaggccgcatttgttttgcttttattgttaaataatataaatctcttggctgcaccaccggccagtacgtgagttgtgtgtcttcctgcatagttgctaatgagacagttaatcatttgtttattttgtatgaagagaggtggcagccatatctctcaaaccagacattgggctccaggaccctcagggaagctgcccacccctggcacatgagtcacccacagtcccagcacaatcctgccctgcaggccccatcaccttcttccctgaggaatggccaagatgcaggcatcagctgatgatgatgatgattactgttattgcagctattatttttataaatactcccttccttgagatgcaaaaaaaaaaaaatgtaatttgcaaagatgctttgttgggagataagtaggcttcctcttgggcacggagtttatctcactcgtgcataggttcctagaggtcgtgcaactcacgagataaagctccaggatcctccccagggaaggccagagtcagtgttcagctgttttcctagatccagggttaaagaggtgaaatcaactatgttcgtcctgtaggctccctggggccgaggctgcttttattagagcaaatcaggcctgtccagaagctgtgctatgggggaggagagagccaggaggaggtgaggaggggttggggtggggtgtgctgcagggattgctgtctgcacctgggctgcccaaactgaatgattgtcttaaagggctcccatctcatcgatttgcatgctgtcagcatcctcctgctattttcttggtgtttgtacaaatcctattgcccgaagcttaaatttcaattaactgggtccaactgtctgtgtcctgaggcacagggaatgggctggggttgctttgttttctgctgcggcactccatccttggcagtctgtctgtctgtcttgaacctcctgtcctgaaggctgcacctctctgtgaattgcttgcattccacagtcaggggcagaattacccagggcagggcttatgttttaggagtagttgatggctagatcaagaaacaggagcatgcagtggagtggaatcatccccttaccatggttgatttctagctttctgcttccccctgtgacatggtgagatgcttttatttttacttcctcatccagatatattcttgatctcatccttctttctcctccctattttcttcttctaaatatgtctttttaacctctgcatctttgttcttgcaatttccttcatcagaattttcttcccttccttttcctaccaatccttatcaaaatccatccttcacagctcaattcaagcgtcactccctccaggaagccctcccactgtccttcccagaagacttgaccttgctttctgtgcttccgattccttggatctcacagttctcccttcttagagtcagagctagcatctcattctgtacatcccacagtacagtatcacaccattcatattattttttttttttggttttgagtttgttctggttgagttttgttgtggattgaatggtggttcccccaaaagatatgttacatcttaattgctggaacttgtcaatgttaccttattggaaaaaatggtcatagcagatgtaatgaagttaaggatcttgagaagatggagagatcatcctggattagccagacggccctacatttaatgagaagcgtttatgtaagaaatacatagctgggtgcagtggctcacacctgtaatcccagcactttgggaggcccaggcaggtgggtcatctgaggtcaggagttcaagcagcctggccagcatggtgaaaccctgtctctactaaaaatacaaaaaattagccaggcgtggtggcggggacctgtagtcccagctactcgggaggctgaggcaggagaatggtgtgaactcaggaggtggagcttgcagtgagctgagatcttgccactgcactccatcctgcgtgacagagcgagactctgtctcaaaaagaaaaaaaaaaaaaaaaggttaggtgattgtggtggtgcatgactgtagtcccaactttgggaggctgggacaggagaatcgcttaaacctgggaggcagacgtcacggtaagcagagatcatgccaccgtactccagcctgggcaacagagggagaccctgtcaccccccagaaaaaaaggaaaaaaaaaaaaagaaatacacagggaagatttgacagaaagaggaggagacagtgatatgaagatggagacagagatgagaacgatgtggccacaggccaaggaattctggcagccaccagaagctggaagaagccaggaaggattatccccaagagccttcagagggagcatggccctgccaacacctagatttcagactgttggcctccagaactgtaagacaataagtttctgctgttctaagccatccagtctgtggcaatttgttacagtagccctaggaaagaaagggttctccttctctgaaagggaagacagggagaggcaggaagaaaacaaaataccagcatgaggaacctgtacccttccttccagattttattatcagcttgggtccttctgttttatttcatacaatccaagtcctgttactcccacaccaggccttgggttgtctaggcagctgggtgaaaggccacatttgttttgcttttattgttaaacaacataaggacagggccttgtcatgtgagaacatcaatactgaataaataatatatttataataccaataagagcaattgacatttgtatagcctttacaacttacagattactctgacttacctcattgcgttttgtatttatggtaaacctgagaggtggttgttgagatcctcattttacatttgaggaaatggacagaggtgggaaggggcttgtgtatgaccatacagcagatgtggttgggccaacgctaaaccatcttttggttccaaatctatttcctttaactgtgcacataatattctttgattatgagacccagtaggtcaaatctgtttttaaaattcttttcaaaatgggaatatcctttgcctgagctagggatacctggtttccttcttttcctcaaggtgtgctcaaactcagcagggtttggtagtagtggagaggctgagagaaagccctgcttattcaggggtctttgttttacaagttgtctctgtatgttgatcctctgttattgtttgggtaggcactggggaacctctgtgcttgcatgtgggcatgtacacacatgcactgtgcgctctgccagctgttatccccctctggtgctcactggcataaatctgccacctgatcatctaaaatcccagtgaaaggaaaattgccaggccaggagggtccaggggagaatcaatatatctagtatagtttatatttgtaccttctctccttaagagttacagtgagtgactctactcctcaaatggagcacctctctccaggagagtaagaagatcacataaatagaaagtgagctttggactctaacagacataggttcatattcaactctgctacttaatatccatattggtttgagttatttaaccttgacaatccacactgtaaaatgggtaaataataaataccctcctctcagaagtgttacaaagtttatatgaaataatgtgcttaaaaagctgggtacatagtaggagcttagtcattgtttattttctccctcatacccatacatgattcattctactgttaaaattatgcttctattgtaaccacactgtcatcagggaacagttagtagcattaggttggtgcaaaagtaattgtgtttttttgtcattacttttaaaggcaaaaacagcaatgactttttcaccaacctaatagttttgtcacattgtcctctagtaatgatgccctttttgcaaaggggaagccaagggcttgaagagaggaactgaaatattaagatttcacatcaaatcagagttagggcttaaatagaagtaaaggcactcattttcccactttagtgggaagggaaataaaccaacatttattgacctcctaatataagccatgtccttccctcaaatattttattctcacaagaacatgatgacatgaatagtgatattatccccattttacagatgaggaaacaggcttagaggatttcagttgctgtaggttacttagcagagaggctgccctccttcccagggttcctggccccagggtgcccagctcctgtgtttttctgctccatcatgcggctttcctcggagtcctggggaaaatacagctcaaggagggtccatgtgtaaggatgaatcaagaggagcatctcattatcacccctagttgtcaaagaacagaatctacagccccttgttgcttgtttcctcccagtcattcagctctcaggagtggagttaagatggaacctgactggtaatgtaatgcaggacccaaggtgtttcccataggtcatgttgtttatggatctgatgtccattatcatttgaaggagtgtttggccaggcgcagtggctcatgcctgtaatcccagcactttgggaggctgaggcgggtggatgatctgaggtcaggagtttgagaccagcttggccaacatagtgaaactgcgtctctactaaaaatacaaaatgagccgggcctcatggtggatacctgtaatcccagctactcgggaggctgaggcagaagaaccacgtgaacccgggaggcagaggttgcagtgagccgagatcgcaccactgcactccagcctgggcaataagggcaaaactctgtctcaaaaaaaaaaaaaaaaaaaaaaaaaaaaaggagtgtttgagtaagggagtaaggccacccaagatatttaatacaaggcaggttgtaagtttaagtgagtatagttggagtaaaaatagaagaaattatatctgttcttaaattaaactccagggctgtgttttgcgaaccaattaactaaaacttggagtcatcctgttaggctttgctgagcagtggagggacttgtggggaaatgtggttgcaaaggagacaggagggaagctgaggaggctgaggagccacagatgagctagggagatgcttgcagcatagcacgtcttcctgtttggttattggaaaacctgggtcctagttcttgatctactagctctgcagcataggagtcattatctctccggaactcaggttgtaaaataaaaaggtccaaccagatgatatctagggttccattcagatataagcgtgtgctgttttttgaatgttagtgcagccagagggcctgaaaagtgacggggaggcagagagccttatcagatagaacaagcagcatttcagcagggtgcagaaggagctttggtggctgtctctgtatgtgcactgggtggagaaatgagtgtgggcattgtggttgcattaggcccctccccatgttctctgttctacagtgccttgagcacagctttattatcttaaagcatttaccaagttctagtgtctttgggcagcaagtccctcaacagactgtgagctccatgatgggaaagaccaactattgttcactgtgatagttgaaaaaatgaatgcatccaaatgcttttggattccagtttctctagagatgtcttttatgtgtcatttttgtagtttggtctcttctcaatggaataatagatactaaatatcatattaggatgggcaggtgaaagtgagtcagtgcttgcagagatagatgaacattggaagctgttcttgaggttctgttcagaaagcctgctcgctcttagtccctttcctgcttgtgggagagtgggggtaaagcttcccggcaaagtgtgagtggcaggcaagcctagctattcattggctcacagcttcggcatagaccccatgcccattgctggcctatggcaaggcacagcaagcttgacagtgcgtgcacctgaccttgcccataaccattaatcagccatcatgtccacagtcttccccacttctataaactactgggacagtcactggaggaactgtcattttttaactcagcgcaagttttgttcgctttagatttttgggctactcccacaatttagcctattccctctcttttttccccaaattttatttttatcttggtaccaggtcaatgagttgagtggggcctggggaaggatgataaaaaagaccaaagatacacatgcaagatgggggcgtgcttatgaaactgtccactggacacccactatgtgcttaacattatgctctaggcttttttttttttccattataacatcatcatttcccggatgctttcctcatggcctctctatgtaaggtatacttcatacttgctattatagttaaagttgatgacataacatttaagtgtctaggccaggacctggcacaaagtaagaacttagtagacattaattgatgttgttgctactgtgttcacatttgatagtttaagggtcttcatgatattctgcaatgtaaaaggagaaaacaaacttggttagttggagatagtccatcatttgtagagcaggataaatattgctgatcattaaatcatctcagactttaacaggtgaagaatgagtagctgccctggttaaagatcgcatttgcctcaacctaagttggggctcagaaggggaggggaaggtgtctgttccagtctctgatttgtttctaagtgatttttattgccatcacttctaggtgtctaagtgatttttattgccatcaacttctagttctcaggatgcatgacatggtccctcattccagaatccagcctctgagctttactcgccatttaaagaatggtgttgggcctgagtgtttctgtccatggtgctaaacacagaactctgggactcaaaagcagatggtactacatggtcactctcatctccatagcctgcgagatgagactgctgtgaaaagaaggctggtttgggagttaggaggtctagtacagtttcaatcacttgctgtgttgcctcaggcaaaccacctaacctgtctgttgcagtgttcccattggtaaaatcgagttgctgcattctgtcattcatatttcagagtgctgctgatttctgtgtgagtaaatgagataacagatgctaaagtgggatatgaatgcatagtatgattatgctgcaattgcctctcattcttttaatcatacattttgactgtatcgttttaatttacggaggcaccctaaggcctaataacatataatgcagcatgcaggaaatcaaacaaacagataaatgcactggaggaagaaagaaataacttttttaatatgttgtttgcaagtggctgtatggctgtagaacctggggtgtgtttctaagaggaaagataatgaccagtgaggggccagcccttgtctggaaggagagaaaaactcataaaatctcatcaccactccaagccccaaaggggagacccactttactgtcacagtcctgaaatctcaacattagcttgatttccttttttagcttggtattccttgtccttcacagaatagttgcaatctccctttttgagttaatcatgcttgctatggcctgagatttgaaaatggagtctgtgggtttaagttcttcttttcctagttatagaaacttcataaagcaagtgaggctcttatagcctacctttcttcatctgtgaaatgggctcagtagtcataatatctccatatgggatgattgaaaagatacagttgtaaaaatgggccttataaaaatgtaccagtagttgtcattgttattccctgacatgctctgttcaaagtattgcatgagcaggttttgccttttccccatcctgtgcctttgtgtgttctattctttttactgggtgtatcttcttcatctcttcttttaaaaatctcactcctttaaagcacaggtcaaatactaccttctttgacctccccaaccataataattttttcctttctagaactcctagatagtctatcatctttactgttcaacttatgatctccttgcacggtggcatctagtttagtcattttttttactttcctaaatagattataagaccctgaaagacggctacttatctagcacagtgtgtagcacagagcaattgcccaatacctgttttaattggaatgcaggatgaatattacacagcactcatggccttaggcttttgtaaaaatacaagcgttgctggaggaggtgactcaataggtcatgggtacttgcatatgcattaagaacattgggtttgggtagccaaatgaaggtggaaaatctggaaagaacaagttgaataaagaagcaggagctgctaaaacacgtttttttcactgtagcagtttttcctaggctagtcctggtcttggaggtgctgtgaaaccagtgtattgacttggaaagatcccttagatctctgaactgggacaagggttgcaattcacggacaccggatgttgtgcaatattcaggtctgccagaaggtggcgcattatcactaatttcatggtctggcagctttgctcctggggatccccaaagttggtgtgggcattctgatgggtagctctcctccgcattttgtgtggttcagagcttctcccctcttatcccctcccctgcctgcattccactcagcttctttatgatgtataaagatgaaactgaccccagtcttcagcctgaagagtgccttccattgggcttccacatttgggaaggttcccgctgagatgggacagaagtgtctcagcagtctctcagttcctgcgtaagttcagaaccaactcaaatcatgctctctgcagtggaatctccccaccctgggcgcggagagagtgagcactcggtgcctttttggataaaccaggtaaagaagaaaacaaattactttttagtacactcctttattcctcattccctccgcagcctcctatgacttctgatttcttgtctgaacttcaggaacagcacctctctctgtgtcttcctcatctcactcctatatggtgtttcattctctttatggtgttatcacatttatttatttatttttgagatggtgtctcactctgtcacctaggtaggaatatcgtggcgcgatcttggctcaccgtaacctccgcctttcaggctcaagtaattctcatgtctcagcctcctgagtacctgggaccacagtcacaagccaccaggcctagctaattttttgtatttttagtagagatggggtttcaccatgttggccaggctggtcttgaactcctggccccaagtgatccacctgccttggcctcccaaagtgctgggattacaggcatgagccaccgcacccagcctgttatcacatttattatcttacattttcacacaatatctctaaaatgtgccacagatatttttctctattttttattagagcgttcacgtttatatcacgcaccatttaatttgaccctcacagcagctatgagaagttttggggcatgagcattaatatctccattgtacagatgaagacacacacaggaagagtaagtgattttctcagaaagtataagatgttcaagaacctgttcatcttgttgctaatgtactttactcttcttctcactatggatgatgcaaataaggctcaaaaggaagatatgacttatccaacgtcctaaagtcaatgatggtataaatggggctggaattaatatctctcgattctcaattcagtgttctttgtatcccactaaggaatccttctccattctctaacagaccattggctatctgtctacccaactcatttcctatgtcttcaaactcttaagcacacgtcaatcagcatttgacagagggtcccaaaggtgaatgcctgaggcatatggaaagctcatcaggaattattattttaaatttaaaatggataaaacaagcactggcaagaaatccatcaatctgctagcaatgactgtgcaaatgactgggtataggtattagaggtgtaccgcaatatctctaatactgttacccagtcatttgtactgttattgttagcagattgagaaaagtgttttcatttttctgtttctatgttttcaaaattttcttcagtgagatttttaacttttataatggaaaataaacattacaaagtggaaaaaaatgttttgtgccacaggtttgggatgtgtttgtgcagctgtgtgcatgggagtggctgttgccacattgtgttaaatgggatggaggctgggtagggcaggaactgtgctccagtcttctccaaggacaggtcattgtgtcattcactggttcccattcctcccctaaagccctggctgatgattttcgcacgctttacttaataacttcctccctacctggagcccggtggaatccacaaagccataagcacacaccagcctggtaggttggggcaggtgggaaggagctctgggaggctggggcatcagaacttcaccctctctggtcagagctgtgggctcctgagcttctccctctgcctgctgtggacttatgtaacacattcacaggacttcattttccagtagattgaaagcaaagccgctgttgattttctccaaaatgatctatttggaagtgcaattgcctggaattacatggtggcgcgagaggttagaccttgctgtaaataactttcctctcagccacacaggggctcagctggaagcagtgtctgggctttagatgacggtgtttggggtgtgtgtgtgtgtgtgtgagtgtgaatacatgtgtgcatggtcttggggcctttgctcaccttgctaccacttcttctacctttggagctttgcatcagaataaggaatgagggcagagatggggaaggatggggttgtgcttgtggtttcttttatcagctggtttatagggcctgtctctggccacctcttccccttattgctgcagggtccttgagtcatgtgaggttgagtaactcaagcacagagtgtggagtggcacaaagaacaagcttaagaattggacgtttctgagttatagcaccacatgtgcccaattacaacatacgggaccttagacaattgcttacatctatgacctcctgtgtctttatacattaaagcaaacaaacctaaaccaaacaactggtataaggtgtgggagttgagagtacctacatttcagtattgttgcaagagttaaaggaagtaatgctggagaaatcacactgcacagtgtctgacacttggtatgtgttctgtaaatttagttccattctgtgccctgccttgcctttcatgacagattgaaattaaaagcaaaagcaatgggcttggaaccaggatggcctaatccaaagttgtgaaacatgcaaagtctggggtgtttcacttctttctatactcccttcccgtatagatagccatagcatacatacatgattcccccaaagaaagactgtaataaacgaactctcactgcagcagatgggacttaatgctgtctgctcctggtgggcatttgtattttaagagtcctgcgtaggcacgtagaggacaatgtttaacccaaagatggcagcattttatgcaggatggcatttagatggcagagctatttttagattagaaagtcttacatttactctggccattcttcagaccagccttatttgcaggcgttagaatgggattatgtgctagatcaagtggacatttttctcaaaactcacctagtgttgtccttttcacatttccccatgaaatttagaaaataatagaatcttatcaaatatggactacatcctcaggagaagacttccagacagttctggagaaggcatctagccgcccacctacctaacattttttggaatcctacactgtaatataataaatatagctgacatttatgaaatattttgctaaatttttatgtgcataatctgagttaattcttactacttccggtggtactgatattatgatgccattattatagcatattggccaagagcaaagatgctggagccaggttacttggctcaagtctcagctcaccagtcactagtagtgtgccctaaggcaagctgattctctgtggcttgatcttcttatatttaaaggaggaatataatagtactacttcataaggctgtttggggcattaagtgattcaatgtacataaagtgcttagaagaatgtctggctattattatcaccattaaacatctgagaaaattgtggatgaggggaagggaagtgattttcccagtgacacccagatggtgacagatccaggtcaagatttcatgccttaggactcccagcctagtgcttttttcttggtatgaggaatatgtggaggatctttaatttttcccacattattatctctcaaggcagctgtcagtcataagtaacagcatttcagaatggctgaaaatctagatgagaacaattgaaaaggtgagagcttgtttaattaaactagttcctgaaagcatgtaaaaagaagttttttcataaagtggtgccaatttgggtgcccaccccagcttggcagttgcagcttaagcactagttagtgggcttattaatcaatggcatcagagccaacatccaggctacagctagccttctagagaggtggtgctgccaggtgcaatcccaagatgagagtcaacttgtatgataagcataggtcaagctctgagttttcattagaaaaaaaataagtggctacttcataaaatatgttaattaaccattgatggagttgggatagaatgcgaaagttacattttctttagaaagtataaaaaccctttagagtttttatttcctaaagtgacccagaacaagccttcaatagaccaagtccaataatgcctcatgtgtttcagagggagagggtgggccagatgaggagggtggtcaccaggagttctcctttgtcctcctcccatttctcttgacctctcttgtcataatggctacagttccactgttagggatgtattattttgggcattgatagtgtttaaagagaaatttaatttccaacatctccaagagacaacaaaattatatagcatcttatatggaactctcttcctccctgttcagatgcagcagccaactaggaccatgcggccaactaagaactggaaaataaggcaaggtgccttgggaggagaaagggtggatgatatatgccgattgaccattttgctaaagcccaggtctactttatgccattttgctctgcaaagtgctgctggaagaagttctgtttggaattaagttagaacagggagctctgatccaacataagagagcatcccactcaaccaagataattaagagtttgtcctttcttcattcctttttccagcataagaaagagcatcctacttgttttggattgaattttatcctctcaaaagatgttgaaattctaactcccagaacttgtaaatgtgaccttatttgggtctttgtagatgatcgagttaacgtgaggtcattagggtgggccctaatccaatgagtatgttctcataaaaaggggacatttggacacagaaacagacacatatacacagggagaatgccatgtgaacatgaaggcagagatccaagtgatacatctacaagccaaagattgccagcaaatgaccagaaactaaaaaagaggcatgaaacagactctcccttagagtcctcggaaataaccagctctgaaaacacttgatcacagtcttttagtctccagaactgcgagacaatgaatttctgttgtttatatcacctgctttgtcgtactttgttgccctaaaaaactaatacaccactgaaccaagataattaagagcttatgtcctctcctttccttctttcagtaaatattagatgagagtctactgtgtgccaggcacaataccagatcctgagaacaatatcttagataagatctttgcttttaaggagttcatagactatcagggatacggataagtaagcaggccattactggctgtatgataggtatttcatgtcttttttcccctctagaccactagctctcaaccttcaccatactctagcttctcctgataacttaaaaaaaaaaacctatgtccaagccccattcccaggcattttgatttaggtaccctgtggtgggaacaaggctttggtattttatgaatcttcctaagaaatcccaaaaggctgttattgatgaaaaccactgttttcaaatatacccatcatcagggccccagtccacactaataaagttggaatggtaatgatattttttagaaagcttcccaggtgattctaatgtgtagccaggtttgagaactgctgtctctcctgagaggtagggatttggtctgtctcatttaatgctgtggcctctctacagtgtctgtcacagaatagacagtcaataaataattgttgagtcaggatctatgatgagaaaaacataaggtgctatggtgcatagaagatgagtgctcagggcagtcattagagaactgagacctgaaagatgagttgacttatccaggcaaggagggaagagaagagtgtgtctggcagagggaacaggatatgtatagagccaaggagctggctgtaacttggcatagctggagcaaaatctatgggtggtgaggggtaagactggaaagcggagcaaggactgggtcatgaagagccttgcaagccacgaggagtttggattctgccataggcttgtttgtgttgtccaggggcatagccatgaactctcaaggctgatttttgtttccttggccttgatgctcacccaggtcgagagtagtatcttgcactttttctctttgaagacaaaagcccaaggagggtgtggcattttgatgcccagggctgtaggcccatctcataagaggagcattgccgtctttctggagagaccatcaagtgtcgcaactgcactgcaccccctacatgggaccttccatcaccaggacttgggagttagattccccagccctccttctatacttccacatcttgggtggaccctgggggagcttccacatccctctttacacatccttcccattcctttcagtccagttttacctggacacacatgctaaggatggagagggaggagaagactcagtgtgatattccccagatggtccccttagggagagctcctgggcagggcaggttgatctgtgcaggaggaacctaaccctccatcccaggggcttgcgcatatatccgctgggtgcttgcttgtctgagccgtgctgttggcagcagtgcccgatttagtactctgcagacttcattaacagcctgcctgttccactccgagttcttaatgaagatgttaaataaaatgtgatgttagtattgccatttgtacagcacttcatatttaccaagcacctttagaacgtttttattcttttccaagtgatagccccaagaagtcgattagtactgctgccccattctacagagaggcaggcccttgggagttcattgatctgttgaaagccaggtagccagccaccaccccaccttctatcaccagtgggcattactcaccctcttttgcccagaactcaatttgttgagctgctgtagctcctcagggcccaaggacatctcacattcctccctccaaattccagactttgctctctaaatattattcctcttcatcattcttacaatgttgtgttttcagtttgggaaagccttagtcttctcttggtcaatttgaatgaatttgcaagtgaaatatcctgatggacatcaaatgtctccctgaccatctaaacacacagcacgcctcagggcccctgttgtccatcctgcctctttccaaagcctgtcaatggcactgtgtttgtgtctggcacgatctgtcttctgtaaacagtcgcaggacaaacagcactgttgtcttcctaaatatgacagtcgacacccccctacgacagtttttacttgtgaaaccataaatcagaggctccaagtggcagcatctctaaagaactgaaagaggaagtaaaccttgtaaagaaaagtacaaaaagcggctcaggtttgcttctctgagccttgttggagcagttgaataaggcttattaataggtttacttagctctctgtgccttagttttctcatatgttaaatggagctattaatggaaacacaggtatgtaaagggttttctgctttaatgacataagcattttgggagggacttcttgcaacactatttttgacttcacacttttaaaaacctatcactaactttctttttctagcgtactatgctgtcttcatgttgccttctttgcgtgtacttcatttctttttctttcttcatccggctttctcttaccttcttatcatctgtcattgcattcatttattccttcttccactgtcctaaatctcatcaccttcttattctgttccttatcctagcccatgggagggtcccctctgctattactgactggcttatcccacaggattctgccttttctccccctacaggctctgcaggatttctttccctttctctctctctttctctctttctttctttctttctttctttctttctttctttctttctttctttctttctttttctctttctttctttctttctttccttctttcgttcgttcattcctccttccttccttccttcctctctccctcccttcctcccttcccttcccttccttgcttccttccttcttccttctcctccttctcctcttcttctttctcttcctcctcctcatctcccttccctcccccatcccctctcccccgccacctcctctttctcctcccactctgtggtccaggctggagtgcggtggttcaatctcacctcactgcaacctctgtctcctgggttcaagtgatcctcccacattggcctcccaagtagctggaattacaagtgcacaccaccacactcagctaattgttgtatttttagtagagactgggttttgccatgttggccaggctggtctcgaactcctggtgatttgcccaccttggccacccaaagtgctgggattataggcatgagccaccacgcccagccaggattacttcttgatggaggatttgtgatgtggtgtgggagtacagagcgaggatgatggtggaaagatgcaaggccccctcacttcgttattaggtgatagaggagagggtgacagtgagatagtaaatagctgaggggattctgagttctttgactcagggagctaccttctggtccaggatcaggtagtactgagggttacaaaacaggtcaaaatggcctggcaacacattgtagttcttcaatggaaagaacattgcactgagaattaggattgttaagtcagaaactgtgaagggtctgagactgcagcctacttgcaagctaacaagttaatctgccacaggtagatattatatatatgtatatggtgtatacagatatatatgtgtgtatagatatatctgtatatgtgcatacacacgtacccacactgctgtcagggtacataatgagagaagatacaaactctagatcaaacacaaagatcattgattacttatggcaaatacagcaatcaaggtgatctcttgcattagttctctgaatcctgatgcccatgggtgatgtggtaagggccagatggtagttgcacatatagtggagcctgttaagcaggagacaccccccgctccagtttagaaaattctctgaccttatctagggctgctggtgacctgctcatactcttccctgcagagagagaagaccttaactttactctagaatatgagcaaatcttcagagaaaggagggagacctaactatcctggaatgtctctggggaaggagacagtctctatctttgttatactggtcaggaaacaaatctgccttctgacctagagagagacactctatttcatttccaagaatttttactatgcaaccaacccagaaaaaattgtcagtagagccctttgctcagaggactcaaactgtgcagaaatgtgagatattcacagagaattgtcttccaacagggactcttaggtgtgaagtgaggggcttagacaacattagagacttgaaaaatgtggaatgtgtgtaccaccactctccaaatctatgcccaaggcagccatcactaattaattggggttttttggtgcaaaaccctaggcagtctgtactatactgattattacctgagtcccctctagctgtgtgaaatcatattcttcacgtttcctcctgtgttccatcttttctacttttgtgaatctgtgtatctatttatatctttatctgtctctaagttggggaaaaggagaacatctcttctgaggcaattttgtggtttaagattttcgtacaaagcaagttcttaatcctaccaaataacattctcaatttagtctttaatccatgagaactgtagctattaacttagagaggcttcccttgcaaacagggattaatagaagaataggtgcctgttgttatatctccttctcaccattggctatgaaagtattctccaaattcctctagagtgatacattggagccatctaactaaggagaagactttaaaagaaatatggcgcaggtgaacatttgcttggagaggggaatcctacatcagaatagatacagtctgagactccttccaactctgagattcgaccaatgatgccacctgggcacttggaagatgtccctttacctttgagtcaatttggactctactcccagcccaagtaatcttttccttcttgtgttctatacttcaaattctgcgtttattcagtgggtagatgtggacttacatagctaacatactggggtttctactgaagacctggttatattttattgccagccactgaaatgaaaggaatcaagagaataatgggaaaagtatatgaactgtgagtagggcatcaaaagatagaggatgctgattagctaagtgaccttggatgcattacctagcctcctcgtgcctcaggtacctttcttgaaaatgaagaagttaaggcctgcctggctgtctatctcatggagatattggcagagcaaatgaggtcatgttcagtgtatgaggtgcccagaaaagagatgttggttgaatgcaaagctggcttttgctgctctgaatctcatcagcctctcgtcctgctccaacccatggaaggtcttccctctgctgtttctgactgggtcatcccacaggattctgccctttctccccagcccctgtaggactatgtcttataagggcctgatgggggacttgtggtgcagtgtgggacatacaaagtgatggtggaaaaacccagtgtcccctcaattttttattgggtgatggagtgggatgatggtgagattgtgaatagctgagaagatcttgtttttttgactcaggaagtgtaagcatacaaaaaaacaaactcactttctcgtactatatattcacaacacagtacttctgtgacccctggccgtcaaaatgtgtgaggatttcttcccaccaagcaattctccaatagacaccagctgggtggcctctaattaaatcagattctgacactgtctacctggagatagtgtccagtcctacaggttaagggctcagtcccacaagacggtcctccacttcagatgtcagttacaagtagtaggttgccaactgtgcttctgaccaactggctataaatcggggattcccacaatcccctccccagatttgattgatttgctagagaaactcacagaacttaggggaacgctttatttacatctacccatttattataaaggatattacaaagaatacttatcaacagccagatgaaagagatgcagagtgggaggtaggtggggaggggtttggcgcttccatgccctctccagcacaccaccctccaggaacctcgacatgtccagctgtctggaagatctctgaaccctgtcttttggggtttttgtggaggcttcattacataggcataattgattacatcattgccattggggatcaactcaatctttagcccctctctgtttcctgcaggttgggggctggatagagctgaaagttccaaacctctaatcatgccttagtttttctggcccccatctaggagctatggtggagtccccagccactagtcatttcattggcatataaaagacactatggcgattccaaggattttaggagctgtatgccagaaatggcattttgggagggggtataggaaaatgttggggtggagagtgaggagttggcaaagaccaacaaagaccaaatatgtttttcacactgtcacagggggctactttctcgtcaggagcaggtggcactaagagatacagaacagataaaaatgaggctggctatgtacacagatgaagtataatgaaaaaggttcatggattaggtctgagattctatccctgttgggtcaataattagttggtatgtgactaatgtattgggaagatgcccggtggtctatgatattgggattttttttttctttttgattctttgggcctctgaagataattcagcagtttaccagaggagtacccattctgcctgctccttccctctctaacttcctttctccctccctccacaaatatttatttgtaccttgtttgtaactgaagataagcacctctgaaatcaggcctgttggcatatgtctaaatactctttaactgagagacatatattcaaagaaacgtttttatatgtccataaactgacacatagattgtcaaatccctaataacaaggttcaaattagaatcctgacactaatgttttcaaatgttctaatacaggtcaccgtttttcctggtacaactcttgtgagtcttatgtgtgtgcatgtgttcgcatgcaactgtgtgagatgctttgttaattaacattgtgaagctaagtgctcagtgaaaaaagtactagagaattgcatattgtccttacagaattgtttgtaaatacaatcaagtaaaagctgtattgaaagaggtaggccttgttcagagccatgttactaatctcaagtctaggggtttgctctgagtgtcttggtgtcttggtggccacatggatgttcctttactctgcttattttcaacacaagaaaggttcttgcaaagatgccttggatgaaaaattctgctgccatggctggtatgcaactcattttgcatggatgttctctcggttctaacctagtttgtgttcaggtaattctggtaatgggacatttgcctctcccctgggggaccatttttagtgtctgtccatccaaccagttagtcagagaaaagagccctgatgtaagtagagaaagaggtatttgtagaactgtgggaaaaagaaaaacataacacactgacctgttttaagagtgcagggtgggttcaaggcttttttaaatttggtttcccaagatgttggggtcactataagcttcgagaatggctgaggtccaaatcctaaaaattactttcatctcagaaaatttgattagcaatcagaataattgaagtgtacctttccagacactatttcctaaataaaatgtatgcataagtgaagtcagacctgatttaagatgaatctttcttccattgagcaggcagtgctttggggataaagggaactggttcccaactccagctttgcattgaactgctgtgtgatctttaaatttcctcctaacaaaatgaggagagtaatactttccccatgggcttgaatgagagataaatgaggtgaagccccaagcacaatgcctgttgcagtgtgttcagcacatggtcatttgctttccttttctaggaaggaagcccggcttcctggtcttctgctgagcttaccctgggttcccagaggctcctttggatgccttgatccatggatatcttctaagatggtcatgataatgtcagtcttcaaagtagctgctttccctcctctgtactgcagagaccaggcacatacagaggccgaagggtggctctgtctcctagggtggctgtcaccaggtgccacatcattctgtgtttatgggtttgctctgataagcagatgaggggggtgctcatccattttttaaattcaagacattcaagttcaacgtatgagacaccaggagtaattgtactatgaactgacataaactgcaatgaggaaagaccttctctcttcccctgtcttagattgcacgccaggatgtgataattaaagcatctgtctctctccagctccccttatcagacatcttaatttatttacttgttaaaaactaagaggagaattcatgctttgttggttttcctctttattctactttcattgttacatattaagtgatctcttggcaaaacgaatacataacatagctataattaaatataattctatttggtatggtgtttccctttcaaccattggcagttcttctaatgacaatgaccttgtaatttaaaacatatcctaggggcatctgtttttattctggactactctgacacattggttgaggaatgacaataacaatggcaggaattgggtacaagtgcagttttgttacatgtgtatattacatagtagtgaggtctgggcttttagtgtatccatcacctgaacagtgtacactgtgcccagtaggtaatttttatccctcatcccctcccattctcccaccttttggagtctctaatgtctttattctactcggtacacccacgtgtactcattgttaagctcccacttgtaagtgagacatgctgtatttgactttctgtttctgaaatagttcacttaggataaatggtctccagtgccatctatattgctgtaaaagacatgatttcatttttttatgtctgagtaatatttcatagtgtgtgtatacatatatgtatacatggtgtgtgtgtgtatatatgtatgtatatctcaaattttcctgatccagtcaccagttgatggacacttaggttgattctatgactttaactttgctattgtgaatagtggctgcaataaacatatgagtgccagtgtctttttaatataatgatttcttctcctttgggtagatacccagtagtgggactgttgaatcgaatggtaattctatctttagttctttgagaaatctccatactattttccgtagaggttgtattaatttacattcctacagtgtataagcattccctttcctccataccttgttgttttttttgactttttaataataaaatatgtttttctttctttcttccatgatggtgcacacataatagattatcaatttactcttacatattaattatattaaagatacagatgcatactagatgcaacacagaagaaagatgccttgtttctggccatagatatgacagagagatcaataaaggccacagaattctcttcctgtttattcctgtggttgttgttgggattttttttagatatagcaagtactcagcaaatttttgctgaatacatttacttagaacaaagggacactggcctcctccagccagccacatattattttatatatattattatgcaaaacacagttgttcagtattgcccctttgcaagatgctccttgacctttatctaagggaattaactgctattattattactcattcttttttatgctgcctatttatatattttttaaacttgaaaaggcgagttttatttttatttatttaattaattaattttttttttttttgaggcagagtctggctctgttccccaggctggagtgcaatggtatgatctcagctcgctgcagcctctgcctcctgggttcaagcgattctccagcttcagcctcccgagtagctgggcctacaggcacccgccaccatgtccagctaattttttttgtatttttagtagagactgggtttcaccgtgttggccagactggtctcaaactcttgacctcaggtgatccgcctgtctcggccttccaaagtgctgggattataggcgttagccactgcgcctagctgaaaaggagagtttttgatgaagcacaaatgtgactagacagtaagggaggaggctgttgggatgactgagaaaagaaataaagagtgtcttagaatcatataggtgagagaattcagaagtcattactgtatacccattgaagggattagattctctgaaggcttaaactagacagtctgacttaatctctctcttaaaggaaaagagttgtatttttgttcttcatgcttttaaaattatacaagaaaaaataaaagcaaaatttataaaagcaatttgtatacattgtaaaaatattcaaatatttacaaaacagcatgaagagtaaaattatctcctctgagttccattctctaaggataaaactgtaaaatgcttcaattcttggctcttctgtttactaccaggattctaacatactttcttgttttataaaatttagacagtagattctgactttttgctatgagagtttagggccatatacgtaaatgctatcttccactcatcattcctcctccgaattctcagtcgtattcttacttatccattatcaaggtatattaacattcacattctgttccctaaatgtaattagattttcacatgctttatagttgattctaaagagtttgtttggatagaatgcctactattcattttttcattcatttgtttatttcattcaacccacactgagagactattttgtgccaggtatgagcctatgtgcaaagtatgtgcaagtgttcacagaattgtgtgtaagacaattgaatgagttttgggcaggagaagatactagatgcatatctcaattctatttctaaagatgtattaaaagaaaatttagatgaaaagggttacggagaaggacactatcatacttttagagaaaaagcaccctggaaattgtttagatacctaaatattgtcaagtattaaataaattatggaaaccagatggattggaatcagagccattaaaaattaaaattttgagaactattaaatgatgtgataaaatgtcataatctagcaatttaataaaataagaaactggatatgaaactagatctataatattatcccagttctgtaaaattttaaaaagatgatatgggaaagaaatatcacaagtgatgacagagatttaaggttttttgtttgtttgtttgtttgttttttgtttttgttttgagacagaatcttgctctgtcgccaggctggagtgcagtggcgcgatctcggctcgctgcaacctctgcctcccaggttcaaacagttctcctgcctcactctcccgagtagctgggacaggcatgcaccaccatgcccggctaatttttgtatttttagtagagatggggtttcaccgtgttggccaagatggtctcaatctcttgacctcgtgatctgcccgcctcggcttcccaaagtgctgggattacaggcgtgagccaccgcgcccggcctaaggtatttttttaaatttttatttatttattttttgagatggagtcttgctctgtgacccagactggagtgcagtgacgcgatctcggctcactgcaaactccacctcttgggttcatgccgttctcctgcctcagcctcccgagtagctgggactacagatgtccaccaccacgcccggctaattttttttgtatttttagtagagacggggtttctccgtgttagccaggttggtctagatctcctgacctcgtgatctgcccacctcagcctcccaaagtgctgggaaggtttcttcctttatactcactttcaatgaggaagtgttatcctaactacaaaacaaacagacaaacaacaacaacaacaaacctattgtcttcaaaaaaataaaaagtaacaatagaatcattgccttcaaggacaagattctcaatctggtgaaagagacattttaagaagttctcataatgtaaaatggaataaaatcagtgtctgagtgtctgtacaaagggataaggatggagttttgataggggtctgggcatcagaaaggacataacaggttgcatcatgaagactgagtagtatttctatggacagaggagaacattcctaggcgtgaagggatggaaatgaatgttgagaagtgagctatctgaaattgctggactagagtgtgggctaaaagatgtagaaaagaaagtggtttaatggcttgtggagaaccttggatgctttgctgaagaattagaatttaattgaaaggccatagggagctatggagaaatttttaaagagaggggtggacttgacctgtattttcagatgcaaagtaaagagagcaacctttggcaccagacagacctggagtcaaaatcccagctctgccagttccttaggataggttcttagacaaatgagttaactcttctctatttccttatccattaattgggggcagtgatttcaactttacggtgtgaacatgaggatagaacaacttaatacagagtttcaatatcatgaatgatgaataggtcttttttaaaggtaagaaataatacctggtgatgaaataatctgtacaacaatcccccatgacacaagtttacctgtgtaacaaacctgcacatgtacccctgcacttaaaagttaaaaaaaagaaaatatttggatccacctatgacctataagctctctctttgagttgttctgcctttccagactgaagtaatgtatgtctcacatgtattgattgatgtcttctgtctccctaaaatgtataaaaccatgttgtaccctgaacacctgggtcacatgttctcaggacctctcacgactgtgcctcatgccatggtcactcacatttggctcagaataaatatctttaattaaaaaagaaatatttgcaggatctcaccccctagtctgtgttaaattgtttctattataatgttaaatatttacaactatatttgttataaatttctcaagtttcgtgctctgctacaggtataaaaccaaaacgagtttaaacattataaacaacacaagcacaataaaattaaatgaagcagtattaatttaatagacccatttgtaatcaatatgaaaataaatctttgtggacgatgtgaatatagtactaactgctacagcccaggttattaaagtttggcctttcccatactctgtgtgttatgttgactcagtctttccccacttttctctactccaacttattgtttatgcagtgaacagtggtattatttaaactttgcttagcatgaacacatcttctatgtatcaggtccacctctcttcctcactggcccatcactattaacatctcaccactgtagacatgcatgcaagtgcaagcattgaaactgcatagcaggactcaattatgtagtggttatctagatgattttaaaaatgttatcagtatgaaaatttagatcacacagacatacccacacagacacacatacacacacaccacacaccacagccctcttatggttctacacctcctatttgtaaatacatatatcctagaagtcttattattattgttttgttgttgttgttgttgttttgagatggaggctcgttctgtcgcacaggctggagcgcagtggcacgatcttggctcactgcaacctccgcctcccaggttcaagcaattctcctgcctcagcctcctgagtagctgcgattacaggggcccgccaccatgcctggctaatttttgtatttttagtagaggtgggatttcaccaagttgggtcttattattattgttaatggcagctttattattgttagtgatcttggttaggtagatgtatcagttggctattgctgtgtcataaagcaccccaaaattccgtagtttaaatcaaccagccatttattatttctcatgagtattaggttggctgtacacacctgctgatatggtttgggggcataatggggctgtctctcatctttggtcagttgcacgtgggcttgttggctttgctgatgtggctgagcttcctcacatctttgaagccttgtctgagatggtttggctttgctccatgtgttttcttcacctccagcaagttagcagaggcttgtttttagggtagtctggacacattcttatgctgatcacagagaagcagggaaagaaatggataagtgcaaggtctctttaggcctcatgttagagctggcagactaccacttctgtggcattctattgattgaaacaagtcacaaggccaatccagattcatcagctggagacatagactctatagtctatttctagatgagagaagctacaaactcaaaattcaaagaatatggttatacgtatgtgtgaagaattggaggcacttttgcaatcaatccagtagagcagttaagaacattgaaatctattaggaagtgacatagatcttcttggtgagagggatcctgccttaggaaagaatgaatgtgtgaggtgctctgccagtctttggtgtgggagtgagggagagggaagagtcaaagatggctttgaggaacctgggcttgggtgactgagaagatggtaaagctactgagatgagatggtcagcaggaaaagtaggtttatattagggggcctggggcatgggagaggtcaaagatggagggagaaaataagtttagagtttagcaaagtgggactcttcccacaaggagaaaccttctccacctagttacacaataaaatcgcctaaagagcttttaaaattgataattgagtctcatccaaggccaattaagcttaaatttctgggtagaaggcctggtattttttttaatattcacaggaaatctaatgtatggcaaaataggaatcattatctaaatcagtgttcttcttgtgcccatacgttagaatcacctggaagccttatgaaaaatactgatgcctgggcctcactaccaaagaatctatttagtgagtctgggatagggccttggcatctgtattaaaataaagtctgtctggatatatgtgatgtaatgtaatgcagccagagttgagaaccactgacctagatagttaattttcactgtgaataatcaatgttttcagggttgcaagccatggcaaaggggcactatgacaaagtctctttaagttcttggcaggtccagaattagcatgaaattgctgggtgccaactggggcatggggacaggagcagtcagaaggtgaattctatacacttcgaagacccaacctggatcaacacctggtgtttgaagcacaagggcttgttagtgctaatcctgcatcaagtagagatggtgggaaatcgccctgaaaagctctatagtgtataaaatgtcatgatgctattgaaacccctgttgtcccattcaaaccgagctttctttacagtagcacctgaaaaatacaacttccaccatttcctttgagaaggtaaattcagtctgagatctcagtatttgttttccttgattggaaagctaaaactgcctcttccttgattttgtcccgttagtctgagctttgaccttgttacatgttagataattccttgatatgcttgttgttaatgccttataaatatttgcagaccaattatctgtctataggcagccactgagtcaacaacagaatatctgggtttttttccatgttcataaatcattcttggcagaccttaatcatttgggtttttggctggcctctctgactttcttctagtttatttttatcctccataagcctcatctattttggagaaatatttaattgcataagagagaagttgactcctgttaggtatgacactgacaatcttccctgggttcagggtttcttcagagtggcatgagaatccctttggggatgggagaaggcttgtgaaaaggacatatttatgagtcccaccccagttctctgaggatgggactcaggcatctggaattttcacttctttaaagggtaggtgattcttatataaacagttttagagctattaccaaagttattgcttcaaatattatacttagaggagaagttggggcaatttcttttctcggtgggagaggctttgctccataatcctcgtcagtaatcaagagatacacctttccttaaagagtttccaaaaatgttctgcatgaggaatcaccatttcatgtcagtcttgtatatcagtggggctggttggttaatacatatggattgtattgtgttcatctgacattaagatataagctgaggcaaagtgaagagaggaggaagaatgaatacaatagataaatagtaagatagaaaagagaagagaaatggagatggggaggaaataaagaagagatatttgtgtaaatatggtttcatctatgacaatgtttagtatcacgcttttttacattttgaagcactttacagtataaaaaatccttttatatgcgatcctcacaactgtcctggggtactggaccaggtaagtgttaacatacccatttcacagatggaaaaattgagacttctgacagcaaccttccgaaggtcagatagctagtgtcaaaaccaaccctggaactcaggacttagttctaaagcaggaattttctgccaatcctaatctatactcagcctgggtaacctagacttgttcttgcttgtgtaatgacaaggccttcattctgaatgagtgctctgatgtgatttgatgtagagtggttctttggggagggacatggcactggcacactgaacagagtggacttggtatcctgaggaggtccttggaaattctcataaaaatcaacaagcttattgaaagagctcatgttacatcttataaacaaaataaaactggtacatgattcgtgagtgtcttcattcttctctttcttccctttcttctcttcaacacactcaacacacacacacacacacacacacacacacacacacacacacccccaagaaattcacctctggctctggaatctggagaaagttcaaagtcatgcagcaatgaccgtcagcatgattaggcctactggaatcaacaagataaattcagggcctgatcaccatcagacattttcttggtctaacctattgtggccaaaggaagggaagtctcactcaggtctgctccctctccttcatttacttactgagcaggctttttttgctttagggcatggttggtactgaccctcctgggactataataaaaactaacctgggtaccagggttgaatgttgatgagtttttttaccctcgttatttctcttgatcattacaacagcctggtgatataggtaatggtaatatccaggcataattacgataccattggtctaggcatacttgtataattctgtagatcagctacccccctagaaagtactaaggtaaatttatgcacagagagggtgaaacaatgcaaagggacactctattgctagttggggcttaggcccctcaaatactgaacaggattttggtgaactgggctgcaccacaaagagaagctgggtggacttgaaccaacctaaaagaaaagtcaaacctacctttctgattttggttaggaagggaaaccaaactctgcatccctgctgagaatccccgaaaaagaaagtggctgtaaaagatggaacctaagcctttccaagccagaattctgtgctttgtaggaaaagacaggcatcagaagagaaagcctcaaagagctttgaagagcaagatagcaagatctaggacacagcttactgtttgaggcctaagttcccctcagtgttggaaactcccactattatggccagatgaagtagttttgcctctttcttggtcactgtctttgggatgtggaggtggtgtgggggctggagggaaaatgtgatatcctggggatatgttttactgtgaggaacttaaggatcggggaagttaagtcacttactcaaccaaggtcatttgtttagtgtgtggggaagctcagatttgaactcttgaatcttggcaacaacatttagtaattttcccattttgctacctatcctctctaccaaacaccattttgttcttatgtggaaaattggttctaccctcctgggcttcctctggcaggagcagtgtcattaaaacattgaagagaacccaaagaatatatttttctccacttaatgcttgctcagggaagacatccacatccatgggagttgtctggctcacagtttaggaagtgtcatgcacatggaggtagtctgctagatgaggcttagatcacatgtctatttcatctcactgttcctccttaaaagttcagatgatacaaatggccacactgtcctctaaaagaagcgttggagtttattttgggaaaggggcctattttaagataaaggacaggggctccctattctgccactgtgctggcttgtctccactccacactcagcaaaaatggaatattctctaaacaataggtgactcagcctttgcaaagtctcaggtgaaatggatttagccagcaaagagagaaaatgtctttttttttttttttcatttttccctggtcctgtttgatgataattctcagtgctcagtgctcctttcatccaaagatctgtaattaattaagcctcacaactcccctggcaagtagagagaggtacaaggatgttcatttaaaaccaatcctgtttgatacagtaggactgttaccaaggctctttaaaagaaaaacctttctggccgggcgtggtggctcaagcctgtaatcccagcactttgggaggccgaggtgggtggatcatgaggtcaggagatcaagaccatcctggctaacatggtgaaacctcgtctctactaaaaatacaaaaaattagctgggcgtggtggcgggctcctgtagtcccagctactcgggaggctgaggcaggagaatggcgtgaacctgggaggtggagcttgcagtgagccaagatcacaccactgcactccagcctgggcaacagagcgagactctgtctcaaaaaaaaaaaaaaaaatgaaaaacctttcttttgtgaaacttctttttaatggactaaattaaaaaagaaagggaagaagtaactttatctgggatacctgctgagttatggccacagacagagtcctaagttaggagctctgatgtcattcttggattaaactaggtgtataagctactgctatgtagcaaatcaccatgaaacttagtggctttagacaataataaacatttattgttaatacagttactgtgaatcaggaattcaggagtggcttatctgggtggttctgccttgagatcatagtaaagatgatagcaagggctgcagtcatctgaaggcttgactggggccggaggatccacttctaagatggctcactcaaatggatggtgagttggtgctggctgttggtagaagactaattctgcatgtggacttctgcaaagggctgcttgaatgtcctaattatgaggcagatgctcccctattacaagggacccaaaagagcaaacgtgtaagtgtcagtgtcttttgttacctaccctgggatgtcacactgtcatttcctcaatgtcctgttgactacacaggttagctctcaacattatgggaggggcctacaacaagggcatgaatatcaggaagaagactcactggaggcctgcttggagcctggctactgtatgaagacatattaaacgtatgtccatctgtaatattagtggtcctctgaaaaaccagcttagaggactaattatcattcatctgataagaagagagagtaagagatagggaatggtgtaattaactttctggttatttgtagttttagaaaaaagagccaccattcttcatggttaagtgattaagcctatattggagtgtacataacaaggggtgatgctcccatttttaggagctggatagctgtcccagaccttatagcagatcactggctcctcattgttggtccatggaccaatgttatattaactgctaaaaggcatccctgaggcatttattaaaaatgtggataccagctttctactcttagggattctaagtctgtgcatttggaacccactgtgctggctcaacttatcaagttatgtggggtgagaattatgacttatggcagttatagtcatttgcttagcatctctccatgatctttttcttggtctcagaacaccaactaaaaataagttcctggttgctaagggcatgaatatcaggaaggaattgatagttgccaatgttgtttgcataccatattagttcaagaaagtgcagagagtagaaagttccctaccataagggctactagaaaggcagagaggggatagggttgctgaccaatagcaacagtttggaagattatcattatactgcatcaatatatgcaaggaactggtctaataccaggtacagaagtacttttgcatcctgcatacattttagtccagtggttctcaaatattagtatccagaagaatcacctggagagtgtttaaaagtacagatctttaggtctgcctctgggattctgattcagtgggtctagtgtaccccaggtggttttgatgtaagtgatctgggaccacactttgatatacactgttgtaggtacagcctaacttaattgcaaggtattgacttcatatctatttaatctccagtagcaagagtttaaccgatagagtgggtgacatataaggggtacatgaatgacagttgctaggtgaactgatgacatgcatgaggggtacagggagactggacaggtgtgaaaaagcattttattagcattatctttgtggatattcccctttcagatgataagctcttagaggtaggacctatatgctatttaattttgcaactcccgcagaggttagcatggtaagctgcttgcatcaggcttacaatagatgtgttaacacataggggcaagttcatctgaagtggccaggaattctgcctggttgggaattgattcatggtacccagagcatgttgcatgttgtgctgactgctttatgactttcgaagttgagtgactctaggttattgccaagctctcctctcacctcttccctctttctttcaagtatctcaggtggtattgatagtaaaacagtcttggcattaatgagtgtctgactggagagtgaaatgtaaataagagttgaatagagcacagccaaagcctacaaattaccgctgacaaataacagggcagacaaagagtatttcagccttaccaaacacctctgctacaatcagctaagaacacctgggaatgtcagggtggcagacacagagccaacaacatgatcaagaagaggacatttgatggcaaagagcaaagcagcaagttgcttgtgcattgcttagagaagaagaggaagaagaatgatagaactactggcttcactcaagaataatttattgaacttctactatgtgccagtacttattataggtactagagataataaggtataccaagtagacataaagcttatattttagcaaaagatatagataatggataagcaaatacttagtacatagtacaatgtcacatggtgattagtgtcagtaagaagaataaagcaagggaggggaatacacagtaaaaataaagtaaatataattcccaatgacattgctatatataataatttgacaaatccattaaactaatacttactgagtgcttactatgtgtcacacagtattgggcaatggagatacagtgataagacaagttttgtaatttcacagtgcctaatttttttaggccaggaaaaagactataaacaaagaaagacacataagaaacatatgagatagtgatttgtgctatctagagaattaaggagaactggtagagtgactgggaaggctgctttagtttggttgagggaattcctctccaaggaggtgatattaaattgaaatctgaatgacaaagaggagccagctatgcagaaagcatcacaggccaagtggggagggcacacgggtgaaggccctggacccagcagatctaggaatagaaaggccagtaaagctttataaaccatgaggggctggggtctggttagaataattaagaagagaaataattttttgtttttcatatatatgacctggggaacaaatataaatcctacaaaactatctttctttccatttaaatattgtctagttctttcatcagagacaggtgtaatatttaagtcaattgatttataatatgaatttcttcctgtaattagttctcttttccccagcacccctgagataattcaaaatgcagggcaagtgttattataataaaattttatgttagtataattaacaaaaataccatatagcaatatgccagtcattaagcgtgttgattcatgtagtaactgggaattcttagttaatatttgtctgcagatccatttatcttccataacaccttagatgaaatgtttctttttgggctcgtattcaagatcttggggtgatctttttctgtgtctagtttccatgcaatctgagctctgcagcagccagtggaaatgcccttagttgtcttcagtttctctttatgggtgctgcaatctctttaacccctgtccatacaggaactttgtacactctgctgtattctccatctagggttcacatatcacccaaattctcttctatgtctctgggaagggaagcaattctttttgcaggtcttcactattgtctttttcttttttccattgctttttctgtgctgtctggagaatcactttccataccattgggtcttcttttccccagttaatataccagagcctttctgctcattcattctctacatttcatgcctctctgaagtattaatacctttctctttacactggttacagatgtatatgcaaagatcaagtggatagattgtgtttgctgagaaactttagtgttgaaaatgcaatgcaaatctttaatgtaagtttactgtatatttgagtgtattgtatatttattctccaatataaatttagcaactttcacattatgaatcactaagccttatgtttctccaaagaagggagcatgacttctcaaaatacaatattgttttagaatgaaaatttgtttcatgaccaatgcaaatcagttctgaaattccaaactccctcagccttgaataactttaaaatgcaaatgctacccataaggaacaaatgtcttttcaattattaaaattgaatttcaagatttggtttcttatgataaaaatgtttgaatatatctgaaaaatctttcttaaatcctactattaattaaaaaggataaaagcagaaagttgcaggcaataacaagaacaaagattgagttacaaaaactagaatgtgtttaattttcatagaagttctaaggcattacattagcaccattagggtagggaaacaggcttatgtctctctctgtctcacacacacacacgcacacacatacacaggctaacgggaaaggacagactcatgtacacacacatacacgcacacatagttgagccaatatgctttatgatctgtgaaaattaggctcaacatagtgaccgaattgagagacaggatgttgatcatagttttgctttctaacttgaagaatatagctgagaagccagggtttaatggttttgatattctggaaaataggtatcatgatagtcaaacgtttctgctctgttgggatacaacagaagtatgatgtctgtccttaggaagtttactagtgatttggggggaaaatggctttatattatacaactcaaacagtatgagccagtatacgcttaagcactagatactgcagtgcacagagacaagtagttatgagaatcaagagaaaggaacattattaatactgtgtggggccaacatggaatgcttcatggaggagaagaagtttaacttaatttggaggaaaatacagaatttagcatcattttctctttaatgatagcaagtcatttttattaataatattgattatctctctgttgactcacagattagaggatggaaaagcatgacaaacccacagggtaactatgttttaaaggtttttaaaaaagaagtcagaaaaaaaagagaaagcctttctaagagcctagtcttggggaaaatgtaggagatgcagaagagaattaatggctaatgcttatcattttgtacaaaataaccttgacacaaatggggcaatttaaagaagggtaagtgactcccagcccactcaccaaggttgatggtggaaataatcatggggttgagggcagactggaaaaagaagaccgagggtaggtagctttctcttctacattatgtgtgtttctgatctagaggtaggaagctcatagctgaaggagcattttagaaactcagcctcttccactttccaatcactttaggtacttaacttgatctagctgcaagttagatgtgtctcttttttttccatcctccttcaagctctatgcagagatgtgttagttgtcatatcaccaacgtccaagaagttatagtgaacaaaacacagttagagaactaggataattgtaaatattttttatagcaaaccaatgtgctacaatatgtaagttagggtgtgactatccctgtgcttcataagtgagaaaattattattgctctaagtcagttttccatcttggctacacattagaatcacctggcgaactttaaaaattaccaatgcccaggaccttcccccacctgctctcccaagaggcatagtgagtctgagaagtggcctgggcattggggtttctaaagctccccaggttattctaatgttctgcaaagttgagaaccactcctctaactgctgatataaacaaagtgcagctggagagtttgttaaaccacagactgttgaattccatcggcagagtttctgattcattagatctgggatgggaaccaagaatttgtatttctaacacatccttgggtgatgctgatactgctggttctggggaccacagtttaagaaacgttgatttaaactattgaggtcaagacaattcaggttgtacaaagtcagcatttcgtaaggtttgtccccagaacatacttattaaaatgcagattctgggcacctccctaaactcactgaattagaatgtccaggaatttgcaattttaaatgagctcttccagtttttcttttggacgctagtgaactatggtggaggttaatagttttatttcttatcttgctccaaatattattttatataagttgaatgtgtgaccctatgaaggtttttgtaattattttatgctatattttgtgtgtgtgtggaagaaaacctctatagattggattgcattaggtaccctgaggaatatcagtagtcaaatttggggaaataaggctgggcatggtggttcacgcctgtaatcccagcactttgggagagcagggagggcaaattacctgaggtcaggagtttaagaccagcctggccaacatggtgaatctctactaaaaaatacaaaaattagccaggcatgatggcagatgcctataatcccagctgctcaggaggctgaggcaggaagaattgcttgaacctgggaggcggaggttgcagtgagcagagatcacgccatggcactccagcctggatgatagagtgagaccctcaaagaaacaaacaaacaaaaaacccaaaaaagaaatttggagaaataagcttcgtcatggggcttatattataacaacagactcacctgtttatatagtggctgcaattctcattgcatctgagatgttcaagaggtaactttcaaaaccacacttggcacattcaacataattaggtaattgcacacagcacaggttgtataaaggttagaggagcatctttcaaattttagaggatattaaaattaccaggggtatttgttaaaagttagattcccaagtcagagctccagagagtcccagctctgggtggcatccaggaatctttatttaacaaaagtagattcttatacaatgggtccaggaatctcattttaagaaatagtggattggagaatatgaagtataaaaattgttttcacagttgacctgagttgctaataaacaatttgctatatatttactatttttttcacattttgtaagtcagtgtcctaatagctaggtataagtgtaggctaaaatggcaatgttcaggatacatcctttaagggtgtaatattattacatacatctgtctcctttctcatttacatattgtgcagctttttttgtccctttctatactattcccccttttattaaaaaatggagcagacacatgattaaaatgaggaccaggtcaagtttgcatttagctaagtattcttcccctttatttccctgtcttggccagcttactgtcattcctctttttccctttgttcttttgtctgtcttttcccctaccagtccatgttccatctttcctctacgttgtctctcctttgtgacctctttctgtggccatttcagtgggcatgaagggaaggggtggtcactgtaaaccttgccaatccatatttctctctccacagccaggtggtggtgtagaaagttagtaaagaataaaaacctacacaagtcttctattatattctggtgtgcaagtgtggggttaatagaactgaataaaatgatttttaactaaaactcagagtccacaggtaagagggagagaggtctggacaaaaattgtacaaaattttgttggtgaatgatagtctctgtaggggaacgctgtgcaaaatgagtcttaactgatttagaatatagctggacattcttatcaagttaactgtccactgttttgaatcacaggggctaggataggattatttctttttctttcatgtttcggatttccttctacctgcgaaaatattagctttcactcaagaatcctctcccaggcagaaagaaggaaagaaagtcttgctagaggagaaatcttattaaggctcatggtgattcaggagtgacagccggggctttttcaatggacttatctgctgtcacagagacccactatcctggaagagcccaggcaaagtctgagggttttgaccatcaaaatgaatgactgcaatatgttttgaattgcacagacaggaggagaagtgataggtattctttatggaaaatcacaaagagaaagagctagcaatcttcaagcctttttatcttcataccaaaaacaatatgaatactttctatggagaaaaattgtggcagcaacctgagctgaacataactacaaacagaaaggatatcccctcctacagccctcagagtcatctggcattttgcttatcctgcccctgaactcaagactcttttatattatagagttcttttaggaaatatttatttcttgaacttccccttattttttagggtatctccccatctttttgccccaagagcctgaatcacttgagcaagatataatatccatgtagataagatgataaagggattccttatatcaaggagtcaactaaaagttaatccctgtgaaacacagaaacccaccacaaatggtaaaatcccaagaaaaagttttgagttttgaccaaagagctaatttcatttcccacaagtgcaaaactttggatgtatttatatcagctgactactatatcttttctcaaactccaaagcccacatagctgatatactcttgtcaactgatattgtttccatgttacagatcaggaaacggaggctattcaaagttactgtatatgcgttgtctaagtgctatttgtatacttgtttatcactcctttgatctgccccattgaggtagacaatgattcttgctacttcttggctctcctatatacccagggctatcctgtctcataatagaagcttgataaatattgtcaaactagatcatatgctttgtttgagtcctcaaggggagacaatgaaatagctggggctagaccctcctctctctctcagacatcttgaaatgcagtcaggacgtagcggtgctgagcccattataagacctcaataaatacctgtcaatggcttgactgaaggactgattcaagactatcatattctttagtacttgtctcatgtacttcaacaaggactttagactaaactgatttgattggttatatttttagacttgttacttctgttttgacagaaagaatagacaatacgactacaagcatagtgaccttctggatttgttcctgtggataatcttaagataatttgaaggaagtttcttaactttttaaaggcacaggtgtcagaagtgacaggcttgataattagtcagcattaccccctcactccttttaatgttgtttctcacgctttgcattggttactagtcaatctgggttgcagttctgatttagatgtcaccgtactctgctttaaaggttattttggatctttgcctgtctttgatgtgttctagtacccatcttcctgtctccatccccagcatctgagaacacttctcatttccccactagattgtttttttaaatttttgagcatgctctgttttattttctgattatgaagggcatttctagtagtcctgggaagagtgagctcacaaaaagacagctagagaactagtgatcatgactattatcacatcaagactttggcttaagcaaaacagaacaacaaaaccccaaaaaaccccacaaaactgggaagtgcttagagccccttctacgtgactctgtctgcatctgcagtaggaaagtttacatttactgttaatctgctgttcaactttttgggaatgaattagcaactcttaaatttctctccatttcctatttctagtaattagctcagtgtcacagctaaggttttcttactgacttcagcatggagacttagcagttacggaaaggagaggctagagctttccaccaactgcatgtcactggtgactccaagagagaatccaacaaatcaactactaataatccttactatttaaaccgtgttcactattatccaataacttggctctcagttatatcttcttaagaattctaataaggcatttagtttatacaaaggaggagtctgatctatgcagtggacatgagagacaaccaaagttttgttcctctttccaatggcatagagaaaaaaataaaatttaggcagaattagaattcagaatgcctgggagttcctccagccttgggaaattccaggtgagaggggaggactctggagctttttaaaaagaccctagagttcattttacccaacaattttatttcataaatgagaaaactgaggcctagagaagtatggcttaccaaggttacaaactaaattatggcagttttagctcatggcttatgttagctagactgctggttcgatttttcagtggaagcctccttttgaagaagggcaagccattcatttttcagcataaaccaagggatgctcttacacacacacacacacacacacacacacacacacacacacacacacagagagagagagagagagagagcaaaaaaagaatagccatcataaagatacatttctgttctggattcaagaggcagaattattaatacaggtagactgccaggaatgcagaatgttaatgcagctgcggaataatacactagtgccacagagtttaataatagataatgacaaataatacagttggggaattgtgtaattcaataacagagtaaatgacaaggaaacacacacaccaatgaatggttctagtggggacgcttaggtgttttcaatttaacttacctctccagccctttggcctactacccttttgagaggcaggcaggacatgcagagatgtgcccagctggggtttttagtttgtgcagtgaagttgcaggtttcaggggctgagtcaggaagtatgaattgtgctcctgggcagttatcagctgatccctttaatgcatgtattactttcctccatgtcatgactggatagtttctttttttctgggggagagggggcctagaattgtcccaggttggccattctctcctattacccactctgtaaatcactgcatatgagggagtggtactggaacatggagcttgaagatgggaagagactgggagttggggtttgggtttagggtcataatgggaggtaaaaggtttagccacagctatggtttagtaagcataccagtgatctggtgtgtacttccctgtcctcagctgcattagagaaaggcagccgctgatcactgttagacctgtattctttctctaagagaatgggatatttccctctcattcttttaaaataagataaaaagcaaggggtggggaaattaattaatgtcagtaaatgaagcatgagacacttgtccggatatgataatgactgtgaattagtgcagaataaataaaatggtataaaaaatgaaccttgccagcacactcctttgggatgggctcagtcacccttataatgcattaactcttcccttgcctcatccttggtcctgtctatgttactgtgtcaaagctcccccactgcagagtctcaaggctacagtattatagcctgaggtgcccaaagggagccctggctccaggagagattgagccagctggtgactgcatactttataatgtaaatagaataacttcacatctatttattaataaaaccacactaaaaagaagcaattgtgtgtcccccggttgggagattcaagaaggcagacagaaagccactggaggaagaaaaagggataagttcctcaaaataagttgctccctttcccccagagccaaagtttacctttgtgctgctggtaagttatctacctcccctctctacttttctgtaagggccccaggctgtatgtcttttatatcgtcttcagatgactacaataaacacacactaattgggcacttcctgtgtccaagcactgtagaataaacagagagaaataaagcaatctccattttcaagttttctcctttaagggtgtggagtagtgcttgacatgtagtaaatgctcaacaaattgttgctattacatcagcattgtttcactgaatttaatccctatgaaattttcactgaagacaagtttgagagattcagagagcccttggccactttattttctttacttttgtttctttgctttccttttctccttcattttcttatctcttctatgtttcaaagttcttagattattggcaaagcaaatgcaaagaacatggttataataacctttgaatgttaacacttaagaaattatttgctattaacagaaactcaatgcagtgtagtcaccaaatatgaatcactgaattcagaaatgttattaattcacactacagtatgggcaggtagacaagtgtcggaatactagtttagagttgtttgatgacagcttatatctttttgtattctcatcagtggtgactatatttgcagagtgatttggaaataataacaaaagattgaatttgtaatgtttggtattttcttaaaatactctggaaccacaacaaagagagggctggatgaaaccatgtggacaattattgttgaagctgagcaataggcttatggtggtacttactatttttgtgagtgtttaaatactgctataataaggaaggctaaagtgttgagggatcctttgggaatgtaagcctggatgaatgacctcctggggcctacctttttcctgcccctccaagtccaagttgggaggtagatggtgaatgttttacattcctggtgtgactcaacataaccttttaaggacagtgttaacatgagatgcctcctgttcctttgggaggtctgtaatttttctcagaaggctaacttatagtccaggtatgtgtgcactctgcccattcagtctttgcctttggtttttctttgatctggaggatcataggaggcaagtgtggaaatacttcttcctggagacaatggcagaggagagtccgtgtatagaaattgatttgttaacccttgcgatggcctccctctcccaccctgggatggtggaagagatgccactgagagcctgggcttgtctggtgaaagagtgggcttaaggaaaaagcaacaacaggatcacaaatgagaccctaaatctggttttttccttgtcctcagtagcttattagagataactacatcacataagctctgtccatgactgtgaacttttatggttttgtctattagagggtgatgtcagaggctgttatcactggcattaatgatttatttgggcacaggtagacttataaaagtaggtgggggtattgattatagtcatgggccaatgagattctgtttcatttcctaaccaccaaacagatgtaaaggacttctgtgtgcagacctcaagattacacagcaaaggggcttccaaaggaatttacaatttgaatgagacctataagaatcaagaggtgcccaagagcagacgtaggcctgtatgtccccatatggttgagttttgataatccttcatttccagtcactgctatggtctggctgaccttctgaatgtacccagtattggctggctttagatctatgatatgagctatttttttactcattaaagtgtttaaatttctgtgcttagtttctcagatgacttttttttctgtgtggaatctggttgatatttttggagaataatttaaatcagttctaattccaccctgaagagctccttttgacacacaagtggctttgtgtcattgcaactctggaggaggccagggcaggcttcctgggtgctcagaacactggctgcccttggaattatggctttatctctgggggatagtacttcaagaaaaaatgccaaggaaatgtttgtcttagtgtatttttgtccattttgcctcaaaaaagatttgtcctgcccaggagcagtggctcacacctgtaatcccaacactttgggaagccaaggcaagtggatcacttgaggtcaggagttcaagaccagcctggccaacatggtgaaaccccgtctctactaaaaatacaaaattagccaggtgtggtggcatgcatctctagtcccagctactcaggaggctaaggcataagaatcgcttgaacccaggaggcagaggttgcagtgagctgagatcatgccaccacactccagcctgggccacaagagtgaaactccatctcataaataaataaataaataaataaataaataaataaataaataaataaagatagatttgtcctgaaacttaaagaataaagactcggtagacatggaatatattttttttcaaatttcaaaatgcaaaagagaatacaggtaaatacttgtatttacttcataaatgccctatttttcacagggtgtatcagtgtgctttgggctgccatagtaaaatagcacaggctggaggacttgaacaacagaaattcattttctcacagttctggaggctgtaagtctaagaccaaggtgccagcaggtttggtttctccaaaggccattctctttggcttacagatggccatctttttcctgtgtcctcacgtgacttttcccccatgtgtacatccctggtatttcttcattccaaatttcctcttgttataaggataccagtcacactggattagggctcactctaatgacctcattataacttaatcacctctttaaaaatcacctatctccaaatacagtcacattctgaggtcctgaaggttagggcttcaacctatgaatttgggtaggaggcagggacacaaatcaactcataacacaagatgaggaatattgttaaatgataaaaacaaaacacttgatccctatgatctaaagccctgctctgcaattctagagattgctttagaagtttgcatttaggtatagtcgtaacatcctagaaattaatttagaaagctgcttttacattaaaaatcaaaaaggtgagcaaaaagaatcatggctctgtaaattttcttttattttgatatttcagaggacattattactattactaaaatattgtgggtggggggaaggaaagttgggagtaggatgagaaagaatcaagtgttgagggaaatttttcatgtttgttggaggaaaagaaaagacatgaaaggaagaaagatgaaagaaagagggagatggagaaataaggcaaaagaagagaagaaggagaaagaaaggaggaggaggatgaagaagaagaaaggggagggggaggagaagggaggaggagataaaggaggagaggagaagaaatgaagagggaatgggaggggaaaggtggagtggggagtgaagaggagaagggggtggaggaaagagatgaggaaagggagaggtaaagaagagagagaaattagtgtaggtagcacttaccatggattgaaaaagagagttcacgcttttccctctcttaggaaactcccagctgcttctaagaaaataagagtgactacatcagagagatgcaaacaggaagagaaagtaaatggaggccctggagagggagagcttgggtattgaggtttggtgtggatagctgagaaccatccaacattaatgagcacaaatgtgtgcacaggctgaaaatgtctctccagggacgctgatgacttgagctttgtgtgtgccattggaaatcatgaatgagaaaataactgactcgctctctcagacaatctggtttatggacctgaagctcttatttgctgtcaggttgttcatctccacgcctctgtgagatattattgaaacagaacccagcactgtcctccttgccaaagtggttgacgttggccttaactttccccagttctgagacagggacagactggctaatgtaagtgtgccctgtggatgtgcaatttagagggaggaatgggaaagtatgttgtatgcagctagggacgcacacacagaggatattttcactgattcctctctgtgggcataactactgtcttgaaggcctttgcttttctggttttatgatttccaagcctctttcctgaatcttagaagtcaaaactcaagctaagctgcaacagaaacttcatcttttctcagaataaaatctattttcttccccttcccatggtaaacaaattatgttgacagacaaatgagggattaggtgaggaaatttgtgattttggaagctcagggaagcagatgtcaggattcagctgagagggaagaatttgggcggggtgggaggctacatggagaaatcagaggcaatcaggaggtgctgtccaagatgaggcatggtggtgagatggataaagaagcagtttctaagatgccactcaagagctctctggagatttacagagagctggacttttttttttttttttgagacagagtctcacgctatcacccaggctggagtgcagtggcacgatcttggctcactgcaacctctgcctcctgggttcaagcgattctcctgcctcagcctcctgagtagctgggactgcaggcacatgccaccatgcctggctaatttttgtatttttagtagagatgtggtttcaccaagttggccagaatggtcttgatctcctgatcttgtgatccacccacctcggcctccgaaagtgctgggattacaggtgtgatccaccacacccggcctcccaaagtgctgggattacaggtgtgatccaccacacccggcctgagttttctaaacttctgggtaaggctgtttgactttggacatgacgctaggcttaactgagcctctattttaccttatgcacagtgggcatactccttaccttacttacttcacaggttggctttgaaaacaaaatcatataggaaaaatattctgaatatgctgaagagccagaaaacatagtattatcactttcttggttttgctgtacccatgtatgaatcttttctgcagcatccctgctgcatgcttgtttctatgtccccatgtcctgcctcagttgaatgcatctggtggtggggagcttactaccctttaaggaaagtcattgtttaaaaacatgtatatataatttttaatttttacagaaaaatgtttgcattgagcccaagtctgcctaataataatagcagtaagctaactctcatgtaaggtatactctgcagcagacccactttgggaactttacatatattaacatttattacatttattattcttagccaccctataaggtgggtactgttattattccgattttacatgcaagaaaaccaaggcacagacagagtaggtaacttgtcctaggtcacggggtaataatttttacctgctggctcttgtttttctgtccatagctgacccaaaatatttgatgaccggtattttgtcctctttgagtgctccctttgccggtctaccatctcctttcccttgctttcttctgcatgtgcctccttctgaagttttcccacagcaggccccactctccaagggtgtttcgacctattcagaaaagagttgcattgctgggtccccttggacctgctgctgccggtcggctgggaagagttataaagaagaaaggacattttcaagctaagctctcctggaaactggtaggatggcgtgagctggtccacaggccccagctgccagatgatgggaattgggatcagctgtgacctaattatgagtctcgtaaacctgcattgtgcccttcattttccagctcattgaccactcagagggggagggaaaagggatgagattctggtcaagtccttcctgccactaccatgtggccaaggtcacaggccaatgatgtccagagggagttggggcaggggatgcgctctttgtcttctctgaatgaagcgagcgaggagtgaggcagagaggaaggaagatttgcagacaagcaagcctcccaggagcttgttggattggaatgtattctcaggtctattgtagagacagaaattccagatttagcattctgtcattgtcagaataacaaattaatatgtcttatgcccacacaactacatatacgcaaatatacaggcatgaaacggaatatctggcagatatcatgtattttataactctttggggacaaagactgtgctgagaattcatttttatactgatagagaaccccagctccccacctccaaaccaaacacataatctccacatcacatagatgtgggcgattcaaattgctttctcctgtcaaaaggtagcatctatgaatcactaagtagagtctatgaaattctcagttgagaatgtgtctataaaatttcctcctttcttacctttttaaataaaattactaatttctctctcaaatctgactgtggaagccttaggactagtgggatattgcagaaagaatgtgacgtttgggaccaggaaggtgctgagattcggattccgcctctgctgcttaccatgtgggcaacgctgactctgggcaagttacttagctctcttagcctctgtttcctcatgagtcaaaactgggaataaataataataaccttttagggttgttttatctctatgattaaacaaaataatagatatgacatacattatgggtctatcacatgataaacgcttaagaacagagactccttttactttccagttatccaaggtatagagtatgagaggggcaggtggctgtgcagtggtacatcttagtgcataatctctagatttttggatttttttatattgagaagtggactgccaaaatttttgttaaatgaaaatattttaaaaataattaccgtcaattaacattatttcataaaaaagacattctaacattctaaagaaagccttcaaaggagtgtgtgaaaattaaataagatcgtgcatataaagtacttaatagtttatattagttcctagctttgataagcattttaaaaagcactaggtatagtttttagatatattagttttagtattggtatagtataaatgttaccataccaagaatcaagtccaaaatctctaacatgacatataaatgggtgttcacacacacataagccatttgtaccccacaaccccagtataaagctatttacagatacactctactccagccaggggtcccagatataaacacttgtaggggctgggtggataatatcattaagtaacatagatagcaggtaagaaaaactctgacgtggtgttagtctgtcttttatccttcattgttgttttaaacatggattcaagctctgaataataataagagccaacatttataatggcaaagaagaatatcatcttgctatgtgttcaagctaagcatatgtttatgtgtaagcatagctttgccaagtataaaaactagtttggaaatcctgtatggactcaatcagcttaatttttacatttttaaccctctgattttgtctttatgtttatcttcaccagttctggttctgcatagaaagtctttagaggaatgtaccctttccgataatgcttccagatccaaaggatgcctcgaaagtgaccaggaattgctacagatggttgacttttacccagttgccaacgttcttctggggatgctgtgcgttttgtgtcctcatcccaactcctagccacttcaggtttttatagatgatcttcagacaaaaatagattaagaattagccaggaggggtcaggcattgtggctcatgcctgtaatcccagcactttgggaggatcaggtgggtggatcacctgaaatcaggagttcaagaccagcctggctaacatggtgaaaccctgtctctattaaaaaaaaaaaaaattagccaggcatggtggcacgtgcctataatcccagctacttgggaggctgaggcaggagaatcacttgaacctgggaggcagaagttgtactaagccaagatcgcgcctttgcactccagcctaggcaacaatcgtgaaactccatctcaaataaataaataaataaataaataaataaataaataaataaaaagaattagccaggaggaatgacaaatagatttcatctttggactaccctctttaggggaaagttgtggttcttcatcctgctggtatttaatggattcagcttcatataggggatactagcttggaaggggagatacttagagaaaaaatgactttcagtgctatagcaaaaaggaatttaaaacatttcaaaagcccccaacctcagtacattccaaagcaggataaaataaatacaaacaaaaaatcaacacctacaccaaaccaggctaatataaaacaaaacctacttaaggtccagatttttttgtcccagcatttaaaaacagtgccagcatggactgaagtaaacacgctgcaatgatttctcagcttgggaaactgtcctttcttatatgtgagatgcctacagaggaagcagaaagatagtaatttctttcccttgcttttctgggagatggatctcagtgtttttgtcccttggtcctagccattttaaagagactgctgccagaagaaccacttagcacaattgtgaaaacctagtccccatccatagcagagatgctttcctttaagctgtactttttgagatattattgacatcaatatttgttaaaaccaaccttcgtggagctgttgctatgtaaaatatattacacttaggtcaccaagtcattagtccaatataggtatttggaagttggtttttagtcattctctttaattcaaatggaattagggtcagaagaaatgttcaagtcctaatcacttagaaacccatatttggcgtgttttgttgcttgggtaaagggagtaagacctcatggcttgaaagaatcctaccagaggtgttttgtttttttttttgtctgatttcctttttcaaacttgataagggagtaggcaaaaaatgtctgagtcaccagaactggggtttcacaaatgaatggtctcgctgtaacctaaagtaagggttgaagtgggggaagatgaaacaataggtggctgtagcactggaagaatatttgcagccccacaaactaatgtctgaattacttaggatacatccctctgtctagagccagcccaaaaaaatatgtgattcctgccctgattcagatagagatatctccaggctacttactatatgtatttattatgaagtacatgaataaatcgccacccaaatacagtaaatgcattggtattaaaaattaacacagactttttgttgtctgtcatcccatcattttctctttaatgaaataacggtctggaataccacctaatggcctgagatgcctcagagtgaggtgtgtttttaccaattctttaacttaatcagactggcctcttgatatggggccaggttcttctgagtaactcactctgaagaaaagcaggatggattgattcatggaatatggaagtgtttgcctagtgggcttcttttcaaaagctcaagaactttttctaaggtccctggtgtaccctggggaaaaaatattcttgactttttttttttttttgtcaaactgtttgtatatgtggggtgtgtgtgtgcgtgcgtgtgtgtgtgtgtgtgtgtgtgtgaagttgcatgttggtacatacttgagatgtcactatagcttttcttgccatttttcattccatttctactgggatgagcaaaattgacagcttctagacatctggaaagaggcttttgatcttaggaagtgaagtacataatcatggccaattttacctatgaggaagataactaagtggtttctcaaatgccagaataaaaaaatgacttcttgtttttcaaaacaaggcatagagatcccaatagcaacacagaatgtttctgtgtatcagagcagaaaaaggggaattgaggtagcattggttgaacacacactatgtgccaggctttacactaatttgcttgaataatttaagtgagtaacagaacaatgtttccactaagttgcagcaaaaactacacatcttagactttccttagtgacatctcgaatcttcagggaaggtggggggtgaataattgaaataactcttgatttcttatattagggaccaggaatatgcccttgataggaaatctgtcatttggaggtcattttggccctttctggaagaaaaggagacattgagtgctttgaggttccaacatcaccacataccagttagtgaaggtgacagtcttctggatctctgaccagcaccagggctgttggcccttgttgctgcccccatcagtctgaacagactcttttcccaaagaaatttgctaaaatgacaaatcagttatcactgtctattaggacatccactgcatccatctatcctaatatcttcctcacgtatgcctcagcggcatgttttacttctatttactggtaccacagtcttagcaaaagtagcacattgattataggagttgtgaagccttgagccctgacaaatggggaccacattgaagaaaatggagggacaagatactaatacaatttccattaatgacctggatagagtccccaggcattgcttatgtatttaatttttattctgattatttttaacattgtaggcagaatgccagaacgccaaccatcttagcttcttcaacattatacagtgaaagccagaggggaaacctaactcatcagatcatagttgacattgggggaaaaaaataaaggtcagcctacaaaatttcttcagactttgattaatacagttgtagatttgaaaaaaatgttttatttgagttttcttcctacatattttgagtttggatgtaaaatattttcttttgaatttggaagaccacttctctaagaatggagagttaattagatgattttcttttctttctcattggaaatgtaaaccgtgttcatttattcaacaaatattaattgagtgtctgctatgtgccagacactgttttaggaacctggaatgctttcaggaacaaaaagagaggaaaaaatatccttccttttgtaaagtttacattttagtaaaaggagaaagaggcaatgcaataaacattacaagtaaattccttttatagtatgttagaagattatgagattataggagaataccaagctgagcagggtaagaggatagaggtgctgagtaggaggataggtgaatccaaagatgaaggggttggttatgtcgttatttggggaatataaggccagtacgtctggaatgcagggaagagggagaagttaactactgggagccagagcatagtaggtctttttggcccctgaaggactccaacttgtactttgagttaaaatgggagccactgcagagtcttgagcagtcttaactcatgtgactagcatgagttaacttgagtcttaagatgcttgtgttggcctctgtaatgtaccaagaacagtttcttgccctatgattccagttttcgataagttatgccatcacttgctgcaaaacagacctcacccaccatgacactgggccagtggctatttattcctgatgaggcattgtaggatctagatcaaactactgtttcttccaagcttcctgattgcacattttcatggaaaaatgcaagggtatgtggtgcctaggaaaaggacagtagaaacggtaatacattttactcttgagcataagttttgattaactttgtcattatttcaagccaatatagccacaaacataattggtggttatgaaattatgcaatcacactgtctgaggcctcattaccctttaacttataaatctgccttgccatctttccatgatcctcttaaagaatgtacctacccaccacctacataataaaaaaagccacaagccccagccttgggggaattgtattgatttataaagagagaggctatcacttgctgttctcattaacctggaaatagacaccacattttatctgctgctctgtttcctgctgtagatctgtgtagtaaatccattaatctgtctgtccattcatccatccatccatccatccatccatccatccatccatccatctatccatctgtccacccatctgtctttccatccaaatttccatttttaaagggactattttgtgtcaagtgtcatactgggaggcaatatatttcatggttagatatataggctgtatgtagcctcagactgtctggaattaaattctgcccattactttagctatatgaccttaagtaagttttgttatttgagcctcagcatcttcctctgtaggatgagaatggtaatcaaatgtatcgaagagttgttataaggatcacaaagttaattaattcaagtccttttcattttgtcccggaggaatagttttagtagtttgagtttgcattcaatcatctcccctttcgctttttcatcagtttattcctttgcagttcatccagcagcctatcaaggacctagtatgtgttaagtattatggagacggggatatttttctgagaaatggaggctgtaggtgtgtctctagcacctaacacagtgcttggcacatggacaatgccctgtatatatttcatggaatgggtgcaactccctgcccttgaaaagtgttcagtgtgtctgtagaagtccagtgccagatgggagtgtcactggtgcagtgagccagggacagggagcagagaaagaacaattgagaatatcagagggagatgatcctccggctgcttctgctggcctggacatttgaagggatttcttactgggactggctcttttgttctgtggtttgtatttctgcctttgtgcgaatgacttgtctgacatttctgggactccatcctgatatgcaggccagacaggtgggatcccagtagggaactaggtatgcctttctgtgtattccaggaagagtttaaccttgggcagacagggctagtctttttgactttatggtatgtttaatatcaacacctggttgggggtagggataataaatgtttggcttacaggacttgcagctttgcaagatacagtggtggtgcatacacttatatttgttatgactcatcttagtgcaaaggcaatggagtacctctagaaaaattgcacatttaaggggataatttcagtggtgactttagtgggttttagaagcacgtgagaagtaaatatgggggactctggagctagaatgcctgggttcatagctcttatcttttctttttctttttttttgagatgggggtctcactatatcacccaggctcaccttgaactcctgggttcaagtgattcttttgcctcagcctcccaagtagttgggactgcaggcatgaaccactgtggctggtcagctcatagctccatcttttattggtcatgttaccttgggcaatgttgttagcttctctgtaccttagttttattgctgtaaaatggttctaataattacaggctacctcattggaagttgagaggattaaatgagatgatatatttaaagtgcttaaattcttggctcataataagcattcagtaaatgtgagctattatttctctttctcctcctcatttttaattttttaaatactacctctattactattgtgaataatgtcattataaaggtgcaactagatcatgtttatgaaggtaggtaattgcctagcacaggcctggcacagataagcactgagcaaatgttagttttctttcacatgggtcattaaagtccgtctgtaaagtctcagggactttctcatcattttccctaaacctaatgcaagatattcacatttctttttgtgcaaagaacaatcttaattcagctgataatcggggcctcccttaccttcccactgctcactataacagagaacaagtactagctcataactttttatgactttgtattgaattaaaattataatgctttattagttatcttttgctgtttaacacatttccacaagcttggcagcttaaagcatcacacatttattatctcatagtttttaagagtcaggaatctgggcacagcttagctggatcctctggtttatggtttcttacaggttgcaatcaaggttttagccagggctgagttctcatctgaaagcttgactggagaagaacctgcctccaagttcacctggttgtaagcacaacttcattcctggagtgttgtgggattgaaggtgtcagttcctagctggctgttcactagaggctgccctcagtttcttgccgtgtgggctttcccatcatggcagcttcaccaaagtcatgagagagagagggagagagagagacagagcctgctaactagatggaagttgcaatcttatataaagtaatcacagaattgataccccatcaactttgctgtattctgtttgttacacacaagtcacaagttcaacgcaaactctaaaggaagggattatgtaaggatgtgataccaggaggtggggaccattgaggctatcgtagtctgccatagcatgcctgacctgtgggttgtcttttagatgctttattttgcctaattttattttattttttaacctcagttcagagaattcaatttattagaacaggtctgaatggtacagaggtgctttaattattcagcagaattctggaaattttaagttttctagaaatgtatagttttgctttactttttctccccttataaatagaaacctgtccttccatgaatgaatgctacagtttcagagatgctttgtttttcccctgattgattgtcagtgggcagtagcctctaataaagggaacagttttaagtttccttttcttctcagcttctctgttaaatggttaatgatctggaagcaagtacttggaggtccttagggagctcctatttaaaggaacactgtgaagagaagttgccttctacagtaaaaaagtggggatgattagtcctccatttacatgtttagtaaatctgaatatttagacttccacggataccccctgccaacccccgccaaatagatgagctgaaagtacaggatagtactctacatgcatctgactgagaaagacttttactatctcaccttagggtcctaagagaagacagctggatggttgcatggcggtagaggtgtcaggaaaagctcccttataattattttcattcctatgtttctactcaatactatttaaactgaaatggggcttcatctgctcctttgtttattcagcaaatacttttgagcattttttatgatccagctactgtgctaggtgatggggttacaataagatacagtcccagccttcaaaaacttatgtgctcaaacgttattctccaaatctttattctgtttctcatctatcattaatgggaatagacagctcattttttattgttcttggaggctagagagtacaggcaaatgcagatgatcaagcctttcttattgccccactcctagttgattccctctccctttcttttacttatgacatgcaacttccacaaaggcagtttatgttagttatctatggctgcataacaaattactgttgaacttagcagctaaagacaaaaacatttattatttcacagtttccatggaggaggaactcaggcatacccttgctgcgtcctgtaactcagaatctctcagaaggttatcattgaggtgtcccctaaggctgcagtcatcctaagggtcgactggcaaaaggtctgcttccaagctttctcccggttgttggcaggatttagttcctcactggctattggccagatccctccctcattgcctcaccgtgtggacctttccatagagcggcccatggcatggcagcttgctttactagagagagcaagtgggaagagccagagagttataaacaagacagaagctatagtctttggtaagctaaacttggaagttatgtcccatcacttttgttgtattctattcaaaaaaagctacttactaggtctagcccacactcaggtggagaaggttatacttgggcacaaatactaggaggtagggattgttgtgagccattatagaagttgtctaccatgggcagaaggacatttcaattctggaaggtatctgatatggagactcttaaggcacaatgagttacccgtgagctacctcttgtacattcatagctgtccaccctttttatattttctgtggtatcagcacagagattgggggcagggggtggaagcatggaataaggaattagatgccaaaactaagaattttattttttacaaagcgttatcacatattaaatctggaaaggacattagagggccttatgcaaatgaataaactggcctagagatcttctatgcagcccccccagggtctgttctactgcagaccctggatctcctataacagaactataacagaacactggatctccacagaaagccacaaaggcccagagatgtgttcgcacagatgtcatcatccctcttctagtccctgcaggagcctcatgggagatcacgtgaccagtatttcacagctctttcccccagcacagaaatatctgccgtgttgagaggcctgtccatctcctagtccctgctagagcctcatggacaatcacgtgaacagtatttcccagctccttctcccagcacaggaacaccctgccatgttgagaggctcactcaagagcctcatgatctgcctgctacctagcaatagctttgttacataggttgattctgccttgtgcctagaaaataaatcatgtttaggattaataatagtttatataattaatatatgtgccatgcttgagccaacacattccatcacttatcttcaggctggctgcctcctgggagccactaggtctcgagctgcaggctgagcatgctgggtaacaatgctataagtctgcttactggacccagtcctacagcctatgaatattcttttctgtatttgaatagcaatagctggagatgcacaagtcttgataaaataattttacatttgttatattcactttttttcttgcctgtcaaaaatgtcagcttttactctctggcttgcaatctaaatggacccaattttaccttagctactttgatatgatattagctgcttagggcaattgcaagaaataccatacaagggttaatctccctcacccttccattcctttgatatgctgttggaaatttcaaagtgctcaaacacggagatgaggaggcagagggtaaatggatacagaatggctgggaaagggagtagcagtggttggctgctcttaagatctctctcccatggcctggtgccatgagtctgtgtccagtgtgatttttggcaatttctacattctatgtgtatttgtgaagtactgtttttgcatcagatgatatctaaggataaattttgtgttagaggagtgtagttacttgggaggaaagcagtgccatattattttatattaaacatcactggcagaaatatgaggatgggtaaatgtctactgataatttaatagattttacctgcctaaatgacattatttgcaatctgtttatttagttagtagcaaatcctggcacattagcataatacctaagggcaaaatattggattgactgtttgtttgcccttaggttatttttaaaaagctacttgtataaattaaaaaataaagcgaggcttggttgctaagaggatggtgggatttgtagactgcacaggagactaatgcaaatcaaagagaccaggaaggaaaggccaggagaacaacagacaacaggtgaatatccagaaaccagcagattctaacaggcaagaggtagaggctcaaggggagacagatgattgattggcttcagagaggtctggtaggaatctaggttgtcagctgggatcgtgatcttcagaacagaccagtgtggggcaagcccaaagcaataacttggggtcaggcatgaggtcagggcaaggcagtgggagaattgtaagctttgaggtatgtgtaggttaggggcttggtcaggaccaccatcagcaggatcaggattagggctcatgggtcttgaacttctttcattcttcctgaccagaggcagggctagtcccagggcctaggacaaggctaagcctgaaggtggacattatgtgacaaccaacaaaaggaggaacatcatactagagtcaccgtatgtcctagtttctctaggacaggcccactttacatgtgttgttccagcatgataatcagtggttctcccctttcacttgaaagtgactgacttgcgtgataagttacatagttaccctgattattttccagaatgtgtttcataaaaatctttttagaagaatgtcatccagagaccacaaaagtagagttctctagtcacataagtatggcaaatccagaatgaaaggaagtttaatggaggagtctttactgcaggatttctcactgcctttatatgctaaattataataggaattgctaagaggggaatagagttcttagtttcccatccttggttgatctatttgtacactttggtactcctgagactacgttatgtggaacacactttgggaaaccctggttagttgaatatggggtcagaaagggaaactggtcattgctcctgctgtaataagggtgcttgcaaagacagcagtcaccagttaaataaataattctggaaacaacaactgcagactctgacaaaatcttcaatttgctgattattgactgacattagcagaggtatatgtgactagccctagctgagtaactttctgaaggatgacttgttctctagctcattggcaaaaccacttactacttagggcatgggaagaaagagaattttctttgttaagtctttaactccatgatgttcttaaaggagagatgaatgaggagataatggtgtgtatgctgtgtctctgtgtatggggaaggggcctcaggaactatgtatttttcaccagcattccaggtaattctgataaaggtagccctcaaaccatttatggagaaacatttcctgggagttctgatgagaaactcatggtgataaaaacccattcatagtggtcatttctttaatcatatgagtcctttgatatgatggccagtgatctgatatttgcgaagttcccactatgtgccacaccctatctatgtgctttcagtgcttaacgtatactgtgtgaaatagtcctcatagaaatttagcaatggccccattttacagaagatgtctaaagatagaccttcaagtgggcccgacttactaggccattccatccgggcccgacaagagggtcacagctcttagacccacccctcagcaactccctaggacaaggacacaatgaggcaaatctctgagcctttgccctaaggttacacaaagctcatttagagccttaacaagcattaagaccattccattacaaacaggaccatatgctgacacattttatctctctgcctggtggaatgggtcaatatcaaacaagctaatccagggagaatgatgcattgatttcctaggccttaccaagtgtgcaggctgaagtcaacctacctaggaaggttttttttttaagatgaggtggaagagagaatacagcaagaaacaaggagaaagatttgctttgcttttgttatggagttacaaatccagacaagtgacataagcagcttcttgtttttagctgggccaaagaatgtttttcttttttaatcttattgaagagccaggatctttgtaattccatcaaggatttcaaactcaaatgcttacaggggcttggagcatgaggagatttagaactgcctgctgggtgggatctatggtgacctaaagaagacctgcctcttctaaaggggactcctgataataatgtattgtatgtttcaaaataaccaagagcaaatttcaaatgtcttactctaaaaatgctagatgagcaagatgataaagatgataattagcctgatttaatcatttcgcattgtatacgtgtcaaaagatcacataatattccataaatgtatacaatcatttatctatcaaaaataataacaaaaaataaaaaagcagactgtgctttttagcattcagagaatagattgcctatggaaaatatggctgttttctcagaaatttcaactttttaaacaaaagttgaaaatctatattttttgaaagtttttctgatttttaaaaacagacttcttgagatataattgatatacaaagagctgtacatatctaatttgatgaatttggacatatgcaaacatcgatgatgccttcaccataatcaaggtaatagacatattcaacacctcccaaagtgtcctgtgctcctttcttttttgtgggtaagacgcttaacctgtgatctaccctcaagaaactttgaagtgctcaataccatattattaactatgggcacaatgttgtatagcagatctctaaaatttattcattgagcctatatccattgaacaattccccatttctccctcccctccagtccctggaactaacattacactctctgcttctatgagtttgactattacagatatgtcatataaatggaaccctgtagtatttgtcctgtgactggcttatttcccttagcgtaatgtcctccagtttcattcgtgttgcaaatgataggatttccttcttttaaaaaactaaataatagtcatgcttggatgaaactttgggttgtttccatatgttattgcgaacagtgctgcaataaacatgggggtgcagatatctctttgagttcctggtatcaattgtttagatatatgtccagaagtgggattgctggatcatatggtagttttatttttaatcttttgagtagccttcatactgtttttcatagctcatactacattcctaccaacagtatacagggggtccaatttctctacatccttactaatagttgttatcagtttttttggataataaccaccctgacaggtgtgaggtaatatctcatatctcattgtagttttttttttttttttttttttttttttttaggagatgggggtctcactatgttgtacaggctggagggcaatggctattcacaggcacaatcatagcatgctacagccctaaattcctgggctcaagtgattctcttgcctcagtctcccaagtggctaggagtacaggtgcataccatcacacctggttctcactgtaattttaatgtttatttccctgataattaacaatgttgatcatcttgtatataattgtaggccatttttgtgtgtttttggagaaatatctgttcacctcctttgcccatttcttaatcaggcttttttcttgttattgagttgtaggcattccttatatattttgggaattatccctaatgttgcaattaatttgagtgtttaaaacattccataggccaaataagacatacagacttctggtcagtgacctctttcacagctacatgtgggtgacgctatgtcactcaaataacgggacactcgtttactgggtgtccatggtgttgcagacatttcataagctacctcatgaagtcctcaaaacgaatccatgggttgaaataatcatgcccatcttacagataaaagtgaggcccagagaaactaaatggtttttccaagttcacacagcctacatgtggttagtgcaggtctgaattctgattggtttgaccagaaagagctgcagatttggggaagttttgttttctctcctctggggaaaaagagtcccactcagggttattccattactacagatggtcactgccccggggccagggccatgccacttttctccaaaggttagtcccaccggtatgtgatgcagttggtggactggctctcctttgattagcatgagcgacgagttagtaattgatcatccacctttctaaggttgccaagcttagatttactatattttgtaaaatcacccttccacgtccttaaagtccacgtgcatagtctatctagattctgatatttcatgtgtgaaattaatcctctcggactgtaatgaaaatgtggctgttagcctctaattaagatgtgtgtatattgattgcagtggtcaagtctgtccactgatatattaaaataaataagcatccattttatattggaaattttgtgacacttcttgagacaccttgagtttctctgagttgttacaaaaccagagcaaagagtcaaagctgtaatttctgcctatcactggcttttgaatagattatgaactcttagaggattgggtttgtatctatatagttctctttatacagagatgaaggctttcacagcagtatctataattgggtgtttaataaatgctttttgatgagggtaatggtatggaaataaagctcttgagatccagagtttgcttggatttcttgcctcattagggaggaaaaggtgaatggggatgcatgggtaaatacgaatgtcaatctcaggtaggaaaccatatgctcttctagcatgaaatgctgaaaagagagaaaccagaagggtgtgactaagacagaaattctgctgattgacactaataccggtatttaccaatcttctgtaacgaggtagactccatttagaatctggtgatgtatcgcatacaagttagattgcttgacaagtcacaccaaggtttactcaaagtcactgccattatggtatataatcacaggctcaccagtgtcccacaagggtgaaggcagaggttaatggttttctttttatttgcattattacttgatctctggctttcctggtgagatgggtttttataagctcttcccatctcactttttgaagtgtttttaagctattttaaggctgttttataggtgccttttcttatgtttgttttgtatgctagaaagtaagtaaagaggatccaggatatgagctattgatactaccaggcacactgaagtaagtattaagtcttttattgagctttctaaatggcaaagtatatttcttttttatttaaaatgttaaaaaaaaaagtggtcaattctaactaactgccctaaatgtatcaaaaggcccttagaagttttcttctttgccaccatggtgaatccttcaagcaaattgattttaagcttgtacaacaatgtgaatgcaatgacactaaagtgtacacttaaaatggtacattttatgtatgtatattttaccacaataaaaaaatagattttaagcaactaatcaactacgaggttgtcagactgattcatagagcatgagcaatattttgtattcagtactataatgtagagaatattactctgttatagtcaagtgtaaaaaatatcatattttattttccttatgttaaatttgggccaggcatggtggctcatgcttgtaattccagcactttgggaggccgaggagggcagatcacttgaggtcagaagtttgagaccaacctggccaacacggtgaaaccttgtctctactaaaaatacaaaaattatttggcatagtgacacatgcttgtaatcctagctacttggaaggctgaggcaggaggattgcttgaacccgggaggcagaggttacagtgagccaagatcgtgctactgcactccagcctgggcaacagagcgagaccccatctcaaaaacaaacaaacaaaaaattaaatttggctctgagttctcatctactggaaaggtgtgtgagaatcaattgtgttatatttaaggaaacccatttcttaggggtctttgaaaatctaaatgagacttacatgagatcaggaaaatgggagaggagagctgcattcttcccatggggaactttgtaatcatttttctctttgccacacaatggaactctgcgatttggcccttcaccgcctgttaggtttatatgcttggaagtcagggagaggctcctgtaattgacctctctattgaccacagacttggccagaggagcaccttctgctcttctccaggctgcagtgttgttttcacctccagagggacctgcagcaatccttttcacctttggcattgcttcaaaggggacatgggtctctattagtcacagaaactcagcaagatcttatctcacttcagaaagctcatatcctctgagtggactcttctacctgcttgaaccccagcatgcagccagcccagattctcagacaaacctttggatgaagaaagtgaaactctgagtgacaaataactttggcttgtctgccctaagaaacacaaattgttagtgctcttgaaagtaaaggttctgagactcagaacaggatggcctaagatcttttctatataggggaggaaaaaaatgtttttctgttttctgaatgtccaaggcagccagaacatgacaaaattttatatatatatatatatattttggcaatgcctagatgagtattagtaacatactagttgcaagggtagctttagagacagagaacttgggtttgaatcaggttgaagcaggttaagttccccatgcctcaattttccccatctgtaaaatagaaataacagtaatttttttatcatgaatttactataaaaataaattaaataaaaattaatatgtgtaaagtactttagtctggcatgtagaaagtacttaatgaggaagctataataataataataataacaattagttaacattaccaaactggttattcagagtttaatcctctggaactctatgcttagctctaatctcaaggagtccagggaagcagactaatcctcactattaaattttgtattgattctcggatgttttcaaagaatcctacatccacatatctcaaaggagtgctattgatttgatcattttatgaaattcttacccttttgctttcagaattctagctagatgacaaaaaggaaataactcacacatgtaaattaatcaaactattttggaactcaaacattgcttgtggaagacttgcagattgagccaagccctgttctttattaactctggataatttgctttctttgtttgatccctggcctttaagtgaatgtcaatctcttgcttttttcctgaagacctataaggcttgctgactaaatttcatggaaattctttgagattcttagctagaagaggctgtaaaggccaagtgctataggtactaacgtctcattgctaacactgatattttaccttgatagtaacttccaacttgacataaaagcttgtaagcaccagatctttgcctctccccatggttgtatgtgtttgaattctttggagaaaattttatgacttgcatggcttagggtttcataaattataaaaatgttttatctctggtttgaatagagtagtaaagcatatccctgatttctcacttcttccataacccagtgccttcttatttctaatgcctcctagtctgatgtcactgagaagatgtttatggccttgcttgccagagaactaaaaaagaaaacaacaacaacagcagcagcaacaacaacaacaacaaaaaacatctaacaacggagccaatgcttactcatgccagtcccaggattccatatatggggacattgggcgtgttttaagccatatgctcataacctttgtgtcatgattcagttggtgtgtcttgatcagtttcctcatctgtcatctcttggaaagcatgtaaagattaatcacagatatctgcttgtattacctagattaatgctagatgattagcagatgaaccttaacatctcagtggcttaacaaaaaaaggtgttaatctcccacttctatatgaagcccaggtgggagtaaggctgtactccacaaagtcattcagagaaccaggctgttgaaggctctgccatttctagtaaatgacctccaaggtggttctcagcacaaacatctattcacagatggagaaagagattttgcatatatatttttctaattttcatttttgcaaaatgtcataataagcaggtaagatggagcctcagttggagttgtggttagtcatggtgaaacaagagttaaaaggtaaaatcgacagatttcctatcagctatttatccatcattactaagaattacggagtgttaggcttagaaaaggtctaggaattgactcattttcctacttccaggagatctggttctagaacccaggacttccagctcccaggcaaattgaagcgcttcttcttccacatgggacccacttctatgagagcatcagtctgttagggttaagtccaagctctaccacttaagagctgaacaagttatattaactgcaaagggataattttagcaacttcctcattaggaggttgtattaaatgcacaatgcgtgacacacagagacttattgtcattattaatatcccaaattttttaaatggtcacaataattccccttgcaacttctgtcatatgaataagcccaggatcgcttgatggatgatgatgaaggattcatggccaagtcatccacaccacctcagccgactttgagtcagtcaccagacatgtaagtcatgtaagtaagaccatcctagagcatacagccccaggcaagccagcctagatcagaagaaccagccagcctactcacagaactgtgagaatgaccaatgtttgttactttaagccactaagtttggtggtggtttattatccaacaaaggctgatacagaaaggatcacaattgaggagtttatgtgagctcaatctgaaagtttatatgagctagatttgcccattatttcactaaattcatcacatggccccacctaactccaaaagagactggaaaatgtaaaaaacccagacagaaagggaagtaggctccaggacagctggccaatatctgccacactgatttaccttgattttgtaaaaacaaaacaaaatcaaaacccttaggtggcaatcagagtgtaacaactttccaggcaagttctttgggacaggccactagacagtcacttttagtttatttgtttctcacaggaagatagagaaaaggaaatgcgacagatgtgatgccttcctgagaggctgtctggtaaatcaattcctgccaaagttctcctacaaccctaagagataaaaaaggaacctgcaggcgaaaaccacaaggtaggaagagtttgaagctgtgatctcttagaataagagcttttcatttattctttctgagaaggaagtctagggcatctgtcattgagagtgctattgatataattttgctttctgccccgtaggatctgaagcagtcctgccccaggcttagagaagtaagggcaagctagcccaattctgtttgctccagcacatctcatcccagagcatttgttgtaaggccctcttctttttgatcccatgtctacatttggatctctggtctgggaggagaaatctcagaggctatgaatctgatgaggaaggcaacttggcagtgcagaaagcaccctgctttgcagtcagactttccagcttccaattctacctctgccagattaattagctctgtgtgatcttgcacaacttctctaagccttaattgtgagaattaatattgtatttattaggagtatggcacacgataggtacttattagatgttagctatcatcatcatcttcatcataatttgattttgcttttcttattccctttgatcttgcctcctagtctaacaggagaaacattagaagttggtggagacggcctagaaaaggaagggtagattagagagcaggagatagtgaaaaattacagttatttcacaattgaaatcctatcccatgtttgcattgttaattatagttttcgaaagactgtcatctaggcaatctcatttcgcatgaccattctatgagacacaggaacatgcagtctattttggcagataaaaaataaatacatgaggagttaagtaaaaactgtgttactgagactgcagtaacttttataaatcaatgtgcaaaaaaaattcaagtattttggaatgagatttgttggattgaaatattttatggtggtctgtaacatcagctcgtgagctcatagaccaaaccccatcccaaatacctggtgttcaggattatcaatataaaaattgatttaagatccccataattcatttactcctatttcctgacatgcagaaagcttactgccactgggttatttcatcagtttttccccatctctccataactagtctacctctgtatgcttggcttctataacattgcttactggtctttcttaaggcatgttgtgttctgggtcagttctctttaatctgtggccaaactcttgctcagatctaggaatgtgtcatctatgtgcatctttgttctaagctgaacatttcttagcactatacctgagtttctgctgccacctttcatattcttttatgatttgcaaagctagcaggaacccaaagtgactttcataaccaagtgtccagggtctccaggagttcaggttctctctagtaaacagttccaagaccgcaatgaaagagatgtcacagagttgtatatagtataacattaactaatatttgaatgataaattattgccataggaaactagagaaagaaaaagacactttgggatggagaggttagggaagattctgtggaagatgtgagatctgagctgtgttctatggggtagctaggtcgaggtaaaaaatgccatagccaagcgatcagaggcataaatatgcaaggagtcttgggtggaatcacaaagtttagcagatgagtacatgaaggtagaccctttgtgccaggaagtaattttgacagaatgttggagataattttgcctgtaatggtttctgactgacagtttattcattcattcaatcattgagttcaacaaattcaatttattaagaacatactatatttcagtaactcttctacatcccagagatacagcaatggacaggaaaggttctttccctcatgctgattacatcttaagtatggagacaaacaattaaaaacaagcagatacacacagtaatatcgtatagtcatagaactatgaaatgttaaagcaaggaaacacaatagtgactataagggtcaaacaccattgtagagaggaaaatcagggaggaccacttgggttgggtgatatttaagctgagatttgaatgaagaatggaagccattcttgtgaaagatctgggtgattggcattcctggcagagggaacagctaatgcaaagctctaaggtggtaacgagcttggtagagtcaaggagcagctgtcattgctctgtagtgcacttggaaaatatgctcaggtctggtcctactattggcacattaagccagaatctctgagatgaggtctaagccacagtgcttattaacacctctccaggtgattctaacagttagccaaggttgaaaaccgctgtattaaaggaaagccaaaagatgaagggcttttttaagcagacagagaacactcaccaggggaatcaatggaggagggaagtgaagaatgtaactgtgcaggaagagtatgctagggatagagggatgctcatcttcgacctggtaatcaatggaatccagactgacctattacaagagtggggtccctatgctctttacatagtctcccttgtcagtttcctgaaatttattgtgccaactatggtgggagttaaagcgttaaggtttggcttatttgttttgggcagatcacagagatccaggactcagagctagggaatagacagctgaccccaagctggaaaaactttcccagatactccctcctgcctaggaagtggcctatgaaaaagcagtttaaataatggcagcctaaaatatagttctatatgcaacatttttttttctatgaaaactaccttttgccttatacaacctgttaaaaagtgggagatttcactaataggagggcaggagttgagcacagatccaatagaggaaaaatactgtcttcaggcagataggggatgtgccactggggccgagatgacgagtttcgtgaaaaacagagttcaaaagaggaggctcttgagtgtaaagataatttgaggggaaaagaaaaagatagaatgtgactggaaggaacggaataggaaaagcagcatgatatagatggaaatctcctcatttctttgacgtccttaacaagaacatcaagtgaggcagaatagtcaagaacttggactctagaatccaaattggatgagcgccttaagcactttaatccacagtttcctcatctttcaaatggaaacaacagtgcctaggattcgttgctgtgaggactaatgacaaattgcatgtaaaaagcttggcacagtacctggcacttagtccaggccccactccatggtattcatcaccagtgtcaaaattgccataataattaacattgcctcaatcacaaaattcatgtcatgttcaccaacagccaatggcttccagataaaagtgagaaggccaatatagagctggggttaaacatgtcaagaattcaaagctatagtgcccctgggtattcaaaaagcgtaaagatttgactaaattcacagccaaatggcatttaccccaggtctaccccataccagtcactggcttctctctaatagttgttatcccttttaattctatagaatagaaaagaaggaattggggctaggctgagcagcagaggagagattggctgtggagagtatagatgacacatgaggccaggtgatctctgagaaaagtttctcccatctgttgcttagattgcccatcttggaactcaggaaatctgagatggctttaaagaaaatgatggcattgagaagtagtgagattgcagggggctttcaattttctgcttgggtgttggtggagagcaccgaggtcaacatccatgcttgcagtataaaattctaggtctgtgtccctgaaaagaatgttggtgtgagctaatgtgaaagatttggggagaatttgtgtaaaaagtaacaacaaacaccaaatgcctagttgagttctctgatgggtaaggtagaatatttgagagatttttttgagaatatttcccactgaaacttgggaaataactatagttaatgaattttgaagaaaagagttagcaaaagagaaagtaaatctgatcattaacattatatacaataaactgaactgggaaccaggagacctgtgtgctagactggattacattgagtaagcaatttgaattatctaggtctcagtttcttcagtctgaaaaagaagggcatgagattatattatgttgaatccatcttttgtttaaatttttgttaaattctatggagtacagagaagttgatggcttcaggcacaagtgagaaagtattttaatcttcttacatttttaggccatgtccaaatcatttgttttttcactttattttatttgaatataatttaggttttctttctcatggggtgaatgaaaataaacactttagaaatgtataaatcagtgtgcatttattggagtatggccaataactttagataatgaaaaggatgattgagctatttaatatgttgatttaagtaatgctgggtgatgagtggtagtgacaaggctcttctcttactaggatatcacatgaacaggttctgtcctaattctgcccttgcctagtacatatgggtgactagaatttggtgagagggggctgtctgctgagctaccccaactgtggttacagcacagttacagagatggatttttaagtacacttgttttccctgtcatttgtcatgaaacagactccctatgctcattatcaaaaagcccatatgctatcttcagttcacattttgctcacctctttctcttcattgcattagtcaagttcagaaactagactgtcagctgccagacaggctgctgtttctctcagagataggtgaaaaccatttaggaattcattatcaaagtgtacagcccaagaaggtgtttttgccttcaattcaattattccaaagaagcacacgataaagaaaagtactcaggacaattagatggactatctagacgtcaaaaatcaaatttttacctttgcaaatgcaggttcatattctgttcttaagtcatcagagggaaacatatgatgttcactgtcagtttagattgtcagaaaaagcttgttcaaaatctgtaaagttgtcactcctcatgtattttcactcaagaaaccagggatccaacttcctgtgcctaaactctctgcctagacaaatggatcttttgggaggttaagtatgtcttagaagaatatctgagctggagttgcaaatagaggaatcatcttttgttaagttgttagaacctagataacatagaagattactctatggggtttgaaaaaactaagacatgatgccctctcatgagacctttacagtctatttggggagttaaggcatatatgcccagaactttattttcagtggttcttggcaattttaaagttccggtagtatagtacaagtacccaaatgtgatgcccacaatgagggctgtggtaagtcagaaaagaggctgggttttggtttcttaggaaatggtaatttacatggagtctcacccacctggaaggattgcagtctttatgtttagcatcactttttgtcatttaaatttctctctaggtggggatctaatccagtccggagttacaggagctagaggtgatcagaaagtgtgcctaatttgacttttgctccatatgtgacataaaatagaaaaaaagtgaggtccccaaagaaaaggtagcttgagaaccaatgagagtgtctctccatgaactgtcaaaacctctgggatccagcagaaacagggtttgatttaagctgttcctgggtacaaaatgcgagctcttacttggcatttatccttgacacatatgggagcaggctttaccagaggcaagaattcaatcaaaagtcaggctttttgaatttaggtctttctcttttcttctgctataaaatggtgagatcatagcccatgccctaattggttcacagatggatacatcctgaggcaggtgggggtaatcctcaagttttcctacaccaaagcataccccagaacaaagaactactcgttctggaggtgaagataaggcctgtgatgggttgtcccatttgatcactgtggatttcctctctgtgatatcttctgctcccctggaatctagtattgaggaaaaataaccttaatcaggaactgtcactcttcttcaaagagtaggacagtcaactggcctctagcctataaagaaatattcctttcagatagactctagtatataatatcattctgctattcatcaggaagtggctgaataatttattatacaacttgtctatagatcagagtagatgaataataaaatctttagtatgtaaaaaccttacaagaaagttgagacttatggtagcaaaggatccagaaggattgggtcattttgtagttattagtaaacatatgtctgtgataaagaccactttggcaaaccgaggtatctctctacccatcatcctgcttcaggagaacttgggctctgataagtatgtacgtaatgatcaaatcccccacatttaccaacctgctccagtcatcattgtggtagatgtgtgcacgagaaaaatgctcattttattccattccatggatacttacattctctgcgtgtttatttaggaagcattttattgaaatgattcctcattatgtgtaacttaataccatttattcattaatttatttactcagtacacattaattgagtacatacaatgtgcctggtgctgggaaagcaaaagaaaaaaccaccatacttatcctcaaagtcatctcagtctatttgtagaggtgaataataaatgactgtaatacatggtgaggaagaccaccattaagtcagaaattgctaaaggagttagcaactaactgtctaagatgattgggagcattcacagagaaggttatatttgttgaggaccttgaaggagtaggagttgcctaggtaaatcaaggaaataaagggaataaatatcaaaggacccacatgtatgaagacacagaagacatagctttagagaagtttagagatgtttgtagagcatgctggaacacaagaaatgcttttggaaagactctgtaaaatatttataccctaatactaggtatgcaacagtgaacatttaaagtttattgaattaagtcaaccaaagaagacccaagttgtgggattcaagaatagcaaggctctttcaaatgcctctgaaacagttgggggtggacctctccatggtgctgaaacatcccctgttcaagccttcctatctatctggattattggctcctttccatgttcctaaccctcattctgcatgcagtaattacttgattgaccatttcactcactggccctgccaggaccttgccttggatactacctgtccaatggtgagcttattattctttcctttaacctgcacagaccctggatgggcatttgatcaactgaaataattaatgggtagaaacagatattgtcagtgaagtcctttaacttctttctgcttgcttttctcccagatattttagcatttaattaatctggatgcaatttattagttgcttgggttggaatttctttagccttttagcccagatcacatatacttattacgtatttattggaattttcaggaaactgtagttcaaggtgaaactttgaagatagactcaaacaatgggcatgtctcacaatgatacagaggactcagataaagttggtggaatagagtggaaagaatactggatttgaaattaaaagttcaaatcagggtttcaccacttagaagctgggtaaagtcatttagtttattttgaagcctcagtatccttatttgtaaaatgtagacaggttattccctgtatactcacaaacttgtgctaagactcaaatattctcatgtttgtgaaattagtttgaaagtgatgcagttgggaacgattactggataggttggaaggttgtccaactggtgcccctcatgatgggaagagacagaacactgcgaattagcacagtgaaagttaggagctgtgaagaccctagggggcagaggaggtacaggcattaatattatggtgctgagaagttaatatctttctttttaaaaaatagctcggcatagaagctgtcagtagggctttctccccggtcagatttatgacttctgaatgacattgttttactttgccatttggaggataaacaaagctggagagaacaaaagttttattttcctatcagtgacaaatacatagcaatcaatgtaattgaagttcaagtggaataatttatgggggatccattgcatgctcctttgtgtactctgtctgtctgtctctctctcttcctctatccccactctaattcctttcaccgtcatttatttctgcctctttctggtattcagtcctgtatatattaaaagcataagccaattagaaaataattgctgttactctgcttggcccatctttcttgatgtttaggttagtttggcattttattctctccaaagaatgtatttattcaaaaaagacatctaccacatttaatgcgggccatttagatattaatcatcaaaggtaaacgatgaagaaaaattttagtctttaattcttttcttaaaagtcacatatacagagagctaattgacccatgctatgcagaagtgctctgcctgaagcccagggttaatttttacaatggccacttagccaattgaggatggttaagtgagcaatattttatagactcttgtattaattattttgggggatggatataagtttgtggatggggaaaacactctcagattattctaggggagatgaatgatatatctttacaaaaacatataaaaaccttaatttcagtgaatggtttataatgtaaaataccacaatgatatataactggataagagggcttctctgtgagtagagcttatctgtatatcctgatgaaatttaaaaaaaaccccatggaatatatgtttttgggggttaacaaaaggaaacttgggaaccaagaaaaaggaaggatgtaaattaacttattgttgtcctttattgtttgaaaaattcttatcataaaggatggtagcccactgatttttaatttcactgataagtgagcaggaaggaataggtaagagatgaagatgaatgatttaggtcatacttcaataaaatatttttactgtttatttcctgtatcacaggtttttcaaagtagagcatttcttatctggctggtatgatttaggcattattttatcactagaaaagccataacgatgaagggatggtatgttcaaagcagaggattaatatttactacatatctactatgagtaagttactatgcttttttacatatacttttttacatatcatttaatcaacagtcttgtgaattaggctattctgacagatgagaaaactgaaaatcaaagacactaagtagcttggtaagtgttacataaccatgatatgtcagagccattaaatcgaggtgtgcctaactctaaattccatactctttatattacactatgatgtctaataaataatttggttgaaagagtcatttttattcaagataggagagtagactcattgatttctgttagtcttttctatgaatctgttatcggaaatagttgactacaattaaaataattcctggcactataacactactagacatcttcatgtcatgtagccaacatctttttttcctttgcaccatataatctgttttctctatgggtaaaaatcacattttaatgatggggtggaacttcctttattccaaaactcatttgtagtcggggttgggcacatatctaggtctgataaatcagaatagcctattcttctgtccacagctatttatttttaatgttttcaagctgattttacctttctgctagagtcatcagggaagatactctctttccactggggttgttaaacaagtagaatgcaaggctagactactagcaggcatccttctcattaattagcgagagaagagcttgtctgaactatggagggaaaaatagagaatcaatatctaacggtattctttaagaccctgaatccagccacacttgaaccatttttctaaaggaatgtgaattcatagtgtttttcttttatcttgggtctatgttatttgattttaaaatatattaaaatctagcaatgttattttatatgtggctgatacattatatatccatagtcaaggagatagcactaatcacataccatgacaatagacacaagtctgatctaaactctgtatagatattggcactgcccttgttttccagattatctctggagtgctctgagggatcagttggttggccaacaaataccatttgtgcctcaggctctttgtaaaacctaggggaatgtctgaatttcccttgattgagacatctcccttccctgtcaagtcctgaaggagctgtaaactcaaggaataatgccaaaggagaaattagtgtctgccttattatcaattgtacttttgttcataactcgcaataatttggttgctgcatagggcttagcctcaaatctaagcagactttctctgcctcataaatcaaatcttaactctaggcagtggtaaaaccacagtgcccagtaatggttagtaaagaatacaagagagtgtaggccgggtgcggtggctcacgcctgtaatcccagcactttgggaggccaaggcgggcggatcacggggtcaggagattgagaccatcctggctaacacggtgaaaccccgtctctactacaaatacaaaaaaaaaaaaaaaaaaaaaaaattagctgggcgttgtggcaggtgcctatagtcccagctacttgggaggctgaggcaggagaatggtatgaacccaggaggcggagcttgcagtgagctgagatcgcgtcactgcactccagcctgggtgacagagcaagactctgtctcaaaaaaaaaaaaaaaaaaaaaaaaaaaaagaatacaagagagtgtgacccatagttcagactactcaagtctatgtgggtctgcttcctgaacagctggtaaacagtggagaaagccatactcaaatgaatttcctttcaatttcagtgcgtcctttcactacaaaacagcccaatcaatgtcctgggttctgttcactcagactgagaaaaagaagtaaatcatccatagattttggcattttgttattatcacaaagtatgctagacatacacctcataagtgattttgacaaaaagatgtgctgcaagcacagtgcttgaggggtggtcacgattatggatatcactgtactaatctcagaaatcttagtgtatgtttttttttgtctttactggatagtttcgtatttctacctgcatgtggagttctgtcagggccacattcttccgggatatataaacgtggagaaaagtccttacactgtggtacagtgatccgctggaggaaagtgctatatctgtgcattttgcaagaagtcattctatagcatgtgtatgtctattaacacaatcactgaaccagagccaaggttccaaagggactatctgagatcatctttctaacccagtgattctcgagctcaggtgcatggcagaatgcctggagggtttattaaaaacactgattcctaagctccacctaagaccgattgaatcaggttcttttagtgtagggtgcaggaatttttttttataacaacttccccaggcgatttttctgccagtctatagaatggcctttggggatctctttatcttttaccttcaagttaaaacacatcactctgaaacttcatgagccagatacgaatctaacctatattcaaagaggtttagaaaaagataccttcaacctctctcagcacaatttttttttctattaagctcccttttcaaaatacttgaactccacctggacctaggcaaaatgttttaaaatggcatcagagtgaatcaaatcacattaacctgagatggtgggcaaggatcatgaaaaaggacagagggaagcctgaatgtgagtttgcctgaagaggaaatgatgattccaataagtgccttttctttccgtttgcattctgtgcgtagctaatccgctcggcataatcctcttaacggcatgtgttccatcagtattttatctgatctacttctctgacaatcctatgtttgctagtttccttgtatttttgagaagctctagatgttacatggaaaattcaaccttgtttctctgttttcatacaaagtggggttcttggaattcttagaaaatggggaggaccctttgcacaggctgaagttgtgtgagaagtctggacagagtttccagctttcaaaatttagtaggggaaaactaaatagaggctttctcccttgtctcaaaactggattttaatttgcacactgctggtatgggtcaggggactgttgtgctgaatcagaggatgtaggatacagggaatcatgaaaataagcattggcccccatgcctaggtgatgagaacatttgtcagtagatgttaaggttcctttataagcttgactattgcttttatttgcataaccaaggaaattagaataagattggggcatccttcatttaccatagataaagacagggattctcttactgtagacccagccctatctgtgcactgcctcctatggggaataatctgagggctaaaatgcatgaccacttgccatggtactaaagtccctcagctggacttcatgccataatcacttcatcccattgggaattcagatccctctaaattaaaatacccctgagatgggtgtaaccttaatccctttatcagcttactctgtaattatcaattaatactttaggagagattaactggcaaaaaatggaaatcaagatggcatttctcctggttttgctcctcctcgttttgttctcctggttttgctcctcattagcagtgtgaccttaattttttaatttctctaggtcctgggttcttcatgtatgcagtgaaggaactaggtgatagaatctttgacctctcttctggttctgttttagtgacagaattcactaaattcacatttctggattcctgactgaaaggggattcataagagccttgcttacttcatggctttcctcattgtgtccatggaactcaggccacatgattgtgggtctagtgaaacaaagagagtgtggccagagaatgaaagccataggaaacctagatagccgcataattacttagttgaaagccttgaacagctgaattccagagatgagtttgcaaaagaggagtatcatatgggatgtcacacttcaacagcagaaaaataggctgatacgatcagaaaggatgccaggccattgtggacatctgccgtgcagaatgacatcaagtggctgtctgaacatagtctgaaatctctctctcttgactttgaagagacccctgggcctcaaacttcaaatctgcaaagatagcactatagccagcaggcctggctttctcatgtcaacatgatgcaaacgtttctgtggatacgggatttggagtcaggaaaactatattccagtgtgacatctagccaaaaacaaagaaaactaacaatgttattgttaactttgagctttcctctactttaagcactgggctaaatgtttcatgtactttctttcattcaaatggtgaccttaggttcttctgtgagtcttcatttctttttcagtaaaaatggagcatatctgctttatctgataatagtaactaacaattaactgaatgcttacttgtgcaccgtgcactagggtaagcactttcgtgcattattatctttgtacaataatcctaagaggtaggtagggatgatgactatttatagacaggaaagctgagttggactaagtgaaataaacagcgatgaataaagtctgtggaagaaaggggattcatattttctatgcttcctgatatccaagtcacccagaaatacaccaaagaagctttcagttttcacacctggctgtatgaatttattccatctcagtgagggccaaatggaagactatttgtacagggctgtgtggattaagggagtgaagtggcaatgagaaacagaattcaagtaatctagagctggatagaaactacttatttaagagagcacttggattccagagtttgagtaaaggctttattgactaacttcctaaagtcaccaagaatatcaataaactaaatttacccctttatttatccttacacctttgtattagtccattctcacactgctacaaataaatacctgagactgagtaatttataaagaaaggaggtttaattggctcatggtactgcaggctgtacaggaagcacagcagcatcttctctgcttctggggaggccttaagaaacttgtaatcatggcagaacgaaagggggaagcaggcacatcttacatggctggagcaggaggaagagatgaagtgggaaggtgatacacacttttaaacaaccagatcttgtaagagctcacttgctacacagtaccaaggaggatggtgttaaaccattcatgagaactccactcccatgatccaaccacctcccaccaggacccacctccagcactggggattacaattgagcttgagatttgggtggggacacagatccaaaccatgtcagccttcttttctgtgttatttttatgtccagccttactgaactttctaagctccaattttttatgatctgaaaaatggggctagtaatagctttaactggctagtggtggtgagtgggaggcaaataggagaattaaataatatagcagacattaaaatattttgtcaatgataaactaatatggatagctattaggcctaatagtgactgtgttgattgctgatttattatttgtcactgatgacaggacaatatctctcttattgagaagaaatgccttccttattttcttcttaaaaagattatcatttgcttattttcttcctcctctgtgaagtaaaactttatcaagaagaattaaacatttaaaaaagatgtgcagtaattggtagggaaggataacgagaagaaaagcagacaactgtctgctgcttagcatatccatgagtgtgttaatttaattagaactgccctgtataaatattaaactcaattcacttttgttatgatcctttgcttttcaaagtattcccagttacagattatctttttcaaattcttctgtgagtttgagggagttaatggaagtaaaacaacccaaattggaatgaactgagagaggttttcatcttatcacactttgcttctttctgttattttcctttgcctagttcctggcccagcggcaaaggaggtgattgattttcagtggttttgcctttcaagatgttggcaatgcaacaacttcccttcagtggaattcccattttgtgtagtattttggggtggaggattgaattgctttacatctccacactcctgattaaatgtgaacccccacctgacgtttccaggtcagtagccaggatgtgggatgtagtgcgggatggttgttttatttgattttccccacaactgtgtgagggcaggatatcattgtccccattttacagttaagagtagagtcagtaaatcacagagccaagcatgtataatttctaacagaaattatgggtttagtacctagattgagattttgatagattcaggataaaggtagtgaaaaaattgcccatggaattggtttgaactgaattcatgagaattatagacttccataggcagaagggatcacttttagagtcttttttcagaatgaggtgagtgaggcagagtcgtgcaagtacagatttggggtcctatctttatttaaatttttgatactttgtttagcatggatatttccattcatttttgtgttttaaatgttgcattaaaaattctgtatctagattaccaattcttttggtacccccttaaattttctgcctgatgcaagtgaggcacttccctcaccctattcccagccctgtatagcaggcacaatgctaggttgtttaccagtcatagccccttatttttcacatgaagaaactggggcctaagatcacaaagccagcaccaataacacatggctcttgactcacagtatcgttctcttcttgctagtggagctaaaataataggagagacaaacgtcaggagattgtaacctcataatagagcctgactaaatgtgccagggaaaaaagtgtagcgtccttaaactgtacaagtcagtttagcaccaaatctttcactcacccagcaagtagaaatagctgcaagttgcagcaggtggaatttagattcggttcaaagaagaattacttgacaatgtgggaagtgaggtgctacattgtttcctagataatggcataaaataagagtgggaaattcaaatcccctgagttgggtgtaaatggtggcaactgtgacaaactggagagagagatcatagtagaaactaagttctatacttaacttgattactagagaagcaatgtcttttctttctttctgggtctcggacacccttttgatttcaggtcaaaatcattttcttgaagtaacgtgaaccccaatatggcatcatcctcttctacctatccatagaacctccttgattctacttctttgttttgtctttgcagctttagtcaacagaggctgttcccacagttcctcatccttccctcagttatctatttctgtagctctgggtcctgaattacagcattttctaaccctttgatttggctctcttctgctctgaaaagcattggctctttcacagttactgtacagtatccccactgtggcattttctgactcccatgctgggccatctcatcccccatcaacaaatcaccttgctaccacatggccttttggtaactgacttttatgtagaataacatacatgtagaatgtgtgagagaacaatgcaggcaggagcctggctttgctctgcactgaatatttagcactagcatagttctctgctgtacaaataggaagtcaataatacttgttgaattaataaatatttatacagtgcaatttaattaattccaagtttggcatcttctaaaattcacataggaattttcaatgtggccaaaagccccacatttcatagcaaaatcatgacttggctaatcagagagataaaagaaagaaagaaagaaaaagctctgccctttgcatgtggcctgataaacaattatgccctccagacaccagggctgtgaattccgcctttttaaacaggcccagagtcagcttatttggagattttcagcaccgtggacagaggcaccaggttactttttatctgtcactccctgaacagcaggatgaagaactactcagtttgggacagggctctcagccactgtggtgaaaatcaccccctttagcagaaggaaatttacttagaccctttttatttcccctttcccttggaaaaattgcattttcagttgtcaaggcacttaggcttctacaagttatttttcaggtgcctggaggatggaaaagggttgccctggaaattgatatcttcttctgagtttggcttaacaggggaaccaccagtgcccttgcggatggctgaggtgtcttttatgctaggtatggctctcttccagataaccaagtgtagacaggagtaggcccagttgttcatggagcattggttttaggacttgacctaaaagctgggtcatactattgccagggcaagaattacaaaagcaggtaaactctgccaagatttttctagtggaacatacacattcatggggatgaatccttcccaaactttcaggttttactgtatttggctgtaaaattcaaaagccagattgactaattctcagtgcctgttaaattcttttaggagcaaagtgatacattgtccccacccctgcctttcctaagaactcattttttcccctactcattagctgtattcaaatgcagagctttgctgatgaacagcaaagtggcttcttgactattgggtctctcactttgtcttctcctggactctgtaagtagccctactttcatttattttctaatctttgatgcctttccttcattttcttgaagcacctttacttttcatagtctgtctctttctttttgccccttttatggccattacacacaaatctgagctggccctcttctcatggcaatagacatcctgggctactttcatgaggaagcttaggacaggagctgatggagattagccaaaatgtcagagttagcctaccctttgacctgggcctggaggtgaggttttcttcttacacttactttggaatgagaaatgagagagtgaagttttcttcctacacttacttcatgtcaatcttctcagtgtctaattgctatgatcagaaattcagagttatcccaggctgggtatttgcataccacaatgagaattgctacaactaatgttgcttgatggaagggcaggagctgaaattttacctgagccaccaattttctcaaaaccttggcctgagagagaattcaagttttacccagaagtatctacattttgttttttacaaaagggctcatgatagagctcagttaccttctgctatccatctgtgccaatctgaactgaatcagagtatcatttccttttttttgcatgtgctggtgtctcctgtgttggccttttagagtctgacacggtatttgggaccctccatgagattggaaggagttccattaagtgatagataaagatgtagccagtagaggccaaaggtactcaaatactttttatttaaccttcttactttttgtccttagggaaactgtagacactttgagactgtttattttatgcttcttttctaggaggtaaagcttttgggggaaggttttatgctttcagaattttcagttaacatttctgctttgtgatggtctcccaatcccatctccttcaatgacagctccaaaatatcaccagttttttatttttcttattcaaccctaagttttattggagaaccttattcctgcttcatggagaaaactggctaggcgtggtggctcatgcctgtaatcccagcactttgagaggccgaggtaggtggatcacctgaggttggaagttcaagactagcctgaccaacatggagaaaccccatctttactaaaaatacaaaaaaaaaaaaaaaatagccaagtgcgcgcgtggtggcacatgcctgtaatcccagctactcgggaggctgaggcaggagaatcacttgaacccaggaggcggaagttctggtgagccaagatcgcgccattgcactccagcctgggcaataagagcgaaactccatctcaaaagaaaaaaaaaaagaaaagaaaagaaaagaaaaagaaaattgatgatattttgtgtgtgtgtgtgtgtgtgtgtgtgtgtgtgtgtgtgtgtgttttagttctccagcccccttagaaagattctttcttccacaccaattctcatttccttttcttcaggtttagagatgacttctctcattcaagaccagttccttctctcctatctttcaggagatttctctataattcattctctctctccacactcaccccaccccactacatgatcttcaacctctccctctctcttctctacttgtcttcattctgtcagcttagaatcatctttcctgtgttcccacctagcaaatatcctttctttgacgccacatctctttagctcccatctttgtttatcttcgctttcttcttcttttttttttccttcgtatccaaatcatcattcattacacaactcattgaaatctgaattatctttcttttcatccaatgaatcatgcctaggtcaatgatttatttttccaccaaacttgctattcttcgagtatttaccatttctgcatgtgacaccactatctatctcagctagctgtctcagaaacgtcacatcttccacacccatcaagctctaattactttcttcctcaacagctctcaatttcctgtcctctctatttctgctaccactgcctatattctgagctttgttgtttcttactatgccactacatcagtctcccaactgatatctctctctctctccctccagccttttttttttttttttttgagatggagtcttgctctgtcgcccagggtggagtgcagtggtgcgatcttggctcactgcaacttctgcctccaggtgattctcctgcctcagcctcccaagtagctgggactacagccaccacgcccggctaatttttgtatttttagtagagacagggtttcgccacattggtcaggctggtctcaaactcctgacctcaggtgatccgcccgcctcagcctcccaacctccagctctcttctagttgtttatcctcctgtatcactagtgtacaccctcactcatattcactgtgtaaaatgcaaagctgacctgattaaaatctgtgttaccttcctatttcctgtggggtaatagtccaatcttctgtataaggctgtccacgatccatctcctgccatttttcctgctttttgttccaaccatcatttaccttgctgttcaccctccacaacacccacagttgctagtggttccctgtatttgatacgctgtttctcatgtttgcggtttgtgggagccttcccctttgccaatattggcatttgcctattttcttagttaactcgtggtcatctgttgaaaatcagctcgatatcatctctccaggaagccctccccgcatttctgcactcactttctccatccgttaccaaggttgaagcaccttcctttctgttggtataaagtaccatgcatatggccactatggccattgcactcatggtactgagttacctgtttttgtattttttttcctcaatgtgcctccatactcagtacatcatttttttctatagtactgggcaaggttcttgacacacatgagctgcttaattaagtttaatgtatttatgacaaatttagagcaggtttgaagaaattcaggcttttccccattaagtaatggtgcaccccattaagtaatggtgcactttgggagaaatgggctgaaaaagttttaacgatagcttttgcagcctatttgccccaattgtgtaaatactaatttaaaaccaaatgacttctagaaagtctgtagtcagtcttcaccattgggagataatgaggcaacatggattttgctgcctctctcttaaataacatgaatctactgtggagacttttaagcctatgatgatattttatatcaaaactgagataaataaaaaatgttcactgacaataatgactatagataaatgctgtcagttgtaaggaagtgtcaatcacagacagacgtcagtggatctgtgagggccacactgaatttttgcatgtgtaaactgtataaaataagattttaaagaatgtcataatcatattcagaaagtggaatgagtgtgcatctgaatggctgcccaatctataacgaatattctatctacagggcaataagcagaaaaggtgatgcagagcagccagccagatactatcatcctcatttctttaacatgtatttctagatccttttttgctcagaacattgttatggcattcctcagaacgcttttagtctctctctttctcttttatacttaaaattctaaaccagattctggtgtagagttctgagattatcactgtgccacagtgccattcaacattcctgggattacatttttctttacaaaaggtagcactttggtattcccctaggaccctcagattctccttttttcttttcattgctgcttaccagaaacaggtgctcctcaacctgtatttgtgcagtattttttgcaataggcaattatatgtacttttagtgataatagttgtttgtacattaacaatagtttcacttttaaaattggtgtattttccccttccgcatatgtgtatgtacacaaaggaatacaaacaaggacagacctgattgttcctttgttataagtaaagaccatctaattataataaagcacaattaataattgtgtgtaatgagcaaattagagcaataatacaagaaaatgagaggcaattccttgaaatgtttctgtcttatcttttaattgaaaaaaaaaaaaaagccttccatttccctcaggtagagtgaaactgacaactgagctgccctgcttctgccaaatatgaagatatctaagactctgcttctctgtttactgggcaaagtcctggagggagagtggggaggggaaaggaagaagtctgttgaacttggggcttagtttcactctggattatgtggcaaattgattttgataacaggcacctccccattcatacctatgttattcttaggattatgcagtaaaatagtttaatagtaaaaggatagaactttggtgttagaaagacctaatttctggtcctgactttgccactttactaatttgtggttttaagaagctacttaagtattccaagatgtagttataggtcacatggtttttgtgacacttaattggatagtgcttacttcaaggcctagcatgtagccagggctccatcaatattctctatgagagaaagaggaggaggaaaagactaaaaagtccgaaggatgatatgatgtagttgaaagaggatgcacttagacacttaaatcctgtattcgtttcttactgtctgtattgtgttgggtaaagcaacttgaactttcaaactcaccattttccaaatctattaaaaaatggataatcatgcttaatatagaacagttctgagaattaggtaagaaaatgtctatgtaagtgcctagtgccacatcttgccattagtaagaaccaagaaatgctatttgtggtgggatgccattgatgttgggtagagcttagctatgatttatgatactcccaagagactttttttttaatcgtgtgaagccatgtgttctattctgctcaacgttctcatcagactcatgattcctaattcttaaagcaaaaaatggggtctgagagtgtttcgtggcatgacagttgtggtcagaacccctcccatattcccttattctcaccaagtcaatgcaacttcgatcaggcatgcatttttctgcctgggggcttgctctttgctaatggatctgctttgtatcctgtgctatagaccagaagtgcagagaaattaatgtcctctttcctcagtgttcatcaaacaatggctggtgttgttttctactggctcctagaccttcctcagtgagctaaaattccattttccctagatagtagctggctcttgccccgtctgtaggtcacatccccgcatcacgttcctaataatctacctgcacttcactcttggtctgaaggtttgcttctgaggaaacccaaactaaggcatggggctactctagtaagccagcccagtgatgtttatggtgaattatcataagtagatctcgataccaggatttgtattatattgtacagaactggttataatagaactagctctagctggtctgaggcttaatatgtagattgaaataaacatgcctgagacctacagattatttttcttttttttttttattatactttaagttctagggtacatgtgcacaacgtgcagatttgatacataggtatacatgtgccatgttggtttgctgcacccatcaactcatcatttacattaggtatttctcttaatgctatccctcccccagccccccacccatgacaggccccagtgtgtgatgttccccggcctgtgtccaagtgaactcaatgttccattctcacctatgagtgagaacatgcagtgtttggttttctgtccttgtgacagtttgctgagaatgatggtttccagcttcatccatgttcctgcaaaggacatgaactcatccttttttatggctgcatagtattccatggtgtatatgtgccacattttcttaatccagtctatcattgatggacatttgggttggttccaagtctttgctattgtgagtagtaccaccataaacatacatgtgcatatgtctttatagtagcatgatttataatcctttgggtatatacccagttatgggattgctgggtccaatcataattctagttctagatccttgaggaattgccacactgtcttccacaatggttgaactaatttacactcccaccaacagtgtaaaagcattcctatttctccacatcctctccagcatcttttgtttcctgactttttaatgattgccattctaactggtgtgagatgctatctcattgtggttttgatttgcatttctctgatgactggtgatgatgagcatttttacatgtgtctattaattggctgcatagatgtcttcttttgagaagtgtctgttcatatctttgcccactttttggtggggttgtttgatttttcttgtgaatttgtttgagttctttgtagattctggatattaaccctttgtcagatgggtaggttgcaaaaattttctcccattctgtaggttgcttgttcactctgatagtagtttcttttgccatgcagaaactgtttggtttaattagatcccatttgcctattttggcttttgttgccattgctttttgtgttttagtcatgaagtccttgcccatgcctatgtactgaatggtattgcctagattttcttctagggtttttatggttttggatctaacatttaagtctttaatccatcttgaattaatttttgtataaggtataaggaagggatccagtttcagctttctacatatggctagccagttttcccagcaccatttattaaatagggaatcctttccccatttcttgtttttgtcaggtttgtcaaagatcagatggttgtagatgtgtagtgttatttctgaggcctctgttctgtttcattggtctgtatatctgttttggtaacagtaccatgctgttttggttactatagccttgtactatagtttgaagtcaggtagcatgatgcttccagctttgttctttttgcttaggattgacttggcaatgcgggctcttttttggttccatatgaactttaaagtagtttttttccaattctgtgaagaaagggtcattggtagcttaatggggatggcattgaatctataaattactttgggcagtatggccattttcacgatattgattcttcctatccatgagcatggaatgtacttccatttgtttgtatcctcttttatttcattgagcagtggtttgtagttctccttgaagaggtacttcacatcccttgtaagttggattcctaggtactttattctctttgtagcaattgtgaatgggagttcactcatgatttggctctcagtttgtctgttaatggtgtataggaatgcttgtgatttttgcacattgattttgtatcctgagactttgctgaagttgcttatcagcttaaggagattttgggctgagacgatggggttttctaaatatgcaatcatgtcatctgcaaatggagacaatttgacttcctcattgtgtaattgaatacagtttatttctttctcctgcctgattgccctggccagaacttccaacactatgttgaatgggagtggtgagagagggcatccctgtcttgtgccagttttcaaagggaatgcttccagtttttgcccattcagtatgatattggctgtgggtttgtcataaatagctcttattattttgagataagttccatcaatacctagtttattgagagtttttagcatgaaaggctgttgaattttgtggaaggccttttctgcatctattgagataatcatgtggtttttattgttggtgctgtttatgtgatggattacgtttattgatttgtgtatcttgaaccagtcttgcatcccagggatgaagctgacttgatcatggtggataagctttttgatgtgctgctggattcagttcgaaagtattttattgaggatttttgcattgatgttcatcagggatattggtctgaaattctgtttttttgttgtgtctctgccaggctttggtatcacgattatgttggcctcataaaatgagttagggagggttccctctttttctattgattggaatagttttagaaggaatgctagcagctcctctttgtacctctggtagaatttggcagtgaatccatctggtcctggactttttttggttggtaggttattaattattgcctcaatttcagagcctgttattggtctattcagagattcaccttcttcctggtttagtcttgggagggtatatgtgtccaggaatttatccatttcttctagattttctagttcatttgcatagaggtgtttatagtattctctgatggtagtttgtatttctgtgggatcaatggtgatatccccttttttttattgcatctatttgattcttctctcttttcttctttattagtcttgctagtgatctatcaattttgttgatcttttcaaaaaaccagcccctggattcattaattttttgaagggttttttgtgtctctttctctttcagttcttccctgatcttacttatctcttgccttctgctaacttttgaatttgtttgctcttgtttctgtcgttcttttaattgtaatgttagggtgtcgattatagatccttcctgctttctcttgtgggcatttagtgtaaatttccctgtacacactgttttaaatgtgtcccagagattctggtatgttgtgtctttgttatcattggtttcaaagaacatctttatttctgccttcattttgttatttacccagtagtcattcaggagcaagttgttcagtttccatgtagttgagtggttttgagtgagtttcttaatcctgagttctaatttgattgcactgtggtctcagagacagtttgttgtgatttctgttcttttacatttgctgaggagtgctttactcccaattatgtggtcaattttggaataagcgcgatgtggtgctgagaagaatgtatattctgttgatgtggggtggagagttctgtagatgtctattagttctgcttgttgcagagctgagttcaagtcctggatatccttgttaatcttctgtcttattgatttgtctaatattggcagtggggttttaaagtctcccattattattgtgtgggagtctaagtctctttgtaggtctcgaaggacttgccttatgaatctgggtgctcctgcattgggtgcatatatatttaggatagttagctcttcttgttgaattgatccctttaccattatataatggccttctttttctcttttgatctttgttggtttaaagtctgttttatcagagactaggattgcaacccctgctttttttttttttttttgctttccatttgcttggtagatcttcctccattcctctattttgagcctatatgcatctttgcacatgagatgggtctcctgaatacagcacactgatggatcttgactctttatccaatttgccagtctgtgtcttttaattgggggcatttagcccatttacatttaagggtaatattgttatgtgtgaatttgattctgtcattatgatattcactggttattttgcccattaattgatgcagtttcttcataccatcaatggtctttacaatttggcatgtttttgcagtggctggtaccagttgtctctttccatgtttagtgcttccttcaggagctcttgtaagacaggtctggtggtgacaaaatctctcagtgtttggttgtctgtaaaggattttatttctccttcacttatgaagcttagtttggctggatatgaaattctgggttgaaaattcttttattttagaatgttgaatattggcctccactctcttctggcttgtaatgtttctgctgagagatctgctgttactctcatgggcttccctttgtgggtaactcggcttttctctctggctacccttaacacttttcccttcatttcaaccttggtgaatctgacaattatgtgtctggggttgctcttcttgaggagtatctttgtgatgttgtctatatttcctgaatttgaatgttggcctgccttgctaggttggggaagttctggataatatcctgaagagtgttttccaacatggttccattctccccatcactttcagggaaaccaatcagacgtagatttggtcttttcacatactcccatatttctttgaggctttgttcatttctttttactcttttttccctaaccttgtcttcttgctttatttcattaatttgatcttcaatcactgataccctttcttccacttgattgaatcagctattgaaacttgtgtatgcatcatgaagttctcgtgccatgattttcagctccatcaggtcatttaaggtcttctctcactgtttgttctagttagccattcatgtaatattttttcaaggttcttagcttccttgcgatgggttctaacatcctcctttagcttggagacgtttgttattaccgaccttctgaagcctacttctgtcaactcgtcaaagtcattctccatccagctttgttccgttgttggtgaggagctgtgatcctttggaggagaagaggcactctgatttttagaattttcagctttcctgctctggtttctccccacctttgtgctttcatcccacctttggtctttgatgttggtgacctacagatggggttttggtgtagatgacctttctgttgatgttgatgctattcttttctgtttgttagttttccttctaacagtctggtccctcagctgcaggtctattggagtttgctggaggtccactcaagaccatgtttgcctgggtatcaccagcagaggctgcagaacagcaaatattgcagaacagcaaatattgcagaacagcaaatactgcaggaaagcaaatattgctgcctgattcttcctctggaagcttcgttccagaggggcagctgcctatatgaggtgtctgtcatcccctactgggaggtgtctcccagttaggctacacgggggtcagggaccaacttgaggaggcagtctgtccattctcagagcccaaacactgtgctgagagaaccactgctctcttcagagctgtcagacagggacgtttaagtctgcacaagttgtctgctgccttttcttcagctgtgccctgcccatagctgatgtggagtgtagaggtggagtctagaggcagtaggccttcttgagctgtggtgggctctgcccagtttgagcttccaggccactttgtttacctactcaagcctcagcaatggcagatgcccctcccccagccaggctgccaccttgcagttcaatctcagactgttgcgctagcagtgagcaaggctctgtgggtgtgtgacccatcgagccaggcacaggagagaatctccttgtctgccagttgctaagaccttgggaaaagtgcagtatttgggcgggagtgtcccgttttttccaggtagtctgtcatggcttcccttggctaggaaagggaaatcccctgaccccttgcacttcctgggtgaggcgatgccccaccctacttcagcttgccctccatgggctacacccactgtctaaccagtcccagtaagatgaaccaggtacctcagttggaaatgcagaaatcacccatcttctgcatcgatcacactgggagctgcagactggagctgttactatttggccatcttggaatacccactccagatttcttttcttaaaataatacctttctaaatacctgttggagtgcttgagttggtaggggctatgggaatgtcatctgactgattttgtcagaggactttgtggatttgagacagggtgggtaggagaggatcatcacattgattccagaactaaacttagggcttgaggtcactttaggtggggtagaagtggggatatctggcatactatgagatttagagggccactgtagcctcataggtactcagactttatagtgttggtttaattagggattttcttaagctggctgccctgattcaaggtgatggttatctgagcaccaggtaaggcctgggaagggtagaggcaatatggctagatgtccatttcctataatctctaaatttgtatgaattgatgcattcatgatctgagatcataaatgaagtccataaagtccataaacctcctgatattttatgtaaaacttaatgcatatgtacacttttctagagaggaagtcttgagcttttggattttaacaggtgtcctcaacatattgaaaactgcttcagcttgatgtccaatttcagtgctaacaattgttgcagaagtgtttttgagcactaatcatatcaattgcaataatggtgctccttggggtctcaggtgagctgagacttggagccttgggatccagaactcacccttaaataagcatagcatctctcttggtgggggtctgtggaggtacagggaggttggagagagttggcattacccaatttagtgaggttaagataaacactgcagagtaatccatggctgacctcagtgatgagttatccattttgcaatctggccttttattacattgctgttgactttgttgttgttgttattgttacatgtttgtttttctttggatatcaatgcttttatgggaattatttctcatttcgttaatcctagcctagtttccttcaaaagggtcttgagtgcaggtagcctcttcagggtagagtaaaacaacaaaaaagtcaaagccggaatcaagggtgtgttttctatcatacagaatattatgatggaccactgaggctcagtgccactagggactctcttgggaggtgcatagaatgaatattaaaactctctgcctgaaagatggaataaggcagaatgtatttactgttcccatttccccttggccaaggattacttcatggggcattaactgtcttacatttccaggtttactcagatgccctgcaggttcccacaggcttcctgcatgctgatagcagaggagccctggggcacaccatgagagatacatgatacagctcaggcaaatgctatcaagttataccaaaggcacctctttgcagcagctggcatgcaaaagtgaacagagaggatatgagggcacaagaggtgtctcatacaccttctccattctagcatctctcctcactgagaccatggtaatcttaacttgtaggcatgcagtgttaataaatgaagccaaagtgctggatttgatccctatgtaggtcacttagctgcccacagtgaaaagtagcaccatggacatcaaagtgaacaaacccctgcctgagtacttatttccatggatcaaaaggatggggaaatgctgatggagagttgaactttataatcgggaaaagtccattcaaatgggctattttattcaattcccaaatagccctagactttatataacttacatggtggaattcatgcttttactaacaagtaagttaaggctcatagaggctgcgtgacttgaccagggtcccatagttaatagactgaaatgtattccttcttacttcaaacttgttcacatcatccagctctctggcaacacattactggaaaagaaaaatagttcagagaaggatgtgctcatgaggactgcatagagttgcaatcttcttgggagggtacacatgcatgacctgccaaatctgaaatattaggaacttttgcttgcaacttgttccatctacagcatgggtagaggtggcaacagagaggtgactggggagaggtttgcccaagagacagcagggagattctgggaataaacaggagttgggttctcaatttggcaactaagcattcttttgttattgcactttctcaggctgcagcagagcctgattagctttaaaattcatttccattggtttcttctttcatgatagttttagatgttgttttattggcattcctatagatgtaatttaaccttggtagtactgatgaactggttgttctcttgtaaattttagaaggaaggtggacagtctgggagaaccagaactgacaggagcaatagggtgcattgctaactggcaccctgtgctctgaggtcaaaaggaaacataggaaggtggtttctgagggcaagacctaggctcctctctcaattctcttttgatttcaaattttgtttcttaatttactttaaacacacacacaaacaactttacataaatgtgtacatatgatttcagtacattttcctaagtgtattcttttctttccatttttgtttgatgtctcccctcttctcctttttgtccatgttggtcccctaactctactccaagatagttcatattaataacctagtataaatcctggcacatttttctctatacacatataatttatacatatagaaatgtatacaagtttttcaggtcattgttttataaaatgggatattatatacttattttgcatcttgattttctttttagaagaacactattgtgcatcatagaataaatacaaaaaagtttaaaacatatttaggtactttaaataataatgaagcaaacatttgtagtatgtctatctacccactgcattaaagaaatagggaattaccagtgccttagaacctgctgtgtgccactttgcaatctctttttcctctttccctcaggaactctactttctggaatcagtcctgtgtttctctttctatattttgcttctgttgctcaacattactttataaaaattttttcatatcaaaaggcagtgctctaattcactctttttaatgggtgcataatattccagtctgatgatatgttatatatgtggtattctccttcctgtaaattataattttatttccatcttacttttttctaccatgcacaatgttgcaataaatatcattgtgtatttgcactggtgcttttatatctggtgcagtccaggaatggggttgataaatagaagaggatatgtattttaaatatgaacaaatactgtcatatggcttttcaaaacattgtaacacttcacatactcaagcaatgtatgagcacacccttttcacacatccctgatagtgatacgaattattgcttttttaaattgtgccagctgagaagtgtaaagtgatatttcattgttattttaatttgcatttctcggactgttagtgaatctgagcatttttgcatttgtttgtaggccatttagctgagcacttctgtaaatgggctattcatgacttcttgtttctacaatggagatatttgtctttttcttgtctttccatagtaatatttgtttaccttgtttagggtatattttgccatcaaatatgttactttttaatgtagttagatgtctgtttttaactttcacatcttctaatttccagtcttcgtagagaatgttttccccgtccccacctttaaaaagtgtgtttagtttttaagattctttttaaatctttgttttcattttttatatttaaatcttaatccatttagaaatttatttttgtgtttatagatgctagaggtccatgtttactttgttcctgatgataatgataataacaatagctaacacttactgctgctatgtggtaagcattgttatataggcactttccacatattgcatcgctgacttggccttgtccctcacaactctgagacataggttttcttaccatatccattttacacttgaggaaaatgaggcacaaaaaaattgagtaattagcccaaaggtcacagaggaggtcaagtggtgaatgtgggatttgaactctgggaatctggcactgaaatccactcttattatagttcctcttatttgttaggccaggactatttatgaaaaaagccactcttttcccactgaattacattacttttcttgtcatttattaaattctcacatataccagagtttatttctcgattgtctgtctgctccctgatcttttcatctattcctagcattttttgttgagttgatgatcatggtcgtataatgtctgatatctatgaagtccagtcttctgtcattgctctttttttttcatttatttttttttgagacggagtctctctctgtcgcccagcctggatgcagtggcgagatctcagctcactgcaagctccccgtcctgggttcatgccattctcctgcctcagcctcccaagcagctgggattacaggcgcccgctaccacattttttttgtatttttagtagagatgggtttttaccattttagccaggatggtctctatctcctgacctcgtgatccaccctcctcggcctcccaatttccaggcattcatacttttatgtataatttatgtttattttattcaattaaagtagccgatgggatcctaattgaagttgtattaaatcaatatgttaattttgggacaattgccatgttcatactaattactccataaatttaaaatatagtatgtttcctcttcattcagaaattaatttatatcttttatatatttatattttctttgtgttgtcttttaaatttttgggggagatgtatttataaatattttaaagcttttgctgatataaatagaaatatttttctcatttctattccttagtgattgttactagagttgagaaaaggtactgattttgtatattttatatataaatcagtaggaagagcactgtcaatctaatatttttaattaattaaacaagaaaaatacattcatgtcattaagggctgaaacagcttttgataaacttcagcaggcattattaatacagttcaggtaaaattgaaataaaagatgattgcttagatatataaagattatttactaaaaacagcaacagatttaacaaacatggagatcattttagttaaaattagaatgcatttagggatgtcccttgttatctatattaaacattgcatttgctatagcctccaaggccataaaacagaaaagtaaaatagttggtgtaaatatcagaagaggtaaaactatctctttttgctgatactataattccttatcaagaaatttaaacaactctagttaaaaacttacagaatgaataagatactttgataagctatctggatataagtatataatatcaatcacttctttattctatcaataattaaccatttttagttctcaaggttcaaatttcagagaaggtggctttgagctataggttggatcatttcccatgacttggacagggagataaaagcttcttaggacggccccactagactctaccaagtggaacaaaggtgattgctcaaatttgagctgaaaggggaaatggatgatagacagaagttttttaaaaaataaactccacatactgtatgtaactgcacttcagaagtcaggtgcctagcttttaagaggataaatctaaattctttgcctgcttcttctagaatccttcccaaacccttttccgttgccccctccctttttacctgttctacactgcatcccaactggttgttacattgtcccctgcacacgttttgcacattcctctgttgtttgcccatccattcccctcactagacgtattctattcctttttctttcatgtaattctgattcgccctgtagggctctctgcacgttcccatcaaatgcttgttccattacccaagaccaggtcccttctcccaaaccacaggggctctaggagcccactctaccaaagacctgaagaacctccagctgtcacagtctcttcactcctaggactgaaggacctgttctcttctccgcatctgttcctgcatccctgtgacatctgccccaacgaaatcagaagaggagaagggaccaggactctcacttcccagactatacattgttcagcttcctctttccccctttctgacatggaaatagcgagcgaagatttgagggccagttttttcatgttgttgttttgggatgttttttggtgtgctgtcatagattttattttttcatttagagaagccaggtccaacctaaacagtttcatactcttaccaagaggatgctttgtccttcactgtttcaagtttgtacaggattcaggaccatgttttgcacctagtaaatgagtcttcgtttatccaaactattttgagttctcacctttatgcctttgctgttgctatgtcatttctcctgaaggcccttctccttctctttgttcacttgattactcttagtttttacatttcagctcaggtgtcaactgctccaagaagcctttctcgagctcatgctccccttcaccaaactgccacaacaacctgtgtgaatcttgatcaccaagcttacagtgctgtttgagataattatctgctcaagtttctggtgttcccattagactgtcagtgcctcatcgatgtgctcagcctctagctgtgaatggtgcacaggtgaccccagtggatattttttgaataaaaaaataaatgtatggatgaactgagcaatgttttgttaccatggatgttggtcatatcatttcatgatttgctatctaattttgccatttctcctctaattccattaccctcccagctcttgtttctctacgtgagcatgttgtgtgaatgctgagtgaacttttagtttactatgcattcatagtgcattcattccagtattcatttcttccttgggtcctggcctactccttccttttctctcatctattcattctaatctcatttgaacatcaagctcctcccactgtcgatactttatcatcattactatcccttttagtaacttagtaaaaaagcacctctaggatctttcaacttactaaagacttttcctagaggaggagacaaatctgattctgcaaactttttttttttttttttttttgagacaggatctcactttgtcacccaggttggagtgcagtagtgcgatcacagcacactgcagcctcaacctccccaggctcaagtgatcctcccacctcagcctcctgagtagctggaacgacagtcatgtgccaccacgcctggctaaattttgtaatttttgtagcgacagggattcagcatatttcccaggctggaattcctggacttaagtgatccacgtgcttctgcctcccacagtgctgggatgatatgctgcaagccactatgcctggctggctctgcaaacttttacttctatgaccctttctttctcttggtttctccttgacacttctccccaatgaacccatggtgcaatatgggagttggtgccctaaaagtgactacctcctaaaatcactcacactcaattattagtaaagttcaaatgacaacttttttatgataattgtgttttaaaagaaaatctgagggatagtaaaaacaaaaaaaaaattcatgccagaatttcaggcaagcaccagttgagaatgtatttttgtgtgagcagggtgttatcagtaaggttcaacatgttctacataagggactggaagctctgcccgggatgtatgagggcaatcttgcctggcctaaaggttggactgtaggtagcacaggacttccgggtttggagatttagaggataagtctaggcttcacccaaataccaacaataagaacttgagtagttcctgggacctccctgagcctaagtataaaatgaggacagcaacacatatctatactgccatgctgttataagaaataaatgagataagaaatataaagccttaggagtcaatacagtgcaatggtggagcatgagtattgcagagtccgattggttgggttcaaactctggacctgacactaattaagggttaatgaccttgtgtaagcttttaatctctgtgtgcctcaatctctctatccatatgataagggatacaagacctttctcatacagtggtttaaagatgagagtaaataatatatgtgagaacacaaatagaagagcatgcatatgaatagcatttaatgctcagttaatgaggctcttatcaaagtgacagagggcctccatgtaatcagagaagggtccacttaaggctctattggcatttgctgaaggatcaagacttgctgtattcctatctatgaatagacctatggaattaaaacccagtacaagcattttttttttctacttatatctatgtatgctctttctctcttgccttcttgataattcagaagcagaactttgtcttattactgacttccagaagaaatttcacaactctcataaagtttgtgatttttgtagactatactgaacatttagtgactcccagggaggatcattttaatcagcatacaatagtttgctcttcctcttcccttccattttcttctttccctttctccccccttctctagttttttaatctcacctcctctccctgcccttttctatcctcctcccctctcatttcccttcctttatttcttctctcatttctactctttccccctttctccttccttctttcctgccctcctcccctccctcctcacctcctcccctttctccttttcccatccctccttccctccttccacttctctctcctctttcatctccctttctatcctccctcttctctcccttccccactctacttccccccattcctccctggagttctccctttttacttttcttcaagtgggcttatcaaagtattttttttaaataaaataaaggcaagtctttctgtaagaaaaaaagtcagaaaaacattttcttctcattataggaccaaaagtgcccttagagatcaagtagcccagtgatccccagactttgcttgttggtcgcgataccctgggcagcatttgaaagccaggccctgcctccagtggtggttctgaatcaaaagatcagtgtagaggcttggagtggcatttgtgtggggtgtgccagaatatatttattttaattcaagaagatttggatttcagtcctaagtctgtcacttgctaatggaaccatcttggctgtgtgctattaaaacttccagagcctcagtaacatttgtaagaatgtggaaaataatatcttcctcaaataacaagcagtgatcagcagattggctggcacatagtaggtgttaaaaattgtttcttttcttccttccttttgagtatggtacagaatcctggttatctctctcaacacacaggatggtgataaaggaaagcctgagtatttctgtgccttgtagcacatcttagaaagggagaagggctattcagcagcattgttcatgctcaggcccaggcccagctgcctctaactgtggtcatgagaagtctcagacactggcatgaagtcagcaaataaaaataaacaacatagccaagtatgatggtgcacgcctgtagccccagctactcaggaggctgaagcaggaggattgctggagcccaggagtttgaggctgcagtgacctgtgatcacaccagtgcactccagtatgggcaacagggaaaaatctctgtctccaataaataaataaataaataagtagtaattagaaataaataaacaacatttttgaggagaagggatgaagttgattaatgggtacaaatacaccgtttgatggaataagacctagtgttagatcagtaaggtgactatagcctataataatctattgtacccttcaaaatagctagaagagaataatttgaatgtttctagcattaagaaaatattaagataaacatttaagtgatggatatcctaagtatactgatttgacctttataaattatatcaatgtattaaattatcacatatatcttgaaactatgtacatctattatacatcaataaaaaataatttaaaaccccatttattgtgaattcactttcccaggactattttaattaatcatcataacaaccttatgaagtaaatgctatgattatctttaaccacattgacttggtaaaatgtctgtaggcagagcttttttatttttttgaattttggctactatttgcatgtctgtatcatttacgccgtcctttgtctgtgtttcttagatcccaaataagtactgaggggtcctatattcatttcaaccatactgtattgagtacctaatataaaaaatccagcctctagtttgaggagctgaaagaatgaaccctatgcagtcctgattgtctgggcttattttcacttgctctgtgaagcacctgagcccttgttggtgaaccctgctacagtccccactgagtttaagacccactcttttcaagggtccccatgttaggtttgcctccacaccttagcttccaaagctttgttcccccctgccaatggggcactctagccccatccacccatcccctctcagagttgtagaaaaggcttctatcagcaagaatccagagaggttattcatacatgggacacttgatagtggttcttattctttgaggaggaggaatacttctgatttaatggtaacgaagttctaattttggtaagtccggggatctgaggctagagctgctttgtcacaagtcttgtttgcatatgctgtgtatttctacccataccctcatccaacttatctaaatcttgctcctttttttccattcttgctgatttaattttatccctcaactcatggttccaaataatcccctgtgttagttgtgcctacagcaacttgtttaactctctctaccaggcaataaggtggaggggcaggggaaggataaatgcagcctacttgtgatttatcacagttggaaagaaaagggaaaagacatgcataacactttttaaaaaagaaccagagaggcagagagagaagagtgtgtggagggagatgaagggtgcactctgatgggaacagatggcccaaaaggtaagtgggtggcagagagtaaaaataaccagggagtgaccaagccttcattttctttgaaacactcacactttagggatatattgaaactgctaattttgttggcactttgacacctcctcctaattaatgagaaatttattaggaggatgactgaggtgagcaagctgcttacaaagagagaagggagagaatacattgaacctattcagcttggcggtcacgaccaagcgaggtgccattggatatgtggttacttgtgggtgagctcaagtagaagcctcgggctgggctcctctcctggggtggaacccttctgctgggctcctttcctcctggctccctgtactcactgctgctctctggtttaccagcatagaggcacaaccccaaaacaggcttcgtggggaccaaattggcttttggatctcaagtgtgtctctgagtcactccagtgaacacgttataggtcactctgtgcaggttagtggcccgaaaatctgcccttcaaaggaaaagaaaagtgaaattctcatgacttttacactttttgtcaaatcttctgcatagagaccttctgagttggctctacctagtctgtgattccaaatctcaagcaccacctgcaattgtccatatttttcacccacaggatgctcatgttaccaggaacttaaaagagtaaacgtggttgctgacattttagcgttcgtgggccagttttctgagatcaacactaggcaaggtactggggagtgtcttctaacacttttcagactttgaacagctaactccattttctgggagagcagggttacttgacaggtatctaaatcctctgtcctagccatccaccaagccacccatttgcccttccaaatcccttatgcagttcattatctgtgcaacatagaacagtcgagagcatgggctctggaggcccattgggagcttattcactcctctgctctgccattcatcagcttgagttgtcttaggcaagtcacataccatcctctgtgtctctatttctccctctgtaaaatgagatcactaatggcattcactaacggatggttgtgagagttaatgaggtaacagttataaagaggttagtactgtgcttggtataaactaagcacaaaataaatagcactatgacatttaacactataacatttaactttcaaaatgatttcatatgcaattttgtggcagtgtcttcatacattgggtagtacagagttttaaagattatcctttaataaatggaaaaattgagtcatgtaatggattagagactttcccaaggtttacaactacagaggaatagaattggctctagagctaagtcttctcattctagtttaattgtttgtttatttgtttctatgcaaacatgttcatactcttccttagcatgtttcatcctatctctactagtgcaacaagatgctgagaagagggaagaatgccacaaaactgcatacaccaaagatgtgtggctcaaaggatacaacttttgacttgaacagtcaccaggccttgtgatcttgaacaaatcattctgcctgtctaaacattaattaattcctcaacttttaaatggaatatgatgactatttccctttatatgtgtatcttagatgtaggcatggagctaaaatagaaactcaaaatgaagtaacagtaagggctggcagtggaatattattgatcccagaggaaaataaaaattttatttccaacgttgtgccaagatggtggcaagggtggggaaaccatgtgtcctagaagaagaaaacagaagaggttaagttacctctttattcttttgtttttcagattcaaaggttgtctttttaacaaaatgaataatgcaggtggtgattatggaaagatgttaaattttgatgatgttgaaatgtgagattggtatcctgtgtgtgaggagctcttgtctcctttttcaaaggcaaggttcctatgtgtgcactttcacagaccagccctgcccctgttgcctggaatctcccttctagcacaggctgctgctgaagaggtggttcagaccattttccaaggcaaatccaaagaaaataatggtttccattggttctccttattcttcagccttcccagcttcccccacccctactccagtcttcatgacatcactaattcatacatctattatgcaactcatgccaagaggctggttaaattggaaattgctctttgttaaataatactggtatagatggcatttccattttaatccaaagctcttgagattccaaaatccttcaaaactcaactaaatttcaaaaggtgtaaatcaagcactgcattttactgactctaaaggaaacgtttatgtgagagtagacctccctggagcttcttaaactagccaatgttaatcttggtgctgagacatattgatggtatgtcatatgtaataggttaccaaataataatgcatatactaaaattatgctaaagatttactaaaaatttaaattaaggcagatcaggcttatggctaaaataacatcatttccatgcacctgcattctgacatgctctctggagattctttgctatgggagtgtgccttgtgtataaatagcatttatgatgttggttgcactagaaaaaggaaagttatcaactttaagctccactgaattaacaaatacctgatctccatttttgtagaccatcaagaaatagcattgtgatcattgggcttctccctagcagttgatggtaaaaaaaaaatacatctaggagacctctcctctcctctcttctcctctcctctcccctcttctcctctcctctcccctccccctcccccttcccctcctcctcccctgcctgtcccctccttctcccctccccctcccctcccctccctcccttcccttctcccttcccttctctcttctcttccctctctcctcccctccccttccctctcctcccctctccgctccctcttctcttttctgagaccgggacttgctctgccacccaggctgcagtgcatgatcatggctgaatgtagccttaacttcccaggctcaagaaatcttcccacctcagcttcctgagtagctaggaccacaggtgaaaatgatcacacctggctatatttttttctatttttttttttttgtagagatgcagtctccccatgttgctcaggctggtctcgaactcctggctcaagcaatcttcctgccttggcctctcaaagtactgggatcacaggttcaagccactgtgcctggctgagatctctatctttaatattcctcttccctcctgcttaattgaatgaggaaggggcagtgtcatacaatggaaggagcatagtaactctaacattaataggttgtgtggccttgaacaattcactcaactgctctgaactttagtgtgtcatccataaaatggagctaacagtgactagtttgttttgagaatgagaaccaagatgcgtaaagttcctgacacaaagccaggtgcctagtggcctttagttcttatgacagctgcaggactacctttgtcactgtgcttttacgtctcctccagtgcctggtaagaagagtttatgtatatttcacctgtgtgagtacaaggcccaacttctaactgttaataagagacaactttgcctccctcacagctggtacttaaagcgtcaaagaatatctacactccagatacttgttaagataattcagtcagaatcgactgcaatctagcacctgccagaggcttgctgaaggcatctgttacttatttattgagcacatgattatataactcttgtttactgtacacccagcactgttctaggagtcttaagaatattaacttatttaattctcacaacaaacctgtgatataggtactatcatccccattttacagttgagagaactgaggcacagagagggtaagtaacttccccaagatgacagagctagtaagtggtagagcagcatttgaacctagatggtttggctccagagtttgggaccttcacaactatactatgtaagaaagactggctaatcgttatgttcaccagccattcttccagattcatccagttctttctctgagcttagtgaaattatcagaaaacaagagacccaaacatgtgacttcagcactcccttcccccttccaacagcttcatgaccatccttcagttcctgagtcacctttctagatggatattctgtgtcttcgacaaactcctggtaggaattgtcttccatgttatccaacagttctaacatgaaaacccatgtattaaagtatctaaacaaagtgtgtttctgcataggacctttccagctttatttgctatgaaatgaaaatgatgaagtctgttagttccctttctatgaatattttcattgctattactctggctaacttctgtgctcaggtgtagtctccagttctgcctagatagttgctgatatttactttctctacttcctttagggggcatcttttctgtttttatccctgatggttctgttttcttattgattaatctcatataatgcctctgaatctgttggatgcagggaaagtataaaccataatccaataagcagcttatgatgattttcttaccatgtaaaatgtttcaaggtgtgtggactaaagtagaaggagatgaaaaaaataatgataaattatatcatctattatggatagctaccatttgctcattgcttactttgtactggcactgtgctaagtgcattacctacattattgtttcttaatcctcatggacatggctaataaatgacagggctctaattcaaaaccaggtctttctgacatcaatgcctgtccttgtaaactacactgtatatgaatttggctcagacacatatctcacattttgccctagtgaaacaaagtgtattttctccttttgaccttgggtgaagagagttgaatacaagtctttccatttgtaacacactgtcatcagtagcacaaggcctccctggttttatttatttttcccttcatccctaattatatcttcaatggcctttccctagagatacccattacaatagcttttatatatatctttaaaaatgcatatacccttgtaagatatgtaacatgcttttcttgttatttatttaaaatttattttactggcagcatgctgtatatcttaatgcatttttttaccttttccattcaacactgtttataagatctttcatgttgctatgttttcatttagttggttttctgtaactgctgcatagcatttctctgtatgcatccaccacatctttgcatctgttcctctagtgctaaaactctgcttcaattccacaattaccaatagtgtggtgtgtggccctgagcaaaaattgcttggggatatattcccaaaagtggtgttcctgagttatagggcaaataatgcttaatcacaccaaatactttcagattgctttccagaagggctgtaccagttcagattaccaccagccatgcacaagaaaaatttctaaactgtctctattcttgacaatacttggcattatcacctttgtactcattgccatttgacacgtataaaattgtatttcataagtaaagttcttctgcaagtttggaaaaagttgatttggacttgaacatgccactaaggctgcttaaaatgtcttagatgggatgctgattgagtgaatgcagaggcagaggaggagcaggctctcatttgagccctccttgcaattggtttatgtgtctcttatgacaactaacattgttttgcaatatgcagtgattatttgtgtacttgtctgcagcgagcaccttttggattgtaaattgcatctttcttccttacctgtgtatgccctcaatgctttgcttgttgcaagactccagtaagtgttttctgaaataaattgtctgatctctcgaaggtcctgcctgacaataaggggccattggctatgaaagggtggtaggatctaggagtggaaagtcacagatgattattttctattctaatagggtgatcggtttatttttttcttttcttgactgttttcctccctactttaaccagaggtgcttgcattaggatagatgaactatatgaaactgctctggtaaaaccaaacttttgaacatactggatttttccccctaaattgacaactaaaaatcatgccatgctattgactcattgtcctcttcagtaatcttctggttgggattgggaagggaaatttccagaactacaaacacttctcttagggactcaggtcccaaccttgctgggcagagtgcatgatgtgtttcataatgcatgagtgtttatttaacaaacagcaacactttttaattaaactgttgttgaagatacagactgtataacctttctccaaggcctggatgctcactggcccttccaagatgctgacccctcgctagctgcaggcctctggggcagtacatgctgtgagagttattacaagccagctggattagagggccacctctcttgaatcattcagaagctgaagtgcaggctctgggatggagagtttctcaatatgccaaagctattggaatgcaggcaggtctggagacacttagctggaacctgggggaaaagagtgttcaagataacttcatagaggaaattccctaccgcttttggctttaaaggataatcattggttcttgctggtcttgtactactatttcctgagctactctgaaatagaattgcttttaggtttcaggtcttcatttatagagctatatccctaaaagattagatacgtctcagggatgtttttcaggatgctttttcgcatcatggtgattgtattagtcaggttagacttgattatgctgcagtaatacattacttcccaaattttagtgacttagaacagcatagctttacttcttattcatattacatgtttaacactgggtaacagtggggctatgcttatcttggacgttcagggacctatacgctcagaagcttggctgctttttgatgtgaccatctcgacatgagtctttagggttttctacagcagagaaagaacaagaaataaattgtctcttaaatgttcttaccattttcattggccaaagcaggtcacatgatcatgcttacctataactttgtagagaactgtaatttttctgtcttctcagagagaaaagaggactggaaatgacagagaatatgaataacatataccacagtttcattgggcatgagaaaatggtgatactttgatagatctcagaaaattacatacactcagcaccatatacatgcccttgaagagaagagaccatagactcttaaaaatgtaagtatctcagaggagattttggccagtgaatccaaattatacagcttggaagtctacaggtttatgccataggggacacagaggggaaaatgaggaactaagatgggaatcttgcccacacatctccttcaaacagggcagtataggaaagcatatacttccaaaatgatatgattttcagtcctactctacctcgaacactcttcctggaacatactccaatttgtcatcggctcctcttaaattcagcactcagtcatgaaaatgttctttcatacctggtctcatcagtgtagaggccagaagacctgttggttttccttgctttggatttgttattttggcaattaacgtttctgacaatcatactatacctttgactcattataagcctcatgtgggtttctctactccaaggaggcataggagtttaaaataggaaaacagtagtacgttgtgatggattgtatttttcaaagaaagtcacaataatatttcccatcccatgcactcttctgcaatgtatccttgacattctgtcatcaagattaagaggtagactctctctctaccctcttgaatgtggataggccctatgatggcttcgatcaataaaatatggtggtttaacgctgaggcaggtggggcacgatgtctcacgcctgtaatcccagcactttgggaggccgaggtgggtggatcatgaggtcaggagattgagaacatcctggccaacatgatgaaacccagtctttactaaaaatacaaaaattagtcaggtgtggtggcacacccctgtagtcccggctactcaggaggctgaggcagaggaatcgcttgaacccagaaggcggaggtttcagtgacccaagatcgcgccactgcactccagcctggtgacagagtgagacttatatctcaaaaaaaaaaaaaaaaaaaaaaaaagtgctgaggcagtgaggcagctctggaaatagcccttaactggcttggcagcttctgttttctgactcttagaagccagttgccatgtaagtaatgtgactaccaaaaaatgaccacactgtgagaagcccaagtgtggtggagaggccttggggaaagagataacccatgaggcaagaaagaggcccaggaggtcccaggcatgggaatgaagaaaccagcttgcacatcctgcccaggctacaatggactgtaaccacatgagaggttccaagattaaaccactcaattgaccccagccaactcatagcaccatgagaaataacattgttttaagccactatattttggaatagttttcttaaaaatataaagtgatagataaccataatagaaatttgtgctagaggaaaatccttaagactcttgaaagccattttgtctaacaaagagtgtaaataagatatggccttaacgatcctaagtaatttttctagttaagaaataactgtaatcagttgagtgtttttccactttatgtgacttcagttgaggctgcaatcatttggtgtctggatgagatgggacatccaaggtacctcattcacataaatagctggcagttgatgagataactcagccagagagaacctatgcatgatctctccatgtgaccaaggcttctcacaggatggcaactgggttccaagaagggctatctgaagaaaaactattcttagaaaaccaggcagaaaaaataaaatttcttatgacctagcttcaggagtcattcattgtcacttttgctatattttgttgatcaaaagcaaggcaaagggctctccaatattcatcgattaggggactacacaaagggaaatattaggagtcatggtttattggggggctatctttggagacaagctaccttgatggatagagaaatgataacggaaataggtttgatgaaaaacgtggttaatctgaattgcagtaggtctgatggttggttggcaagttgtccttattctggtgtatgggtgaagggaataagcagtgagttagctcttacctagatccatcccctagaaagtaactgtgtccagttatcaatgggcagggcttgctgggcgttaagcacaggtaacctctagtcttttactatgtttctgcgacagtggcataaaacagctttttaatgagacctactgagatgcactgacagatctcttcctttccttttgtgtctagcccatccaccttcatgtaaatgatttatcaagaaataagacctaggattttgagatgggtacataagagcaaaagagaactaggatgagatcattctcttttgcctgcccttcagcattctcaatgcaagcaggttggggttctaaaggaagagcagggatgactggaaccctatagcagtgagtctgaggaatgggatcatgggggacccagaaggaggaagcagaactggaagatgtttccattctgtgaaagtggcttttggctttgaggcagcaacagtaatatttcatgtcttccgtggtgtctcctacctttaaatgtcagtctctgcagctgccttatctcctgtagcacatttcaattaggtattccaaattatactcttttcttccaggacaaatatgccagaggtgatatttactgttacagcagcatttaaaatacttagggggaaaaaatcctagtgaatagcaatttctcccttataataataataaagcacaataataatggagagaggaggtgaattctggctttgatgccaataactggctgacttaaagtgaacatcttttgtctccgccctcttttgtccccctcctcctattcccgcctcagtgtgaaggttatagtgtttggctctgtcaagagcaacctcacacatcttcttcactggaggctcacaaatgctcctcagaatgtctatttaactatctctaggtaggactgggctctgactgggctcctacttcacccattacctgtttcttcctttgtcctgagaatgtttgcatgaagccagaatctctgtttgtttagaaatttaccaggcaccactgcttactcctcacctatgggacattgtaggtcctgatggaacaccccggcctcctctctaggaggtatatgggttagaaacttatgtattgtacctttccttcttggaatcaagtccttggcctggtaatgaaggtccttcgatctggtctgcattttccagctccatctcctactaatctttatatccttatctactgtttccctaggctgttgtcttcacggccgccatggtaggttttgcctatcatcccaaaccttgtgcaggcctaccacagtacttgacatatggtgggggtctcagtcagtattctcccctatatttagaacccttccactagatcttgtcttcatatttttgattcctgctcagggatcagattatgttccatgtcctccactgagccttttctgacctcctcagcgcactcagtgccgttccctctctgaatttctaaagtgctcagcagcagcagcactcatttggcacttggtatatactatcttatgctattttgtatgaccatatgttgtctatacaactacattataagcacctgatagggataactgtgccctgtgtgtttttcctatccctttgattctaagatagttccttgaacattgaagatgctcagttaatattcatttattaagtagatagatcaaggagtaaatgaaagcaaggatcctaagaagcctgccttttggtgccaatctattcaatttggaattcacaaacttacctaaaacaaggcctttcaatttcctgtttcccctgtaaacagagctctaccaccaggatttctcagaagctctttctccacactgaaccctaaaactgaaggttcaggtagagagcttttccagtgtgagagaatttttaaagcatctggggtttggcacatccagtgctttgaaaatcaaggtgtcttgatcattgggtgaaggggattagaacagcaggctgtgttttcaagttcaagtccataagcagacaggaatagaatcccacaagagtttgttctgtctctgccatttactagttaatctctctatgcctcaatttccccatttgtaaaatggatttaataatggctgtctaccttataaggttgctatgaggtgccagtgtgataataaacgtaaaagtactttgaatattgcaaaacactgtatgaatgtcaggaattaggcaggcaacaactatttcttgggggtttgttctgcatgtagccctgcactatgtgtagatagaggcctctgtacattacagaagactggcagaggcattggggattcatcatggctggaattctggttctcagatagatgaaagctggaaaaagtattatagcctagcaatcacatctgaaaggttggcagcaacaattgagtcagagaagacgggaggtgaagtattggcaaaaatttgaccctggtcattctttgaacacttcagatttccacagattctatccctttaacatttctgaacgttatgattttgcttcctccccacactggcagctctgcctcaatgaaaccgtgttgcttttttggttgatcaattgtgcccaacttcctgatcatacttgtcctgagagcctgtgttaagctcatgccggctctcccaccccgcccccaacgccggccaaaaaaaagactctctaaaaacaggtgcccccgatgatctcacactgctgctggcattggcagcagcccagaagggccaaatggtgacttcaggtccagggaggctactgtcctcagctctgttttcatgtaaatgtcgctcctgctgaaaggaagtggatgcaaaaaaatatctgctatggaagcagaactaccccagactaaaatgttggtttttttttttttctctcccccttttcttttccttcaagttttccatgtggcatcagcagctgagtaagggaaagctaagaggtttaagtgtgctggggctgggtgggctagattaataacccaaagccttccaagctggcggtgctgggtgagacaggccaaccagaaagcgttaggttatggggagccctggccacagagccagaccctaccagggtggaaggtgaaggagcagcgagctctgcgtgcttgccccgagcccccaccttccttccttcctcctccctctggtttctttcctcccattttatcgagtccctctgagatggctgcgcaccagtggctccagcctctgaccgttgctgccctctgctgggaagaaagctttactcggtgtggaaagtgctaagctctaccagggaccagcttaatgcagaccaagtccacagtctgtggctagtgtgtgatttggcccagaggaaggaaggacaattcagaaaacccttgcaccacagtgtttccctagtggtttcaggtgggggcaggactttggaatctattagggaaggattgcttgaatcctcagagttctctgttcaagaggaacatccctgggagaggagcctcctggctcctctttacctgggtcagacatgatgtatggagactccaccatggatgacccttaaatatgatggatggctttagttacaggacacaattctttctcaagggaaggtgaccaaaagaagttgggtcttgaaggggctgcaggatgggcctggaagtctcttggctctaaaggaaccatcatagaatggggattctgagcaaccaggaagcagcagaaaaatatgcaaagccagatgggagtggggaatattgcccattaatgggcaagagtacatagaaaggtagataataaactggcttcaccacttctcaactttccccagagctggctgtgccagtaaactgtgctcagctggctttggatgagagaaggacaagagggtgcctatctccagcatggctgtggggtcgccctgctccatctctggatcttcagcctagagtgcagcccagccaaacaagagcgatgacctcactgaccacatgtaattctgcttgagggatttattttcttccatgagctcctgccaagactcttggttaaagctaatggggctcccccagccagtgagtgtctcctagttatatgtgtaaacaacgccaggcaggaaataggtttcctgttcttaatgggcttgttaaacctcttatcgagtggggtttaaatggctttattatgaataataataatagtaaataaacattattattattagtagtagaaaaattatgatgtcagccctgactaccccttctcattttaatcttgccaacgtggaggtctttggcctctaagtgcacaggaatatggtgagtgacactgggacttataactggagaagatggcagaattcatcttcgttgcctgcagctttccaatcctgagcccttttccactttcatcgtgtttccatctccatcattcctttcattcagggttttcatgatcttattctatcagagaagatagaactacacatccctctccttctcagttttatttagcattgaaagccatggacagaggttctgaggttaaattgaggtatcgggtagaggggattttggagagagcagtggatgctggtaggggagctcagttggaagtggggctcatgttctgatcttcagtgccgaatgtctgtgtccctccctcagatttacatgttgaaacgtaatcaccaatgtgatggtattaggaggggggccttttgggaggttagtaagtcatgagtgctttgggattagtgctcttataaaataggcccaagggagcttgttcaccccttccaccatggaaagacagaagaagaactagaagccaccatctatgaaccaggaggtagccctcacctgatgccaaatcttccagcaccttaatcttggacttccaagcccccagaattgtcagatacaaatttttgttgtttataagctacccagtttatggcattttgttgtagccacctgaacagattgagatatccagtttatagctggaactggaggtataccaggtatcccagactttggtaatttatgtatcaggttcactattttcaccataactccctacaacagtattgattttctttacaccgattatcttgtttgacttaagtagatttggcatcatcttacaagcaatatgtctttgaaatcctgggttcaatgtgttagccaggttttttactgactgcatattgaaatgaatatctaagagctaaatattttttcctaaagttcatcatgtggcaaatgtgtcacaccctccagggaaaacataccacaacatctggagacactgctatagggtagtggttcttaaactttagtgggcatgagaaacactggcagagcttctaccagaaacactggtagatagctgtgctcttccccagagaatctgattcagcaggtctgtggtgggaaatatgactttgcaggttttttttttttttttttttttttgagacagggtctcattctgtcacccaggctggagtgcagtggcgcggtcttggctcactgccagctctgcctcccaggttcacaccattcttctgcctcagcctcctgagtagctgggactacaggcgccagccaccacgcctggctaattttttgtatttttagtagagatggggtttcaccgtgttagccaggatggtctcgatctcctgatctcaggtgatcttcccgcctcggcctcccaaagtgctgggattgcaggcatgagccactgtgcccggccttttctttattttttgagacagagtctcattctgtcacccaggctggagtgcagcagcgtggtctcggctcactgcaagctccgcctcccgggttcacgccattctcctgcctcagccttctgagtagctgggactacaggtgcccactaccacgcccagctaattttttgtatttttagtagagacggggtttcaccatgttagcaagggtggtctcaatctcctgacctcgtgatccacccatctcggcctcccaaagtgctgggattacaggggtgagccaccgcgtccggccgccttttatttttttttgagatggagtctccctctgtcacccaggctggagtgcagtggcacaatctcagctcactgcaacctccaccttctgggttcaagcaattctgcttcagccttcaagtagctgagactacaggcacccgcccccacacccagctaatttttgtatttttagtagagatggggtttgaccatgctggccaggctggtctcaaactcctgatctcaagtgatctacccgcctcggcctcccaaagtgtccagaactcctagactcaagcgatcctcctgcctcagcctcctgagtagctgcgactacgggcttgcacccggaaactgcagttctaacagttgctcaagagatgttgatatccaggggccacactggcagtggcactggcctggagaataagggcctgttctccatttccacatgtgaaaatttcctcatttgaaaatggggataatgtgtgctgtataaaatgaaataattttttcttggtgccaatctgtctatgcaatggaatgtttgtgtctccccaaaattcacatgtggaagccctaactgccaatgtgatattaggagatagagcctttgggaggtaattagatcataagggtgaggtccttagaatgaaatccatgcccttagaaaaaggaccccagagagttccctcaccctctttctgccatgtcaggatacaatgagaagtaagaagtctgcagtacagaagagggctatcaccagaagctgaccatgctggcaccataatcttagacttccagaatgcagtactgtgagaaataaatttctattgtttataagccacccagtctatggtacttagttatagaagcccagatggagtaagccaacctgtttggagtgtttttgagctgtcatgcttttcaggttcagcttaaagctcagatgggaaatacaggaacttctgcaggttaattctggttctaagttcaagtcctaagaataagcccattatgcaattctgggtggccaagcagttctccagcagcccccaggaagtattctatctcacagaatcctggcaaaaggagacagtcttctcagtctggtcaagggctatgttgagtgtgagggaacagaggtgaatgtcccttgctgtgctcaccatgttctgagagacaggcagacaaagcgtaatttacaatttgattaagtgattgcattggtgactttttaaagccgcccagtagttgagccccctttctgcatttggaagtttacccgtatgagtctaaaagggagacagggccctcattccatgactgaggcccccaaagtctagtctcactttcctcagtctcagtgagccacagaagccaggctcagtgtctgggaggagaaatcctctctgatggtggcaggggtggggacagcagccccgctgggccctgtggggacagtcccagcagcagacagtcccagttgggcttatcctgtgatgttggcctcactgtcttggcagcctctggcatttctgttctctgttcatcttccacatatggttctcaggttcactcatcaaatcccttcccatttcacccaatcaataatgctgaactaataatggtttttagagcagggaagtggcacaatcacaacttattttaaagataactgaccactctctggagcatggattggaggatgagtgactcaaggtggggtgactagtgaggaggtgatgaaggagatgagaggaaagaggaagaaacactcacagagtaaacctggccatatctaatgactggaagcctgagtttctcttcaaactcagaagagaaaaatgaatttatggttttgggcgcagctttagttttgtctttggggatgagtatgtattttgttgggaaggtggatgccctgaagcagggttgggaaacaagattagaggtttttgaataagactgtgtttgaatacagcttggctatggtcttctccatttcaagtctgttcaacttaacaaatattgagcccttactaggtgtcagacattcttgggtatttagaatacagtatattttgattttggtgttgaaaaaggtgtggaggtatgcagggaaaaatctcacatgcttttacctacacacacacacattcacgcaacacaaagtgcacgcacatattggtcttgaaattccccaaggaccaaaatggacccatgtgatgagtctgtgttataacagggaatctaccgtaggttcttggctaccttttgtgaaccttctgtcttctttcctctcacttacaagtaatcccctgagtttttacctcctgaaccctgtgatttcaagggttcacaactaaatgcttcttatgctgagcaaatgtatacactgctaaaaccatatactcactccttgtggtgtgtttgttaggaagctgccacttctgtcttctccattctttggaaaaggctgtgagtaaacacagagcactggctatttacatacctagctcctgcttgctttttcaaagctctttgttcaagtgtcagtgctggtttgtaaaacatgaacagagttggggtaaaaaaagtaattacagttcaaatctggtgtttctactgacatgatactgagctgcctgactgctcttctttcttatcccttctctagttctgtcttttcagttgcaagttcactctgtctctgtctcccctctctctcccttgctctcactctcattctcttgcttgctcttctgtgtgtcagaaagctacacacatgaaaggtagctggcctcatagccactgggtagcccatccttgagagcctggccaccttcagtgtgtcgagatgccagggccctctatggctttttgcacagggaagttctagtgttttcagtttccagagcccacaatgagctgtcctccaaatccagatctaaaaccaaaccttctcttggatcagaccaatccagaagcactctatagtttcaggggtgtccaatcttttgacttccctgggccacagtggaagaagaagaattgtcttaggccacacatataatacactaacactgagatatagagtaagctcagttgttgacatagcaagtttgaaattacagcagaacttccagaaaacatcacaccagagttttctatccttccaactatattttacattttttgctttcagaggctatgcttcttcttctttgttcttctcttaattcagcccatgagcacatggtagattatgaatggatgctttaggaaccatgtagatggaggtttgtgaaaatttccacggaacatggcagttgagaattggtgactgatatggtctagctctgtgtccctacccaaatctcaccttgaattgtaataatccccatgtatcaagggtgagactaggtggagacaattaaaaaatgggattggtttctgccattctgttctcgtgatagtgagtgagttctcacaagatccgatggtataagggggtataagaggctaccccttttgcttggcactcattctctatcctactgccccgtgaagagatgccttctgccatgattgtaagtttcctgaggtctcaccagccatgcagaactgtgagccagttgaaccacttttctttataaattacccagtctcagttacttcctcatagcagcatgagaacagactcatgctggtaccacagagagtagagttctgctataaagatacccaaaaatgtgaaagtgactttggaactaggtaacaggcagaggttggaacatgttggagagctcagaagaaagaagacaggaagatgtgggaaagtttggaacttcctagagtcttgttgaatggctttgaccagaatgctaatagtgatataaacaatgaagtcctcagatggggatgaggaacttggtgggaactggaataaaagtaattcttgctatactttagcaaacagactaaatttgcatttcacccctgccctagacatctatggaactttgaacttgagagagatgatttaaggtatctggtggaagaaatttctaagcagcaaatcattcaagaggtgacttgggtgttcttaaaagcattcagttatatgtattcacaaagatatggtttggaattggaacttatatttaaaaggtaagcagagcataaaagtttgggaaatttgcagcctgacgatgcgatagaaaagaaaaacccattttctgaggaaaagttcaagtcagctgaagaaatttgcataagtaatgaggagccaaatgttaatcaccaagacagtggggaaaacgtatccaagatattcagagatcttcatggcagtccctcccattacaggactagaggccaaggaggaaaaaatggtttcatggattgggcccagggccttgctgctttgtgcagtctcagaacttggtgctctgcatcccagctgtggctaaaaggggccaatgtagagctcaggccattgcttcagagggtacaagccccaagccttggcagcttacatgtggtgttgggcctgtgggtgcacagaagtcaagaatttaggtttggtaacctccacctagattttagcagatgtatgggaatgcctggatatccaggcagaagtttgctgcaggggcgaagcccctatggcgaacctctgctagggcagtgcagaagggaaatgtggggtctgagctcccacacagagtccccactggggcactgcctagtgaagctgtgagtagaggactagcatcctccagacttcagaatggtagattctctaataggttacaccatacacttggaaaagctgcagggactcaatgccagccaatgaaagcagccgaaagaggggctgtatcctgcaaagccacaggggtggagctgcccaaggctatgtgagcccacctcttgcatcagcatgccctggatgttagacacagagtcaaaggagataattttggagctttaagatttaactgccccgctggattttggacttgcatgggacctgtagccccttcgttttggccagtttctcccatgtggaataggtgtattcacccaatgcctgtaaccccattgtatctaagaagtaactaacatgctttttattttacaggctcataggtggaagggatttgccttgtgtcagatgaaactttggacttcaaattttgagttaatgctggaatgagttaagactttggaggactgtgggaagggcatgactgttttttgaaatgtgaggattaagcataaaataatggcaaaccgcacaagaattattacaattcaaggtgagatttgggaggagccagggacagaatgatatggtttgcctctggggccccacccaaatctcaccttgaattataataattcccacatgtcaagggtgggaccaggtggagacaattgaatcatgagggtggtttctgccatgctgttttcatgatagtgagtgagttctcatgatatctgatggttttataaggggcttccctgtttgcttggcactcattctgtcccctgccgccctgtgaggaggtgacttttgccatgattgtaagtttcctgaggccttctcagccatgtggaactgtgagtcaattaaacctcttttctttgtacatttataaattacctagtctcaggtatttcctcatagtagcgcaagcacagactaatacaatggccaagaagtgatcataggatggtaatataataaacacatggaggggaaagtgagtgtagttgcaggttttcaggagaaaatctgaaaggggtgaccaaaaatgagtacctgaatgatgcagctttttgaaaaagtctatttgtaggtcattaacaaattgagattcaggaaatcattgtatggtttaaataggataaaatttttcactagaatgcttgatctctggggattcccagaagcccattcatgaaagtggttcattcatgcaacaaatattttaacaaatgccaagtatgttgtagaattattttaggtgctaggaaaacagcagtggataaaacaaaaattccttagagtttatattctaatggcgagtcataagtaatctacaaaataaataaatatacagtattctagatgatggtaagtgttttaaaggaaaaatgaaacaacaaatagtgatagtacaagcgggggtggtggtgataatttcaagtttaggtagggtaaagaagaagacatggatagacaggaagcccagatatagcatagtattccagggaccaaagcaagatgttcaggaaactagaggcctcaaattctcctactgcaatctgactttgtaccccaattaacagtgacagcatactgctttaaaataggaaataaagtggaaggaaagcaaatgcttgatagttgacctgacattcactgttgcaagattgggaacgtacaataaatgtcactgatggagaaatattcatgaagtaaaaatgtcagttttcaatttggcatgaggatggtttgacatgtattagtcatgcacagaatattatcataattaatgcattaataatacagctgtcctttttctcccaatcataagttaaaagggaggaaatagaggcaagtgaaagagcagctctcatcctgatcagaccttttctcttggcatttgtctcttcctctgcccagccatttctgtggcattggcttctgatcagtatcagtcttgatttatccatctcagttcttccttcacctttcatgaacaacaccagtggttttgtctgctgagggctttttccttaattttcagccatactttaaaaaatattttaaaagagagagatatatatagtaaaaatgagacataagcaaaatcaagaatataaaaatctcccataagctcactacccagagaaaactactattactattttggtgtttgtactgatctcggatagctggcgctgggatgactcaggggatttgattcttctccactgtttctcattctccagcaggctggccctagcctattctcatgtcattggcagaggcacgggcaagcttattctcacacctgctttttaagtctctatttgtgtcacattcactaacatcacaaagcaaatcatgtgattaagcccagtgtcaaggggcggaacattctgtcctacccatagttggaaggtactgcagggttatgtggcaaagggaagggtgaaaacttggggcaaaatttgcgacttcctatactgggtcaaaagacacccttgtttcaaggcttatgatagatgtttccaaattgctttctagaagggctgaaccaaccccactaatggtataagacttcctggctttccagttctctttagtcttgctgattctgggaatgatttatgaccttctgtctgggctgttttgatttgtatctccacctgtcttttaaggctgcacagtttttctttgtggtaattctttacttgcagaatacccccaaagctccctaagactctggtctacttaccttcttcatcctgatttcttctgcctgctttatctaacacttgtgctgaccaactcccagctatctgaatattcagtaatccatgtaggcctactccccaagtgttctaagttggtaggagttactacacatcttttaactttgctgcctacaccagcagtaatgtaattgttggtcctcattattcccagaatattggaatttttagggtcagaaaagagctcagaatccaatctcatttttatacaatattattccaaagatgtatgggtatttgtgtagatgaagataagggtatagatagaaatttgcatagaaaaaaggttgaaaggcattgccattgttaatatgctagtatacatctgtatatgggaattataggtgaattttttttttgcgatggagttttgctcttgttgcccaggttggagtgcaatggcacgatccctgctcactacaaccgccacctcccaggttcaagcgatcctcctgcctcagcctcccaaatagctgggattacaggcttgtagtaccacgcccagctaattttgtatttttagtagagatggggtttctccatgttggtcaggctggtctcgaactcctgacctcaggtgatccacccgcctcggcctcccataggtgaattttaaaaaatctttaatgttgcgtacagaaactgagggtcacagaagttaaataactcacctcatatcctaaagattaataatagtgaaactgactaatgcccagttctgctgattcctggtttaatgctctcttgagataataccacagtatgatctctgaggcctagctgtcttttgtttgattgtttgtatccaagctgtattggcagtttcttttggttttataagagtgctctgctgattgtgggttcacagggaaataaagaatgttttttaaatgattgagtcatctaagtcagctatgtaaatgtatatatatatatacacacatatatgtaatatctgtatgcataaattaccatgacttcaaaatttgacaaatggttcaggtaaatagtggattttatcttttaaatcacattaaggctcccaagtggatgcatcctgagttctggacacataatttatcataggcatcacatggattttatgtaattatattaattatttagtacatacaaaggtaagctctgcagaattagaatagaatcggataagtttttagggagatctaaattggtaagattgatcaaatttcttgctatgagtaattgaaggtgggtcactgtgatggagtgttcttcactggagctaagcttcactagagctattcggagtaattggggactggttaggagaccaatgcatcaacatctgtctataggaagtatggattcatctgctttgaaatgagtctttagtttgtttcctgcttgttctttatttctttttcacctgaatgctctttcaagaatattcaaaaacacaaaaacaaaaacttttcccctggagagtggggattagctcaagaatcaccatgatgatgagaagcagaaaacctggtttggagagtcctggacctggagaacaccaaaaagatgttagcatcttgagtatattgttctgatctaaagtcagatgttaaattttttactcacttagggctgtctgtgagactttgcggatcacagagagaatagacactgagaaatgaacgtgaactagtgggtacaaaggaaagggcacccgaggctgcttcatcaagctagaggagtgggaatctcagcccctgagaatgagcatctacaggctcttttttcctagtgcttctgtggtgtttgtttttcattgtgccacttggtttgcagaaaagaaaaaagaaaaaaaaaaaggctgccctggaagctgaggttttacaagtgctgagagaactgtcaacctattatagaattcagacagagactttcagctagagagggtttaggtattctgtgcctggctggactctagggactcacgcttgatcatactaggattcaagaacaacgcagttgtcactgttagcccatgatcccacacgtacccagacacattctctcacggcaagtacatctgcacctggatgccttctactagtatgacatacttaaaagtatcttggatatgccttaaagatcattgttggctgcttcttgatggcaaagtgctcagttagagccagtttaaacacatgtcaccagaactgaataaatagattttgataaaactgattcagtgaatatctcccttagggcgaagctcagccttctccacttcactggtgctatgaaaatcactagtcctcatttccaagctgtgtctgaattcagatttaactgctaaccattgtttaagaccgcagtgagatccacagggtagtctcaaggtgtgattaagacacttgggagtggtggtggttaaaaaaaaaaaaaaaatagagccaaagtgtaaggaggcaagctggaggcacgtggttatatgaggagaaaaattgcagtgaggccttctcatcaccctcttcagggtcaatgtgatggcttcgtagaatcaagtgcaagtctgtggctccattatctcaactggctagaagagagtgctactaaggcagaggtgggagcatgaaagttcacctaatagcttagttttgttaagtctcattgccacagtctgcaccttatcctgatgttctcactggaaaataactagcctagttcctgagaaggaattgtgaacagggcattgcctgtttgtcaaaaagttatttaaagtcactccagctcctcacttaacctctctatgcctgtttcctcttctcgaaaattacagtaataattattacagtaataatagaatagtacctatctcataggctttttgggaggattaaatgagttaataatctgaagatattgaaaaccacacctgtcatgtggtaagtggtcttcaaatgctaattgtttttatctttattaactgccatacccatgtttgattggcagctacatcttgtatgagtctttaatatttcatctgtaatttctgggttgctcctgccacagagaaggagcaagggagccattggtactactgatgaatattaggaggtggagacaccttgacaactgctgaaatgtactcatgcctgcctgcttgccctaactgcacttagtggcctggatttaggagctgccaatctcattacacaccagttttcatgactatcctcaacttactcctttcttaccactgctcagcacttatcctaagttgacaccaggctcattggtaatcatggactcacttctcccatctgaagtattcttgagttggctcccaagaagcattctctcttcatctccaactcaagggtgagctccttttcgtggaggaactaccctgtgtgtcctttccctccctctctccatcaccatcagcattcaattcagtattctgcacacacaggagtttagtctcaatttaaggtaggtcaggtttcattcacccttgagctccccttagcacccactacagactcattggagaggtgactattagaggtgcttgtggaaatgaatctcaaatagtgtccttctgcctgagtccttcattgaatccctcacttgtatacatgattcatactctggtagctttgatcattgtacaaaagaaaagtagtaactcttctttggggccaggccaggactgtggagcccaaagggcttttgtcatccctcctggaatggagttacctgatctggatattggaatgtttacatccttagtccttgaaaaggggaaaagttatgcttatcctcaattgtttaccatgacccttcctgtcacatcatactgttctacgaacacaagaatcatggctaacatttgtaaaccatctactatatgccaggtactctataatggaaggtattttacataaactttttatttaagtctgtgaattaggtataattcaatgcatttttaaagttaaagaaactgaggcttagagagctacttgaccaaaatcacaaggctactaattagtacaagccatttgatctaatactaacactaacttgttgtaactagcttgtcttgctcttaacttcttatctcagtccatttgtgctgctggaacaaaataccacagactgaataatttataaataatggaaacttatttctcacagtcctggagtctgggaagtccaagatccaggtgctggcacgtttcatgtctgctgagggctgctctctgcttccgggacgacagcttgttgctacttcctcctaaggggaggcatactgtgtcctcacatagctgaccttttatagaggttgctaatgccactcacgagggttctgccctcatggtttaactacttccccaaagccccacctcttaatacttatcacattggtgattaagtttcaacacatggattttaggcgacaatcagaccatagcatttcttctctacaggtttataaaaatacttttttgtcttgtatatattttcattatttttcctgcttgagtatacattttcatctctgaagacagggacacatttatggacattccttcctctgctctctaagactgcagtgattttatgtgcacatacatacattgaaaatgtatagttggctagatcctggaccccatataatagcttactggttactatacagcaggaggaactgaagagaaagaaagaatcaacagcaaaggtgcccatacctgttgcaatttgtattttgctcatgtcctagttcagcccatccaagggccaaccctgatagggcttaaatgttctcagcattagcttctcttcattaatatctgtttgtacctttctttgatgccgtatctatcctccataaggtacttattaattttcgcatcatcctgcttcatgttgttctgtccattatctgtaaggctcaaatatagaaagaaagtgcatccatatcagtgagagacagttcagagtgattgtgggtgagctcatggtttcctgcagctgcaggactagagagagctacttcatgatgttggagatctggagtttaggaagcctaggaggtattcaagcagcagtcagtcagcttgccttgcatttttaaaagcatgtctgcaattttatggtgtgttctcctctcccaccactgctgttttcctccattactgcttaggttgctaccctgagagagaagcagccatgctgattctttatcttttaccaaaagggcagcagcagcatctctttctaaattgttattatgaagagaatagctactgtggtttgaatatccccttcaaaactcatgtaaaatgtaattgccattgtgatggtattaagagatgggacccttaagaggtgattaggccacaagagctccattttcataaataaattaatatcattatttcaagagtgggttgttataaaaacaaacttgcccccgtctgtgtttcagtctcaccctcacttgcccttctgcctctgtcatgagatgacatagcatgaaggcccttgtaaaatgtcagcaccttgatattgaacttcccagcatctggaactatgagaaatcaatttgttttcgttgtaaattatccagcctatggtattccactatacaataacaaaatggactaagacaataacccatccacacgatacaatgcatgatgtagaaagtaaatacattgaaataaatacaatgcaaagaaggtctttgttatccaagacgctctgtcctgttctgcagagttaacaaccatcatatctctcatatgatacttcttactagaaaattcccaggcgtacacaggtgtgtgtgtttcacccctttttgcctttataaatggaattggctggaatgctgctgagatcccagctgctgaccctcctgtcaggtgccctgtggttctcattagggcctctgggatactaacattcacacaggcaatgtactttcccttcctgacgcctctggggcccacccgggaccgtcaaacagaccctgcaaagcttaggagatcaattccaacagaagtccagagccatggtgctcttggaaaaatcacaaaccaaaatatagaagtaagactttttcttcctaaattttaggaagaataagaaaatttagtggacttatttgtccactaaaatattaaatgtgaggagaggggaaggcaaaactatggatgattattttcttttttttatatttctgtaactttaaataaggatctatatttataatgaaaacatttatttataatgaaaaaaacctcaatctatcaaaaaaaaaacaaaccccaaaaagtattgccagttcccattgaagtggaatcttaggctctcaacttattaaatgtactaataaagtttttattggtaagcagatacaaaatcgctttataagaatccccagggaattactaagcattgttttgtaatagtaaaattggatcctaatgagcatagtggtagaagtcactgtctgcagaaattagaaatgaaatagagttgattctgggtatgtctgcattgaattagtagagtgtcttggaaagcttgctggactatgatgtgcacggtgggtaacaggatctcccagggtgttcaaagcagcatgattccatccccagcttgccctgcttgttgaaaatcactctctaggacagtattttctgtgctgtgggttttagcctctgtgggcctggaatattactgctggtgactgtggacccttccaaacataacatactgtctgccacaaataacacagttactatttattgagtgtttcttatgtgccagccaccgttctaagaactttcatgcatttacttatccagttcagtaatccggtaaagctaatagcatgttgattaccttatgattgaggaaactgaaacacaaagggctgaagaagattgtctagagtctctcttctattaggaggtggggtcatggttaaaaagagccacctcctaatcactaaaccatgtcacctctcagattagtggatgacatctcctgtatgtggaccatctgtctgtatgtgtgcctgcgattgttttccagatatttgtagagattgttgagattgaacaagcagaaattcatataagagccatactgagtttacatcagcttttggtcatcagtattttctgtcagtggatctaaaatgcgactcttttcttgtgatgatcctccaagtatttggctgttctaaaaaggctatggtcccaaaggctgaacgtcattgttctagaggaaggattttcctgtgatgatcctccaagtatttggctgttctaaaaaggctatggtcccaaaggctgaacatcattgtcctacaggaaggatttggtcatcaaacacacaccatccctagttctttcccaaacagctctcctccagctctgtcatgtctccaccaggatcaaatggcatggtctctcattctttgtgatgtagacagacactggtgagataaattgataagcactgctttgggagtcatctgttgaaatacaaaaataactttgtaacataacctccttctccttagaaacaattattggaggaatttatgaattttacatcttgtgtgagaggctgacagaacctccaatcagaaaggccgtgttctagcgtcaaatcatccatcatttgtgtaactttcagcaagtcactctacctctgtacctctgcattttcaatttgcaagagtggttgcagagttaaactagatgatggtattatatacttgtttttggtttgtctatttctttattttaaagaatgttcaatatctactccataacaggcatagcattagcttcaggatttccagcagtgagccaaacatacagagccctagttctcatggggttgatttcctatttgaggaaaagagacaaaaaggaaatatacaaatacatacattattaggtggtgataaatgctatggagaaaaataagaagaaataggggagataaggggggggggtgattaatttatgtagacattcaggaaaggcctcaatgttgaagtagtattcaagctcatacctgagaaaattagagcctgagccaaaaggctatcagggcagatggtcacaggcagccagtgcaaaggacctgaggtgggaatgtgcttggtgagttggaggcacaggaaggggcctgtgtggctagtacagagggaggaaggctgagagtagagatgatatctgagcttccaaggggccagagaatggaaggtttgggagtgagacggagccatggacaaattgaagcagagtgaatatgctctgatttatactgttaaaagttgatcactcctgcggagtgtggatagaaatttagggacaagggagggtggagggagactagttaggagactattgtcataatccaggtggcttggccatgaagttagtggcggaagaggtctcattctgggcatatcttgaagctatgcttgatggggttgttggtaattgggtctggggtatgagaggaagggaggggccagggtgacaccaagcatgtgattaaggcctgagcacctggactgatgagctgttgtttgctaagatgggtaaggctgagagagatgcagttttaggggaagggttggatattaggggttcagctttggacttgcatttccgtgtctaggagacactctagtagagatatgaaattggtgatggtatgagtaaggttggagtttagacaaaaatctaggctagaattatggatttgagaatcattagcatacacatgctatttagaggcttgagactggatggaagcgtagataaattgagtgtagctagtgggggccaaagcattgattctcttcccaaatgctagggagccctattacttggagcaggaattgtcagacagtgaccagattttcatgtctttttgtaaataaagtttaattggaaccattcatctgcatttctttatctattgtctgtggctgttgttgagctacaacaggagagctgagtagttgtgacaaagactcatggcctgccaaaggccaacaaaatctaccatctggctgtttagagacagggtttttgtttttgtttttgttttttttgacccttgatttagagatcaaggagataagaggcatccagcaaaggaagctgagaaggaatagccagagaggaaagaagagtgccaagagttctgcattgaaggaaagatggtgccagggtttgaacacacagcattagaatacgtgaggctgggcaagttacttccccataaggacggtagtagcacaggattggcataaaaattaaagtagatgatgcatgcaaaacacttacagctgtgcctggtatccagtaagtattcagtaaatgctcttacagcatctacttctatttgcttagtctgtagtcctcagccaaggctctgtactggagacaaatcaggatgtttgaggattagccccaccgcctgatcaggtaagcctatgatctatgctcagggacctgaggaagaaggaggaaggtgagccatgtcccccgaccctgaccgtgtacaccctgtcccccaagaggaccttgaagaagagcccttcagcatctgctttttacttcctatctttgacaaacagtctttatggaaagcttttgagcaaacggcaaatccatctttatgagattactaatgtcaacacattttgtgtatcaggattttataggctcctgcgggcctgtgcctgtgacaacattggctggcagtgctcgcctgaggaattatgcaacatgcccctgatgctggagaaggatcttgatatcccactgaggcccgggacattttctcccagaaacagtcttgaatgagaagcttgaagaggggagttagatttactggggcttctctaaagattctgtgtccaaagcttgaatagggaaagaaatactttgcatccatgtagcaggttctgcattcagcataccaggtttgctcctagttaaagagtcatggagcccatgggagtgtttgttctttgggaatgtcataaaagagaatttggcctctcccacttacatgttcttgcatttcttattggtccttctcttgcaattattgctactttccctggtcaacctctagagcagtggctttccaagtgccttctgtggacaggtagtatcagcatcatctagaaacttagagacgcaaatcctcggtgcacccccaacccatggaatcaaccgtttttaatgtgtgacctttggcagattagttacccctctgaaatctagtcttaccctatgaaatatgggaacgttaatagcacaggattattgtaaatattaaatgagatgattttaatgagtcttccaggcgattctgattatgctacagttccactcctaaagattcttctaaaagattcccatttttggacaattagaagttcctgctaagagaaattttcagattttatccctctacacattcgcaactatttttaatctgagctaatctgccaatcatctttccaaaatgaattaatactctcccattttcttaaaaattttgtaggatatcaaccattttaaactttttcttaaagactcagggcatcatcatgaatataattattgttatattagatgttgggcctttgtcatatttctatattttgtgttgtttaccagtttttttcagcttctttaaaaatagaatctttagtttgctaccttcttcttcattgtctggatatcagctatttttttaatagctatatccagtattatccccatcactttctaattttttacttttaacttgattttgcacaaggactgaaataaccaagatgattaataatgtactcaaagcaagaataaatcattaaacataatagtaaataaatgagaagaatttattgagaggaaataaatgagagggattttttttgaaagtataagcttctgtacctgagttttgcatcataaagtctggattcttgggtaccttactatttacttctgatcatgtcatagttgtcttgaataactgaatagctgatgttttgaataaatgaaaagtttttgtagcatactcaccactcaatcattctcctgaatgttccaccctcatcatgttatacctttctatcctttgcatatattgttgacatatacattttcctaggtgatacagtttgtaactgatatcatccaatcacaagtaaattactgctctgtggaataaaaggtaataactaaatgggacatgtctcctctttcactccctttttgctgttgttccacttctcctgggctcctgatgaagtctaggggagagtatacagggctgagatgtgaacaaccctaggatctaggcttggctctgccactaagtgactatgtagaactaggcaaatctcttggcctctctgggccatgagatgcaacactataaatcagtacgataatactcgcttctccttccttatagcagtagagcaagaatccaaataaatagtacaagtgagaactcaacacaatctacatctgtgaagcatcattcttaaggtatatccagggcatttggctccacgtagacctagaggttgctttctcagtcccttgtccgccccatatccagctgccttggctcacagagtttgagactgtgctgtattttctgtcatgcttcagagtgtatcaaatcaacacaaatataaaataaagccataaagagaaggctgatattcaccatagaaaatgttggagggaaagacaaaaacactcaacgacaacttcacaaacaacccttattatggctgtggaagacacaatagtatgtgtaatgtggtgtttgggctgtatttgctgcttgggaatctggtgcattctgagatggagggaatgccaagtgtttagacaacatgctgcttggcgcctgcaggttcctggaaaggactggggtctccagatctaggctgccagccaggagtctcaggcagagacatgcattctaccgtttaaggcctttctagacttcagcagtgagcagatacaggagccctcaagaagctctgcaaaagcctaccaccactgagatccaggacataatatgcattcctaagcaggctgctgcctttggctgagtctatctgggggccttctctctgcaggagaggatgctaacagctactgttcctgaaggactcataagaagacttctgtgcacttccagcctcccacatgaagcttctggaagggctaacccggttcatttcatctacttgctgcctatgccaatcctatcccctcttcaaagcccagtttaagtctgaccttccccatgaaatcaccaaagcctttagtcttcatgacccctcctgcctctggcggtctcttgcacttgttgcctgagattctcttaagctcttttcatctgctgccttgttagttaaatttactctgagtgtgttttatcttgtttcctcagctggattgtctgcatcttgggggaagggaaagttcttataaatcctggttctgctcttgggccaggacatgcctggggcagcaggtgtgtcttccccacctagactgaggaattgtgtctcaggggctgggctggattccgcaggagggaggccagggctgccaagagcaggagagccagagaaaagaatcaaatggccttaaatttgatttaagtttcaaattgcttgaacccaggaggcggaggttgtagtgagccaaatcgcaccattgcactccagcctgggcgacaagagtgaaactccgtttgaaacaaacaaacaaaaaaacaaacaaacaaacaaacaaaaacaagcctggcaactgctgccaagtgtctcatccaaagaaggaagggggatcgaaaccaaagaattgtgaagtcacaggatcaacagtcaggcaagtggctaaggactcaggctatgaagggtcctctgccacggttaggaggtttctttgttgttttgtggtgctctttgtggtgtagaaacaggtcatttctctacaaggattcatgcaggttggacagttccatcatggtctgctcccaagcatggggcctgtagaagtaatgacttttcttctggtcccagtccacaaagagatcgtgatcccattccccttacctgtacaatgcaggggtgagactcaatcctttcttgagtcccagtaaatgacttgagagattgtgagcagaccaatatcttctgtaaatgactggatattccagggaatactttcaaaaagcatcttggacataaaaacttttttttttcataagcagtggaggcttggggtcaaaagctagaccattcctaaaggaaagtttgatagtttcttctttgggagtgaaaaccctatgcatttaagaacagaaaggaaagcttgcataggtctgaaaatggaaaataggcctatttcctttaagaatagtaaatttcaggccagatgcactggctcatgcctgtaatcccaggactttcggaggctgaggtgggcagatcacttgagatcaggagttcaagaccatcctggccaacatggcaaaaccttctctctactaaaaaatacaaaaattagctgggtgtggtggcacgtggctgtaattccagctactcgggaagctgaggcacaagaagcagaggttgcagtaagccaagagcaggccactgcactccagccagggagacagaaggagactctgtctcaaaacaaacaaacaaacaaacaaaaaaccaaaaaagaatggtaaattccaattaacaacaggagatggaacaaatggtggacagtgactgtcatcagagaagtaaatgctatgtctgcaaaaaagaggtgagggcacagtgatgcgtagagacccctggctttaattatcccatgccttggtgttactggtcctctggagatctacttaacaggaagtagtgagctatgtccccacaaaagcatcccagaggccatttctgagcaggatggcctgtgggagtcgagtggtcagttgccatggttagcagagatttcctgctgagaagtcgcccctatgtgtgcacatggacagtgttgggtagagcaatgctccttcaactttagtgtgtttaccatcacctggggatcttgttgagctacacgttctgatttcataggcctggagtggaacccaagactgtgtttctaactagcttccaggtgctgtccatattgcggggctgtggaccacattttgagtagcgtggtgtagtggacactggaggaagaagtgtagacctgagctctagccccagctcagccctgtgtgtggccctgggcaagtcactgacactctaagactcacaattatgtcaatcatagtgataaagggaaatgaactagaaagactctccctggttctatgatgcgatgtttctgttacagtcccacagagaatttagacctctaccttgttcttccttagagtagactgttggccctagagatgtgcccagtggtcatgtaacatggagatatgcttgattaattcactgtacatgggttgtttgaccagcttctacccagtgcctataagagtagataccagactctatttttatgtcatttgaaagacaagggtagaagagacagcagttcagtgacagttgcgccatcgccattactctaatggttcagaaatagcttcccctcttcccctgtggaatgtttagattcatacttttaacctgtagcattttcctacccttcctgtgtaggaagcaggtgcattggaccaccctaaaacaatgcgtaggcctcagacttctgaactcatttctctgagatgagatgtccagtttgttcactacaacaatagttgccagacctattacggttatgtaataggtttctttttttaaacaggtcttgaaaatgtatgcattattctttaggtaataaatgaaatttaaaagactgaaaataaatcagctttgcaaagtgggggctgaagcttttctactaactgaaccatcttttcttttttattcttgttactttttaaggagatgatggcaagtgatttctttttaacccattttaagggcccagttcatcttgtacaattcttgtgcaaagtctctactgagactttggcctgatgcaaaagaagaggcccttagagaataatgctgggcatggagtgtgattcaagaagttattatcgtgtgttctctgacacagggtggctcttgctccccaagggtccaacagagaggggcccaggcatgcagaatattacatgcctgccctgtttccccatcagagaaatgttttccaacagccattgtggttgtagtaaggaaaaacatgtctttctgcctggatatatcaactgagggatgaacggtgagagaatataattgtctaaggatgacaacaggatcaatttccctttgacactgtaggccaccacctctttgtctccataaaatttcattagcacttgaatttatcagattggcttagctgttgtgcattctgctctgtgtgcaacgggcccattgttctactctactttaactggttttctgatggatgtgtttatgatacctcctgctgggtattgtgcgtgacaactggggactcgataactaaacaatatctgaacgcagaatccctctgtccagggaggggctgaggaagtcacaacagttaatctgtagtaggacccatgtcctcccatctgcaggggatgctctgttggcttgcaaagtggaaagatctgggaggctgaggtctgatgtcgtcgtcatcggcagagcgaccttgctcctcatttgtgcgcacaggcactgaatggagggagccttgaatcatctgattttgctcctcattagtatttctccactgtgttctctgaccacactttcctcctcggtgcatgcaaagctattagcaatgcacacacgcggcacatctgtggagccattattgctgctggatagctgtgtttgtgtaaaatattgaacaccctgtgaagatttataatggtttcccgccctgtcctctatccaccccctcttctctatttaaagacatattaacatctctagctctacctggaggaaaaactctttgaagtgagactgcacgaagataaaatgccttctctgaaagcgtccctctagaatgagcatggaggccttctgagaggccagggaaccacctgaggcacaggggcaggatgtctctgctggaaggcctcaggcccctctctccctgctttctgtccctactgggagtcagctctcccaagcacaggctaagcacccttgtgaccacagttatctggcccttgtgagagcttgctggtgactttcctgagactggagtcccgaggcttttaacaatgtggatgtgccttggccaaaagacatcctctgggttccttaatacttgtcttcactcttctgttttgtcagtggagatgccagtagctgtaatttagtcttgggtgggagagagccagaggtcgaggagggggtggggaaattgtcatcctaacccagcatagaggacctggtttaaagaggcttaacagaccactggtcttaccagcagatgcacctggggcttcgagagtgacttgggcttagcttcttcaaagggtgctgaaatctctcaccacccctgctcaaccctcttgctgcccccaccccaatggagaggggcccaggcatgcagaatattgtattccaacgatgctagattcatgtgcatgatatggaagggtctggagggaagaggctgctggtgcctatggccctgaggaccagctttctccttcccccatgtccccaggccaccccacccagagcatgccctcggcacgcaacaagcggcatgttccaggttgttccagggccagagagagtgacatgaggcaatgtctgtggcaagcgaaaaatgtgtgctgagccttgggaggcgccgattggctggcagtgaggtaatgcaatgcagtccaaatgtggaagcagcagtaccagcatcgagggcgtgcctcctcggcaagcctgagtctcctgccagccatctgaaggacaaggcgccgaggggtgctgcagacctcatgcaggtggctggctcacatggcagggtctgggtggtagagatcagatggcaggatctgagttgtcatgtctgttctctgtccctgaacacaccaaatgccactacaattctgatctctgttcttcaatggggatctcttagtggggagggcaaagaagcttgaaaatgagggtctggacctcagaaccacttacccaggtcatggtgagtgatggtcaatacaactactcttgaggattaggatggttttctcagtaaccgatggcttccctttaatgatataaaccttctcagggtctttcctaagcacagttctagattcatatttgggccagaagtccacactcaatctccccattccagtccatttcctatgactttgtgtcattggcaatgtccgctacgaaggatggaggaattcaagaggccactgtgggctatgctttcttctctttaataagactcctgttccaggagaaaactggcctctcaaaaaaagtcttctgaggaatagcagctaccaggaatcacagttggttccccatgaacatttcagatcaattacataaataataactacctattgtcttctagtgtcagtaccacaggagtaactccacatctttgagttaataaataaatttacttacttattcaataaatattctggactctttacggcagttctgacaatgttctaaatgtataggctatggtggtgagcagaacaaagtccttggtctcatgaagctaacattgtaaagggagatacagacaaaaagcaagagagctaagaagaaaatgaaagaggataatgaaatacagggtggctagtgattgaggcaactgtagttgggtggtcagggatgacctctgtaaagaggtaacattttagctgagacatcagtgaagccaatatggccatgagaagttctaggagaaaactccctgctggccccagaaattaattacaatatgaagctttagggaaggccacagggttgaatacctaagaagaaatatcccagtggttaaggacaacttctgctttgccactcagagagaagcagagcttgtcattgagctagtacagtcctgtgcactcgtgggagtaaggtcgcctcctttccccaggcacacagtaactctgctggattgctgactcctggcagtgtcttgtagcaaggtagactggggggtggcagatgcaaactctccctaaagaggtatcatcctcagttatttccattcacccaaaccctttctttcctccaaatcacactggctatatatctgaatgttttctttgacccagatcctattcttggcttctgtagacattgtcttgtttgatccctataaaaatctgcaagatggatgctataatttgcatttgactaaggaggaaactgaggctgtaagagataaggcaactctcccaagatggctcttttggggagacgtagaattgaggtccaaactcctaagaaagatggaactttggccatctccattgaggatgaataactcatcaaactattcctgggaaagggggtggcagaggagagagagatattgagacaggctacatatcataatatcatgggttaaaccaacagcaattttagaccccaaggggacaattcgcatagctgcagacgtttttccttgtcacactggggatgggtggggagcgctactgacatctagtgggtagagacctgggatgaggttctaaatgttctacgacgcacatgacagtgccacagcaaagaattatttggccccagatgtcaatagtgctgaggttgagaaaccttcgattaaagtcttacagtgctcactgctctctgcttcctctgtcttccttctatggctgccctcggggttacttacacactggatctctagatacaggactaaagtcataatggaaatttaagattccatttggatgctgatttttttcccaagctctcttcactatttattaaatggttagtgaagggaggtggaaagcttgatctccaggcaagtgagtcccttggacgtggggtggggagggtgaagctctggtgtggtactgcatcagcctagtgggaggtgcttgttaaccctctgtgctgtggcttccccatctgtaaaatggaggtgaaaatacctcctcctgccacctctcaggtttgctgtgagaagtcagtgatgtgtaagtgctttcataaaagtactatatacgtgtgttattactaattcttatatcatgaataaaatgaaatcatcattctgcccctgacaacaccaatttgctgaaccattagaattctgtacattacagtcttaaagagccatagagagaactgtaagggacctcaagaggtcatgcggtagaaaatggccagtgagacacttgggaatgattaaagtgaggtgggaagacacatggcatcttattcagttactcaactctcctttgttcacttccttgcatcatcattgcctttaggagtaatataataactgcattaataaagttgttatcctcctcccacccctgccagagctctgagggcacagtctaaacagaataattaattaatgaaaatgaagagaaaatagctcaagtgatggctataggagatcaaatagcaaagagaaagctgcaaaaacgttcgttgttatttgacactgagtagtgcaaagagggctgggagagtcccaggatccctgatcaacagagagagagtatcctgggggtttcctctttactttttctttttctgctctgaaaggttaggaaagatcctgagggcataatctgaccatctgatccaggccagcatactgctggagaagactgtgtcggggatgaggtggtctgagaagctggaataaatgcaggatcagctgataaggagggtgaggaaaaggtgagcttagtgtctgactttaaaaatatgtagatgagctccctaaataaaatacccctccacactgtactgatgactgaaattcctttaagagaaaatattttcgttctacaattaaagatagaatcctattttttccagggagaagtaatattgtcttaaatttatcctacattactacatgttgattacaaaaactgaagaatctattttctttgttttttttccagtttttatctccatccccatcttgcatcttacaaaggacccaatagaagcttcatggggtacaggaaagaatatagcaaggaccttggaggcctcaggcctcaatctggctctgccattcaatagtttgaccttggagagcaatcagaattctcagggccttagatcctctgcccgtgaagctgaggtattggactggatatctccaagggccctactaacaataagattatggactggggatggcttttcttctttccattttgttcaaggaagcctcctcttcgtcatttctcacctaccacccagctctgtattttcccatatttcaatgtcctttcatgaagacatataaacagtggccatgagtcaaggggatgcaagggtatctgtggttcaagaagatgcacgtgatgaccacggctagttgatccctcttggcatattgttgccatctcagaaagacaggaagggtgggttacagctgccagcaccatcaggattaaaagcaggaggactttaagactcaccctcgatgatgcagaactcaaaaggtctctgcttcacagctctgggccaccttgaagggcaagttgacaaaataaagcaaagcccagacagccttacagagtagtagattctgcattcctcattttcatggataattactgtagccttcaatttgaggaacatggcagtgatttgtgtgcagtttactcttctttcaggtgatggaaccagagccagaggcgtggatgtgactctgttgccctctagtggctagaatgcagtagcatacccagcaccccctcagacttggcttggtggtgccgctgacacgtgagcaagggttcctgggacactgactgccaagggggctcgggattctttcagcacaactcctgacctgagattctgcagagagagagagagagggagggagggaaagagcatcatccttcctatttctggaagtcagatctgtaacacagagggcctgtttcgtctagagtaaccctgtaccagctgcagcgctgggacgctcctgcctcttctgcggtcgcatgtccatgttttggggcagctaaggcacctggggtctgctctcgcagtcacacatttgctgtgtcacttctgcctcagttagatgttttctctagcaaacagatatcattatgtggttttccaattatcacttcccaaagggagctggttaatatggatgaggctttttaacatttggctttgaagacagggttatatgtagttgtagcagagggagccaatatctcggtaattggctaaggtttgcagaggagcaaggcagtctggggtatgtgccatctctgggacgcggggtctttgcagaatgtgttattgtggtgtagtctttaagtgagttctcagataaactggaaggtgggtctaggtggagattatttcaagaaggttagaactctggtctctggttacaataaaaaagctggattgctgaagatcatatgggcattgttgatgttgggctcaggcagagagttcttagtagggtcttcttaccctgacggttgccctttgtaacaggcaataatacaagaggattaatttatggagaggctgaagaggttagtggaatgagaagagatgcagcatgcagggacaaaactcagtttactatatcagcttcttttaccctttgggacaagaatccccaatttactgggcaaaacttccctccttctacttcctcttccaagagtttaactcatggaaaggaaatgaggggaaatagcacatttcatggcatcgaagagggcatctttgaaacctagcggctttccacctacagacatttagaatgcaacttatgctggcaaagctattgagggtttaaatgatatgctttatagcgtgttgcatttcttcctttgaaaatgaggagcttgaattacctttcttgcttcataatagaaatttagtcttatttctcagtctatagttaacacatagcaatctggtgccttcgagtgacaatttacctaaaagtcagcgttacatagatagttctacaaaatccaaacttacatgctttgtctgtacacttcttggtcttccaaccttcaggatcaccattgattccttttcctgtacccctccaacccctgacactgttaaactccatttcagtagtcattcacccagtcctgcagattttttgtccctacagcctaacattagttttcaaccagatcactctttttttacactattcaaaaatttctttagctttaaaagccctcatgagccaaagtgccagagatacttgtggtgttctaaagtatttgctgggacagggttaaatggatagggaaaaaaagaaataataggagggaaaagggtcccatgaaaagcttgctgcctggtggtggggaagatggagtaccaccagctatcattataggctgggccaggtgataggcagaataaagtgacttaagaaatttctggaagcacttcactgcactgcaagtcatgccactcttcctcagctcacagttggcagaagcaccactataaactgggttcagccacgtgtcccttagacacataagagagggagtgccaattgggaggacaggtgaccgaggggggcagagggacacattcatttattacccagttttgtcctggattgatgctggtcttgggtatccgacagtggaaccactctagtacctgacacacctactcttgacccagctttttcactcccaatttggttgttatacagcaccacaaatagggaaagatggctgggactttgaagagaacaggtggctcctatcagctggtgctaaaagagccccaccttatagatatgtatcttacactcatatgaccttccctactacaatactgtcataaagtcaaaaatgtgtgtctcttgtccctttgggctcccccagctccatttaataccgttcccaatgtttgtacctaattacagatttgaggagtcataaaaccacatctcccaagaggtagatctgctttattttggcttctgtgacacctgattgtcctctttcttcattcacctttaatgatttgcttccttttgttgcttatcaaggacttgtgctcctgaaggttctgtccttgactcccttgtcttcccccaacattatctttctggacaatctctaccaccttaatgttaatgagcctcaactccaaattggcagcccagatcaccctccagggctctggacatgtgtccccagctttctattagacatctctacctacttgtcccacaagaacctcaaacaacaaacatctaaacctgaatttatcctctgctccacaaaagtcacttctctatttctcattagaagtatagaaatggaagaatgaaaaacttccatccattctatcacttggtattaacctagaccttttccccttgctcaaccccatctctccttttgccttttaccacgaatctgtcaccagatcttacaattctacttctcaaatatctttccagacagactcttcctctccatgtctactttactgccctagttcagggtttcatcaccttgatctggcctttgatatctgcctccatgtgtccaggacctgcatgctaatccctgaaagaaaacctggatacagttttgcagctgaattttattttaatgaaatctgcattcttgtggataaccttccaacacactacttcagtaatatcactgactgtagcaataataataatatcagtgactataacaaaaacttttggcttaaaaaaaaatccatttgcaatgacttcactttccgaagttctcaactgatacccagagccattctttttggtcatatgccaattttgtgagtaaaatatagggtttctttatgaccatacatttcctatgatggcgagcttatgagggtggtccttcatgcaagtttctcatctttctatagcctgaaaagtactgattctttttttttttttgagatggaatctcactgtgttgcccaggctggagtgcagtggcatgatctcggctcactgcaagctccgtctcctgggttcacgccattctcctgcctcagcctcccaagtagctgggactacaggtacccgccaccacgcccggctaattttttgtatatttttagtagacacagggtttcaccatgttagccaggatggtctctatctcctgacctcgtgatccacccacctcggcctcccaaagtgctgggattacaggtgtgagccactgtgcctggccttgattctttgaaaatgaactctttttggcaccctcatcttctgccatcttggtccattttgcttatcagagtaaatacaactggtaaaaaggtttatgctatttattctccctccagtcttggttcataacatgctcagttaaatttctccctcattgagtgtctcctcaaagataaatattttaccttggaaagtctggtcatttctaaggttaggaaaatgctatcagtcactttggagttgattgcctatgtcaggttggcattcttggatgaactacaggtttaagatttgctgttctgcatgcatcactgtgaagtcatctgagatgggcgctgacctgtagctcacaaggagtttcaaggtcttctatcatcctcctttcaaacactcacagtgattaattctccagaaatcactactggtgctatcaccttcagaaaacaattttctttctgaatacatgtagggtatataggcttctctggtttggtttgcatttcacattagcctttttttttttttttttttttaaattccaaggaactctaccttcaaaagcaagcaaagcattctcctcccaggtggcccatgtactggattttggagtctgaattgttatttcctcactcctgccttcctctcttcttggctttctttctagggcacctgacgtccttccttattactgatggcagcagagactgaacccctgggagaggaaagtgaactgagtaattgttttgccttttcatgtctgatgtatcactctgggtcagtgtagctttagttgaaagagtaatgttgttacccaggagcagctgtagtgtctccagacaactccaagacctctccagtcccgcagaggtcagtttctggtctgggcataatggtcttttttccaggggttgaagcccagctagaagcaaattcctactctgatttctcaagactctgaacacccacaccggcccatgagggcagagagtggtggctggctttctaaaccagccttgtgtcttcagagtccttgatcagagataacttggggaaagctgtgtctcataaatccactttgctactgggtcagagagatgccttgagaatgaccttagctagggaagggatggaatattggtttccctttgtcccctgcccttcagttcatggcatagggttaagagagtgtcaggagcctgcaggcctgttctgtgcttagcgtggggagacatggcagcaagttggcaagctggggtcttcttattccaaattcaaccatttcttggcactttttttgtttctttttctgagaggtagtagacagtggagctaaataaaattttctcccaagaaaaaatggttagaagcagcgtgtcccctgcccaggcctgaaatctcttcattccctttccctttccccagggttcccaaaggtcttctgcattgcccacctgctgctctctttcctgccctgtttgttttgatggcattaaaaggcctgcctgcctactttacaaggaccctcatttctttacccatcatgttttgatatattttttcttgctttttcttgaggtttgcaatcaagagccctttaactgaaatcctgggctgcctgcagcagctgtggggttcccagccaactgccttgtcctctgagggataaattccctttgaccgtgccacttgtgaaaacacagagcaagtgtagagtattttacatataatttagaaagagagaggacttatcggtgggtggtaggaaaggacagaagatggattaatattttttctttatcacttggcatgttaaacttaattatatttcttgaaagacctctaaacagttataattagaaattatgataatagctgcggttgccttacacatgttcattttactgcttgcttctttgtgaatgtgggctgtgattaataaataaccaccaacatcattaggacaagacctctccttgcctgctgggacccctttgactttggatggacagtgtcaaggatcaggagcacctagactagccccatgagccatggccttcataggctagatggtcattggaaatgaagttgttggcaccgacagtcacagttatgaaaataagaatttggatctcagatttttctgctccctcttctcctgtgtattagtccgttcttatgctgctaataaagacatacccgagactgagtaatttataaaggaaagaggtttaatggactcacagttccacttggctagggaggcctcacaatcacgacggaagatgaaggaagagcaaagggatgtcttacacggaggcaggctagagagaattagagccaagtgaaagaggaaacccattataaaatcatcagatcttgtgagacttattcactaccacaagaacagtatgagggaaactgcctccataattcaattatctcctaccgggtttctctcacaacacttgggaattatgggagctacaattcaagatgagatttgggtggggacacagccaaaccatgtcatcctctcttggtcatttgttttttttttttttgatttacaagtatcgtttattcactcacttatttttgtgcagggatgacaagagagtcacaggaatatccctaaatacttacggtatcattgtaaagagaaataacccaagaagagagtgaaaaaagaacctcctaaccaagggctgcagttgagtactaactactctgtggtgagaaataggaaatttagtattaagttaaagcaaaatcctttttaacatttctgaggtctattctcatgttgattataaatgggaaaagtgagaattagcttacttctaacctagctgcctgtttggccctgcaaaggattttagagatccccttcattctgtttattttatggaagaggaatttgagtctggaggagttaagacattgactgggcaaagaggcccaaccactcatgttcagacctccctgtgagatgccatataagaatatcaagagaaaaccttttaccctctaggctgttcaaccttagaaattcataagagcccccttagtagtcaattatgaatgataacaataaagatccatgttcaaagtattgaaagcactgtttcaataactttcttacagcatgggtgtatgacagaccagagactaaatacggagtcctaattctcaagacagtctcaaaggatattcaagatcaaatttagaaaatatattgtcagaagcctgttccccagagtcacattcaaagatttttctcagagaaattttcctaaaggcatgattctaaagagatctagtacaaggcaaaggatttcgattttttttcccctactacttcctcatctccaccccacaagttgacctggagtcatctttggtccttttgagttttaagtcatcatcttccctcaggctcaagaggaagcctgctgtattttgatgagacaactcacctttgatgtcacagttttcactcttcaagaacaaggagtcattagtatcttgacatctaactgtataagttaaagcacttcctggaagctcaaagggaaacactgaactcttaacacacagattctgctggaagtaaatgactctgccctataaaaggaggagaaagaaattctatttgagtaatgccgttgaaatattaaaagaaattcagagggaaaaatatccaagtgaataatatatattggatctctggcctctaatttgacattcaggtcagatcaaaactaaccctgtgagattctggaatttaatgtcatataaaaatgctactgggcaaggaactttattacacatgatcataaaaatatatgggaggcgccatctctgggtatttttctatcaaatctttactcattttacagtctttacaaacagaagccagaagtgctatatttgaacatctacatttgttgggatttctttaaaaaaaataaaacaaaaagaagaatcacattttatacgtgttaaatggtgtagtagtaaaccatgtttaaaaaagcttcagttttcattggtgtacaaagctgctacatgtaaatattggaaccactttttaaaagaggattgctgcagtcagattttttaaaataataaaataatcacaaagttcaacatatggtgtcttcatgtgattataagtgtgcgagtgtgtatacatgtttttaattccttaggattagcagaatgacaaaatgtgtgaagaaggatagatgatggttatttcaagcagcacaagaatttgaggaggaggtggagactaagaagagagaggaaaaaaagatcaagcaggacaagggacatgggtacaagactagaagaaaagctggatttctttaaactagaaaaatcaaagacatctgttccccttatggcaataaccacatttttctagaaatttacacattaacatctaaaaatggatttgtgctaaaaatacaagctatgctcaatgcatgactcttgaatgactttcccctatgattcctctgtagtcatatggcaaggccatgccctcatctgacattttttttagtcaggaaataccaacttcagttttctttgatcatgtgatttccttggcctggaaactcttctctgtctttccccctaaccaactcttactcattcttctagactaactcagctctttaatcactgagaaaaccttccctgcctatctttgtcccttccttagttttactgaatttgcctgccctgtactctgatagcacattgtatttaaataaacacttacggtctctcccgctaggctgtgaacttcttaagtgaaaagccatgttttattgaaatctatatttctggaacctaacacagtgtcctagatgctcgataaatatgttttggactaaaatatgctgctagtttaatgctccagttcctgatgaagccagggctttctttcccaggagacagtcaactcagggggcatgtttggtttagtacctgccagcgtgttgttgacaaacaccatatactctctgttgcaaagccaaaacatgaccttttccacaaatggagtaagcgtttattggggaataaaaaagtatgatgattgtttttaagtaacgtataaacctaagtgtctcaatagaaattgtgagaaatatttatttactgcgagagaaacattttccttaagctttcattgttttaggtagtcttcgttttcctgttccccatcctcctaggttgaattccctgattctggctggcatgctcataatttctatgatcacagccccattgtctgttggagctgagggcattgtaagtttttgtaagcagcctttgataagttttagaggtgtagagaaagagctctgtctcctccctgggagaatactcctttccctacacctcagaggaccaaatcatgtctttattaatatgaagcattcattccagtggcatattttattcattacaagaggatcagtagtttgagcaatcagagatgaattctaatatatggaatcctttcccgctgagcttccatgaaagcatttgatcctttttggcctgccccctttgagctggctcctttattaatcctaaaggaccaaggtgtaagaactcaggcaggacaactgtctctttaggcaaacccaggctttgatccgcttccctgacacagtgatctcacctcctttggctcagtcctctccttcgtcattggcccagctatgagtctggaagtccccacagtgccttctttgggtcaatactattatcgtgcacctgctatttgcctggtgctgtgctagagactcaggatacagatgtgtagagggaagagtgtttattcttgtgaccttatcatggagagctttcagatgagatttattcctaccaaatttattatttgagtgaaactgaacagttccattctgataagtaagggaagaaccaggcatactatgttgctattctccacgatctgtgttaaggtttctgtggatgtgtgtgtgtgtctacttaaagaaatggcagtctatccctcttacatcctcagatattcacagagcccctcagtgacattttttggcctaggctttttaacattctagagtagaagagttgactggtaggaacatttctaagtgctcttttgcaccataaagcaagaggagtgtagctgttaggggaacttgagaagttggttagtgtgtaagtgatgtgagaaaattctaagttttccagtttaaaaatggagacaggagggaaatggccctttgttaagaaaataatgttaaggtattaagaaaacaatattaaggtataaagaaaaccagagacatgaaacagaagttggactctgagagtcttggcggagatggtggtagttttagcctgcataggtctgggataggagtcacttgctgtccactggcatcagaggacacaacggagtctttgatgtgggtctgaaatgttacaacttcccacccccacttaaggatgcttggatggagaataagagatgtcagttgtgttctgaaaaccctaacctagatataccttcagccaaaagagagacatgctaccatggttatcatccaaagccactctgtagaatatagcccaaacatcactgtgtattaaaacatttctctttactgttttcacataaatagattaatttatacagatttgtatttatttacatatttgtgtatatgctgcactaaatcctcactagtgggacattgtttaggaatcctggtacagggtgtagtaccaacaaggaaaaccttcttattaagctcagtgtcacttgatccattatatttaatgccaggaagggtatatatacagatttagaaattaccttatttctttgtcgactgagatgggtaatctactcaataaccatttaatgacaatgcacaatgttccaggatgcagaattgaatagcctagcctgggtcgctcccctctgagaagattacagtgtaatatgataattattaccatagtgctacccctggggcagaggacactcagagaaggggtatctgatttagacatggggatcactacagctgcctggaggagaggaagcttaaactgtgttgggaagtgtgagtaggacacagattggtaaggtgggggtggagaggtattccagaaaaagggctgggcatagggaggcttgtagcaatctacaatatttgggaagctatgggtgggttaatactacgggcattaagtatgctttgggagggagtgaatggggataggattcagggcacagctgggccaggtcacgaagtaaataagatcagaaagactttgaatagctcagtcaggatggagattcatcttgaaactaatagctggagaccttgattgacttgagaaggaagagaatcatgtgatcctatttacacgtggaaagatcatgctagctgtcatttggaggaggaagtagttaagggcagggtagagataggcagatatcatgagataacctccatgaaaaaaaaaagggtgaggtggcacaggtgaaagtaaacttaggaaagtaaagccaggattctaatgaaagatgttattaattaaacttactgtttaggaggatgatggagaaacccaggtcctggcaaaaacggtcacactactttaaagtttgggactaagaaggaaatgaataggatatcatgaaagtaggctctgtgattttcttagtttgtagggagatggtagaacttagtggttaagcacttgagctttgagctctgaaagatgtgagtggattcctggcctgatctcatactagctgcatgaccttggttgaccttcagcattctcatctgttgaatggggtaataataatatatgactccaggagttcttgtgagaatttaatcagaaagtacatgttaaatactttttggcacctagtaagtgttcaataaattaccactttgcttatttttataattggtaattaaaagccagcaaaagtatgcttgtagtggaaaaggcactacaggcacaagtactaatggggcttgggctgccaggaaaataccctgtgatctccttctgatacctggcacacaattttcagggatcttggaaaacgtttacctcatatgcaagtccatgcatggtaccagcaaacagggatccttgaagaagtgaattcacagctgtctttaccttctactatgtaacagaatgtgagatagagagaaggagagggaggagagagggagggagagagagagagagagaggagagagagaaagaaagtgacaaattagattatggaatggaaagttacatttgggaaggtgaagagttttgtcaagtatcttagcctttcttagcctcattttaaaatgatgttggactaagtccagctgcaaactgacagcccatgcaactagcacgtggaaatattttaaaaagctgagccaacgtttaaaaattggaaatttgtcaattgaggtagcttcttccataataagttcatttttattatttattcaaagctaaataattttattcaaaaatagatttctggattctgttgaaaaatcctaagatctggccaaccaggctcctgctcttccaagggcgtaagcattgctgccccttttgggcaaagaatcaggtttctaggtcctcaaggctcatcacttggggtgtgtgctggtctctcatgccaggtccccttctcttatttgcaaactgtctctgtttgatattaaaatttgtaatggggaaacactcactggtttctaaaaccctatgtagatttaagtagttgatgattctgtgaaaaaaccaaataccttctagagaaaacatacaggttgggcagagcccaggtattgatgtccttgatgaaactggtttttgtattctgaatgttggagattgagagatccaaagccattctctaaggttgacaccaaggtgcaggtgaaaccatggggggcaggtgtggggagaaagggaaggagttgaaggaagaaatctacaattactcggaactccacatccactcagctgctgtagaatatgagttgagaggaaatgcagaggagaatctgctgcataggaccactggaatatagattgtgttttggaaatgactgatttatcaggtggaagcagagaatgataagccagctccatgctgttctctcctttgtcatgttcccctgcccctggcccttggccttcctctcacttccctccctgacaccccaactccatgcagcatttgctccccctccacccaactcctccttgctttcctggcaggttcaccaagaaacaaccgggcctccatggcaacgtgaagacagctgaaaaatggcagctaaatgcagctgcccctcatttaatatcgactctggcactgacagaacagataatgggcaataacacaccattatgttgtgggaaaatgaaatgcttcagcagaaggctgtcatgctggggggatttatttgttactgtaccagcaccagtttctatttacttcccttccgttctttttgttccctcatttccatgccagtttctccctcctcctggtttctctcccattcctcccttctatagcttctcttttttgtacttcctttccctcctcttttttttttttccttctctctgaatcacttatggatataccagaaagcatacatatataatgcaattatttgcatgatgacttacaagttccaaagcacattcaaatacattgctttttcatttggagggtgaggcaaccctatgaagacaggtagggcctagacactgatgtttattttgcagatttttaaaggggctcagagaagttgaacccaagatcaggcaagtaagtgtcagcagctgcattgcaagtcagattttctagcccctagacaggactctttcctttctacgacatgaaaaacttcagagtcaccaatttctacccactttactagcaccctatcttcttactgaataatctgcaggtgcagagaaagtcttctaggctttgagacttcagaaggtctttagatctttacttatattgccagtcacttacagattcttccagacaagtgcctttgaattgttgataagattggtttatttttgttttcatttttactctttaaacccaagacgtctatctgctcattacctcctattgcatcattatataatcatgaaatcttggtatgcagaagggcgtggtgtgctctttgacttgaaagtgggggcattttggtggccaacagctttctgttttgcaaaagaccgtggtacattgaggtccagaggacatcactgatggacttggcatgaggaaaacccttctctaagttgttgctgtagtttaaacttgctttcttacatcctgttggttggattgtcatagcaccctcatcttctgttgaaatatcatttagtagactctaaattctggaaagatctgagatcaagtttcttagttctttgggtcttgaaaggattacaaatggagtgagaatggctattgcaaacatgttttcatttctagttatggctggtgagggaagaactaaatgtcaaaaaatatatgtgtacatctgtagaaggtacagtatgagtaatgaatatagtggttttcaatcatatgaaagaatgatttatattgataaagagatcaatgtttgtacttcccagcaaatattttttaacctgggatctctgagccccttgaaaacatgtgcaaaattttgtatggataaggcaatgcagtgcagtgtttcaacccactgatgttgaacatactgaccaggattttggctctgccacttgccagatttgtagctttagaaaaattacttacactcttcagggcttagatttttgaactagtctggtactcagttgagatttgctattctgtattgtttcttttctgtctgtaatgctttgttctcattcctgcatactgaaactcttcctgcaggtttttctctctggcagccatccccagttttagctgtggaaactcaagtaggcctctaacaaaatgttctgtggtggtgagaaagctaaggaaaaccagctgctaaaattacagcaagtctctggttgctgttgcttggtttctttccctgtatagttatttcccgtgcatggttcctcaaagtgaaatgaaccttagtgtcatatcacataatcatggaatgttagaactggcaggaaccagagatgattccatttctgtggtctgccagttcaaatccttgctgtgtagaaagcaagtccttgaccaaaggcctgccttgccaatcagcctccttgctattaatatattgtccctctgactcctttaacttgtttaattgcgctaagttcttaagtggatttactgccattccttatccagatctgaggctgtatgatataaagataactagtgtttgtttagtatttatgccattttagtagttatattttattcttaaaaagtaaaagtgactggttcaggaaataagtactctcaggattgagacatatttttacatgtttcattattttgataaattttaaaattagattttgtattaagaagactgttcagaaattatccccattatctcatttttattcattattcaaagaaatgtaagaaaataataagccctttatctagctattggaattttggaacttccgaggcaactgtgaatctcaagttagccagagaaaagggggcacagagtctttaagcaagaggagaaaactgtctcacaaccatagtttttttttttttttttttttttttcccttggaaaggaatagagctagccagaggacttagggtctagtttccataccaggtgggagggttagagacagcaagtgaaattggtggagaactttggaagttgtcaaatcttcattgagtgagaaaaataaagccgggacagaagtaccccaaggaagaccacagaaggaaatcctaacagaacatacatagctcaggagaccagaatcttttaggtcaaaagcaacaacctcaagagaacttaagaaaaccaagtgcattcttaaaccagaaaagtacactcagaaatcacggagaactcaagcaaaggactttcaggcaccaacctctcttacaagctctattatagcaccagtgaaataattgatattcatgaagatcatacaattttagactctttgggttggttgtagcttagagattatctagttcagggctgctcaaggtgtttcctgcacatcagtgccgtccaagagctgtttgttactaatccataaggatataaatatggaaactgagagtaagcatttaagcacttttgtagtaattccatgtgtgggaacacacaggtgagggagagtggactggtctcattcaagagggtgtcaaacagttcagcattttaaaacttacttggtgagtcatatgtggcatgagctggtagttcttcacagtagggcatgtattgatctgaaaggatggaaaaatctaaaaaacaaaataaaacaaaattggctgtttactaaaaagatcttgtgaagccccaatctagtgaaaaagcctacttttacatatgaaaagatagatgatttatccaagaaaatataaaaagatgatggcagaacccagaatatgggattaataacattttattaattaagcaaattatgcccaacatactctgcttcttaaaataggcaaagcatgcaacacattgtagaattaaaaaaaaaaaaagacaaacatttgagacctgtgggctcttaaaggttgaatcattcctccatggacttcacatttcaaataagattttgctatatatacacatacaactgtatcaccccacagaaaacatattttgcacttgaagtttgttgatctcttggggcattattttgtttctgggaattcttaaagaatataaggctatgctggatggcaattttctgggtcaattgtgcccaaggcactccctacagcaaattaggtaatgaaacaactcttgtgggcccttatgatgcaatttagggcactatagtggtaatagactagctgggggctcagcagctagtggaactctagggacctcaaagcatgactaagccttcttcagtgcccagttttctgccgtgggatggtgttaggcccgggaagaacagagcctaaatgcacccctctacccacttccaccgggatcttgacgaaggtagggatgctcctcgtatttccatggttagattaggctaattgtcccttacaagttgaggttttgaaacaactggaagtggatagaatcacaatggtcatattaccatgataataacaatatcttacatgtataccattgaacttttatctcattaggtcctcactatagtctcactataggccaagcagctacttttagctgctttgtaataagtaagccaaataaaggctcaaagattgaacagatttattgattttacccctcagttaaaactaagatccagggccgggcgcggtggctcacgcctataatcccagcactttgggaggccgaggtgggtggatcacgagttcaggagatcgaaaccatcctagctaacacggtgaaaccccatctctactgaaaatacaaaaaaaaaaaaaaaaattagtctgttgtggtggcgggtgcctgtagtcccagctacttgggaggctgaggcaggagaatggcgtgaacccgggaggtggagcttgcagtgagctgagatcgcaccactgcacttcagcctgggcgacagtgtgagactccatctcaaaaacaacaacaacaacaataaccaaaaaaactaagatccaggatgggtacagtggctcaggcctgtgatcccagcactttgggaggccaaagtgggaggattgcttgaggccaggagtttaggaccagcctggacaacatggtgagacacagtctctacccccaaaaaaaacaaaacaattagttggatgtgggcatagtggcatatgcctgtagtcctaactactcaggagactgaggtgggagactaaggcaggaggatcactggagaccaggagtttaaggctgaagtaagctatgattaaatcactatactccagcctgggtgacaaagcaagatcatctccaaacaaaacaaaacaaatcaacaaaaccctcagattcatccccatgtctccatctctactgtcactatccaagtccgtgccgccatcactcatcacctgcataactgcagaagcctaccaatagtctccctgactcactcagctcctccagtggattatttacatagcagccagagtgatctttttaaagtataaatcataccctgtctctctaagcttaaaaccctttaatggtttccatttttcttaggataaagtccaaacttcttggcaaggtttgcaaagcccagcaggtagcacttggccacctctgcaacttcctcttacactgctctcttgttactcttggtgcatttgccccattagccttcaaattcatcaagctcttttctgctctccctcccctcccaaaggctaactcgtactcatttgcaggtttccgtttaaaccctgcttcttcaagagcttccttaattcttcatctaaattagctccttctactttctctttcctcttattccaccctgatcttgtctccacggagtttttagcacgattcaaagttacgtccatctgtaggcttttctttgtttgagggccgtctccctcactacaatgcaagattgatgaggacaagccctatgcagctttgttcaccagtgaatattcacacatagctctctgcttcagagttctcttgctataaatatgtgataaataaaaaatgagggaatgataggcccaagagggcacagatgggcaagggtgatgtgagataatgcactctgcttctgaaataattcctaattacctttggttttgttcttaaaacacaactggagttcttagaagaaatatgcaatctggcatatagtaagggctcaataaatgtttgaatacatgaattaatatgtaatgaaagaatgaatgccatcgttacaaattagctgagttctccatgtgtttgtaatattaggatattactgtccccaagttgcattatcgacttcctggctttcagtgggcccagtgtccccacatgcctgctcaccccccactgcactaacctaaataatctctgattattttctttttctcttgctactaccaaattctgttctgagtgaggaagcagcttggttaaaaaacaaaagccctgatatgtatatatattttttttcctgaagaataccatcaggatgaaggctatgattaatacacataattgctacaaatggcagctaactgcagaaaaccacctcccagctgttggaggaaggaaattgctgacagccactccccattgggtggctaccaaaagagaggagctcacaggagcaggagagaatacacatctccatcccacgtgacccatagagatgacccatagggctctgtcttacatgtgagctttgccataaaatggtagtgttaagagtttttagggctggggtttacagccaggctttccatggctggggctggttttataggacatgctgtcctgcagaatgaacatttagaatccctgtggcccagttggtattactgcaaaacccaggttgaatcccttcaggaggagacagatgattcttggctggtcagatttcttctctcatcctttccttgttcatttgccctattctaatgggatggggaatgcacaaacaaggaagaagctctgggttgcttcttggagtctgctttgtgacctgagctcgacccttcactttcctgggcctcagtctcttcagtctataatgtgaggtgttagactagaagatcactgtttccttaattttaagcatctgtgttacaaaacatacgtacaaagtatgtgtacatatcatattaaaatgtatataaagttatatctatatctgtctatctatcatctattctctagtttctattagcttggtgcaaaagtaattgcggtttttgccattgaaagtaatggcaaaaaccgcaattacttttgcaccaactttgtatcaattatcacctatttatctttcaacgattattcatcatctatccatccacctatctatctatttatcaatcaatcattcttatgtatctccatacccccatcttctctgtctactgttttacagttagcacccgaaaagttatttgtacttgtgttagtgttaacatgtgtctggcttaactagtcccttgttcaggtgcaggaatttatcaacatataaatcagaagacaaaaaacttcaagcctaacacacttaatgcacataagcttctccaggccaccacttacagagttgtgctatacctttttttttttttttgatgtggcaaaaacaaaacaactcagcagctaaacagatgaaaagccaagctgtgggctaaggtatgtatttgatgaagctctctcttctctagatctttagtgggaagagttttgccacttgacacatatttaccccgcaaacctacactggcaatgctaaggcagtgagcacagaacacaggcctgaagtgtgctggaagttagctgaagggcaatgtcagcgcaccagctttgaaattacatgcagcgcagtcaccgtccctctggaaaactgtgcattctgtgaatgctgactctggaagtgcacacgctgagcatcagggctggaaaacagctgagagagaatgttctcccaggagaacaaaccttagcgagcttcctccatgtgttctgtacatctgcatcatctcatttcatcttcaaacaatccatgaagtaatgcagtcttctttatatggtaggaaaactgaggatcagaaaaattaactgattttattcaaggataccctgttagttgcagccactggtggtaacattttttagtgctttggtgccaaaaaagaaaaaaagaaatttttgtgctccaaataaaagaggacttctgtagaaattaaaataaggcattattagaactttaggaattttgcttctttctttgtcctctgattattcctgtgactttatgtatgaccccttaatgcaatggctgtgttctaccagttgatttggacatgtacatagttgaccttcaaacccattactgttgcatccgagactatccccttgaggagttccatcagggagggaggagcatcgtctagaagtcagaagtctttgcctgctgttagtattctccacagagctcctcctctccctcagttgagggtcacaggatgttagagaaatcaaaagccactggacatcagggaaagattgaggagcctgttacctgtcaccttttcatttagacggccttgcttctaaaattatattctgaattttccatttattcttgctgctatagactgaatgtttttccccctcccacacccactgttcatatgttgaagccctaatccccaatgtgatggtatttgaggtaggtagggaggtaattaggtttagatgaggacatggggatagagcccccttatgggataagaaaatgattataagaagagtgctcgatatggttaagctttgtgtcccacccgaatctcatcttgaattgagattcccataatccccataatccccatgtgtcaagggagagaccaggtggaggtaattgaatcatgggggttgctccctcatactgctcttgtgatagtgagtgagttctaatgagatctgatggttttataaggggctcttgccctctttgcttggcatttctccttcctggcgccttgcaaagagggtgccttgcttcctctttgccttccaccatgattgtaaatttcctgaggtttcccaagccatgctgaaatgtgagtcaattaaacctctttcctttataaattacccagcctcaggtagttctttacagcagtagaaaaatggactaatataatgcccttagaacaagaggaagagacaagagtcttccctttttctcggccatgtgaggacacaggaagaagatggccatctacaaatcagaaagagggcactcaccaggcaccgaatctgccagcactttgatcttggacttcctagcctccagaactgtgcaaaataaatgttggctgcttaagtcacccagtctatggtattttgttacagcagcccaaactggctaagatactgtcttgtaggtgaaacagggctaggagttattttacaggcataaagttacctgtttttacactcttgagaatcaattagtgggttggtatactaatggtagggtctaaaaaaagaagaaaaacaccaaatgcatttgaagcgattccaactttgggacactttttattatttcagacaaatgcagatagaatgtttactgaggtgtctccctggccctttatgtaatatttggatagcgcaatccttagctgcatgcagataatgtgttaggcagctagaaaaataacctgcttgtactgtttctgatttattccccctcctccctcacgtctttgttcacagtaaacacatcactgcagagtagctagcaaatgaatgcctttttatcagaggtacatgcccagttggtggctacgaccacatagaacagcagatatggccaaagggggaatcactgacaaaacaggcagaccctcacccagagtggatggtgtttcttggcatctgagaatcagaatatagaggaagatgaaagcactgtcgtgtttacggtgctggaaattatattgaaactcaagtaaaataatgatgctgctgctgctgatgatgatttgttgagtgtttactataggctctgatctggcatgctttccatgtataatttcatttatactttactacaacctcaggtgagagctacagttattatattattatacctattttataggtgaggaaaccgagacatagagagtttaaataacttgcccagtgtcacataggttaagaaccaggatcaagataagagctttcctcaactacccaggaaggaccaaacaagttaagagtctccagaatttgagaggaggaattatgattctggaagttccaatctttctctccagcttcagaaggatcaaccaatattttaaaggaatgtttaatccttgtggtatgagctgttggggtaagaaagaatatgggctggggtgaagattgaatatgagccaagttcagtctcattacaggactaggaagacagagaaataccaagatctagagcattgagggatattttgatgaagctctgttggctcttgcatggtccacatgaatgcaaagcattcattttttttctagatgagaggcacaaagaaataagacagcatttttcttttttcagtaaaatccctttagttttgactgcactaattctgtattttcctaatttagtcatgttaagctaaaatttacctttataccatgtaggttgagaggaggatttataaaacaaaaagagaaagtggtcagcctattctatcggatcaaatcagtaaattactaccaatcttcactacttcaggacaattattttattcaaataacaaatacactaattacaaatgaatgtccatttttaaatcacttgcaagagtcccacacacatttaacagagtggttttcttttctttaccttatgttcttggagataataaatcaacatttccctcagaaagcatttgttaattttttattcaatcataccaatcttttgcccaattaggaggcattagtgtaattttttcccattaaattgtacataagtactgtcgtccttgtttgaataattaactttcacctagatgccctatgtgtttcggttgatgtatttgctcacttgcatctgcggtttgctgtagctttgaaactactgacactttcaagcaagatggactaatgtctctgaaatgaagctggacatttggatttgtgacagtgagcttgacacttattaccttactaataggtagtaagcatataccaaaatgatttacatagagggtattagtacctattagtaccttactacctattagtaaggtaatatgtgtcaaagatttacatagagggtatatgcttactacctgttagtgctaagacattggttctgtcagatgaggattttctgattggcaactaaggaagttatgttcataatttaaagtgaaggggtgggatgggatagagctggatcaatgccccatggtactacagagtgagtgataacttggagaatattgtccccctgctccccacccagctgccagtttgactagcctttcaaatagcattcacttgtcctcaattctcacccaagacaaaacacccatgacttggaacaataaagcaaacatatttccaaaatggccatggcagaacagtgaaaaggtactttggtatatctcatgccacatttcacagatcttctgttctgtgatggtttatggaagtgaagtactttattatgtaaaattcatcctgttttttgtttgtttgtttgtttgttttgttttgtgatactacagatccatttcactatagccaaaggacatgcgtttggggtctggggatccatcagaggattcttctctcttcttctggtcccacaaagcaatcgtgagctttagaaaggaatcctaggaaaagtgaatagtcttccactgacatctgctctttcttatagcttacaatgaatactgcctcttaaagtgtcttcttaaagtggcacaaagagagcacctctgtgagtgcagggtgattgggcacgcagtaggagaagcactcagggttagcaagtgattttcctgacacaaaaccatttgttggcaagatctgtgggagaaacattctggattttgtatttcttgacctttccgtgctttcatttggtaaactttgcaaagcagaagctttatcttaaaagttgttgtggttttgtattaagctcttttgaagtaactgatatgacttattttgctttaagacttaaagtgcaatttttaataagctggtaccatttattaattacttactaatgatcccagcacagtgctttctgtatattatgtctcttcgtctctacaaaaaaccccaggacttataaattattatttttctctaatttgcggatggctaaactgaagcttaaagagattaagtaatttgctgaaaatcacatgacttctaaggaaggttgagattctttctgactccaaagcctgagcattatttcatcactgccttcctttatacattatgtatgttaattcaatgttttcctccctctcaggctacagaactcagatttcatgagagtttagagttctagtctccagagtttttcagtaacccttctctcttttcagtagaaagggagagttgttttaaaaatggataactacttaagaaaggcctttgacaatctctaacgtgtgaaaaattctttttggccactggcttctgatgactcaaattgtcagttgacttgtttgctaacatgttttagcttccatcactcccttccacagatggcatgaagaattggccatagtagataaccatgctacagtagatgccattcatttattgccattcatttatagcaaatagccattctatagcagatgccattcatttattttattttatttttattttttgagacagagcctcactcagttgcccaggctggagtgcagtggcgtgatctcggcttactgcaacctccgcctcccaggttcaagctattctcctgcctcagcctcccaagtagctggtatttataggcacacaccaccacgcctggctaatttttgtatgtttagtagagacggggtttcaccatgttggtcaggctggtctaaaactcctgacctcaggtgatccgcccaccttggcctcccaaaatgttgggattacagtcatgcgtgagccatggcacccgggctgatgccattcatttagagtagtcattctttcatagtagacagccattctgtagtagataccattttctatagtagcactaccccttaccatccgactagaagaagaataagtaagtgattagaaataaggctcctggttatagggtttgttacccaatgaacatgatgacttgattagcgtgccctttcagcccaatgtaggattttctatggactatgattgagagcagacacctacagatttgtttgctttacatatatagctgaatagtcaaaatgctatatccacctcaaatggagtcaggataagcattatgaaaagtcagaattggcagttgctaggtgatgtaatttgagggacttcatggagcataccctccaaaaaactcttactgatgcctgaaatttcacagttatgtcttgattacattggattgagcaacagcccctcctttaaaaaatgcaaattcttctcacacagggaggtagctattatgcccctgacacactgggtgcttattaagcactcgaagcagaacagaggatgtggatggatgaggagatggaaaaagttgtgcagtgaacagtttccctgagagctggcatggcaagaggggggcggtatgcccactgcacaggggcggggccaggtgctggatcctgcacagtgggaacatgctcccctctgccatcttttgttgggaagaggctcacacagcctttccagaagagaattgcaggaccaagcaaggtgaactgggaaagagaaggatctggaagtctaggatggcaagatagattggagagcaatacacagacaacctggggaagagacctcgcctgggtctgaggtgatggggtgggagccctggctctgcatctggctagctttgtaacccagtcccacgtctactgaccccttgacttcctgttcctttgtgtgtgtgtgtgtgtgtgtgtttgtttgtttgtttgtttgtttgttttgagaaggagtctcgctgtgtcacccaggctggagtgcagtggtgcgatcttggttcactgcaacctccgcctcccaggttcaagcgattctcttgcctcagcctcctgagtagctgggactacaggcgtgtgccaccatgcccggctaatttttgtatttttagtagagacggggtttcaccttattggtcaggctggtcttgaactcctgacctcaagatccacccgccttggcctcccaaagtgttgggattacaggcgtgagccaccgcacctggtccctgttccttatctttaaaatgagggcatttgactagggacatctccaagtttccttctagttatgaagaatacatttttttaaaattgtactggaatcttatgagaaacacgagggattattctttttgcttttaagatttatccatgatagagtataagataagccatgggacttgcttctctcccaactcaccatacccaaaagatattaatcttggtaagatcccacaaccaacactatgcttttgcaagagcatccaaagttgtgattttgggttttgttttgatttcttttgttggttttttaatttagcttgtgactaatagaaaaccagaaatactaatctcttacatcaaaggaaggttactggcaacctccttgtactctccagggaggcatggttctcttggacttagcctgggttgtctgcatctgggaaggacttggacaggaaagagctaggcataggagctgaaagggaaccttcttatcttcagactgggaggacacaggttatatcctccatcagaggtgtagaagaaatgatgctcaacaatcagtcacatcctcagaacttccccaggcttgcatccctggaaagctgaagtagtctttggggcttcagagaaggcatcaattgatggatctcagtccatgtgtgtgtgaggctcaaggttacctggcaaggcagtacagggcagtagtaaagagtgagtaaaggatttggggtcagcaaaacctggttttgatcctcgatgctacctctttcaatggacaggttaccaagcctcaactcccatgtctgtagaagagactgtcacaacacttgtctctgagttgtgacggctccacacaatagtccaggcaaggaggtaagcctggtgctcagcattgaccagccatctagaattggtcattgccattattattaaacagtgcagccctatggccagtgaaaaacaacttttaaggcagcaaggcacttgcagcatccaatctggggaaccactcagaaccccggaaaggtactccagcaacacctgacccttctcagattcacttccctttacatagcttgttacgtggtgagctttaactacagtgcgcagctctcatctcttcaagggtgggaggattgcactgcaaatatgtctaaaaaggcacctgtgtcaatatagtttgtgtcatattcaacagggagagcaaaatgaaatgcatctttcacagatctgtagaaaacaatcatcatgggtgcttcctaaactccatccagagagttaaaggcatcaatcgttattattttttcccttcaaaatacatataaagaatttaaaaatacatataatttttgacttcaggaatgtatgtttgtttacaagtaattttattgcaaaatatcaagaatgttctgacctctatgtgaatggatgtacatatatctccccaaagtggtctatgtcaatgtcagataaaaagtcattcatgtatttcagatgagatggaagaggaaagcaatttgccaagtagtgatgacataaaggaatgtgcttatagggtcttcagagggctatccctgcctggagggtttttgagggtaggtaggaggccaggtggttggctcctctgttattgaaaaaaggagattgtctttcagagagcactgaggcctagagcactcttatcacttggaatgcccgtcagggctcacagagagtggagaagcattttatatatcacaagccattgcatgccataacttctccttcttttcttgtcctctttattttcccctaccagcatggctctcagatttattaacagccctttcatgccttctacagccatcaggaagagaaataaagaggtctgggagaatccaatcttctttagcttgtcctttttcactctcttagcttttttgtttgtttgtttctctttccctcccttcctccctccctcccttctctctctctctctctctctctctctctctctctctctcatttttattagactgctctgcatcaggctagagtttctttttcaatttccctcttctttcactgtttttaattgtttcagtgcctttgtttttccctagacttgagcacagtgggaaaggtcagctgtcagaagaggggctgtacacagctgataaggccttcaggagactggattggagtcatttaggcagcattctctccctgaagtcatagaggctacactgttgcagtggaaagaaaaaaagagctcaatgagtagaaaaggcaacttacatgaaatgagcagcttggctatgtgagcactaagcagtgcattacttacccagagcccttttccagaggcaggtgctgcccagtgccagctccagtgactctgggacgttgatggaaatgtgaatctggatgaggcacacatgcaggaggcttggagtaaggactcaactgggaattaggaatctaacatcctggaaatcaaagttgtcccctgttaatatatctgcttcatggttattttacaactaatgaacttatataaaaatcagaaagcctaggttctggtcttgggtatattgctaattactttgggaaagcatgaaactatactagccttgtaaaaagaagtagaaaatgtgtggtttttaaagcacttttcatagataatatctagaattcatcttcctgatatcatttgcaaagtagaagtgaggagcataccccttcttggacatggctatgaaaaccagttaattcctttttatgtaagtaccttgaggtaaacccaaagtcaaagcccttggaactcatccaaatagcctatgcaaaaattcatgatggagtgctgcagagcttttaaagaaatggtggtcatcttctggaatgggaaaaagaatagttgatatggataataccatagcattgcagagttctttttttttttttttttaagagaccaaatcttacgctgtcactcaggctggagtgcagtagtgtgatcatgactcactgcagcctcgaactcctgggctcaaacaacactcctgcctcagcctcccaagtagctgggactatagacacatgccaccgtgcccagataatctttttattttttgtagagatagggtctctttgttgcccaggctggtctggaactcctggcttcaagtgatccttctgagtcaccaggatttcaggcataagccaatatggctcagcaaattcttcatgttttcaaaacaatttttttatacttcacaataacctgatttaaggatacttcctaccataatgtacctgaaaaatatgacatgctaaaatgtgacagaactcctgttttcactgtcaacctggcacatgacaagtgttctcaataaaggtttgctgaatgaatgaataaaattattgagtgagtgggtaacttaaagccttcaagtaacacacagttaactatgtttatttggctctccctggccaaccccagtaatggttgggtacaaagaggaattggggtagataatgttggccataaaggatatgtaatctggttatattggtagttctgctgtcttgccatagaaaagggagccaaagggttttaactagagctctgtcaccttgggagaaccctcgggaaagaaccactgtccaggctagcagccacagaagccctagaagatcacacagtgaattgcttagcttctgctctcactgcagtgccttttacccaaaacaaactcttgttttggtaggagaaacaagaaggttggagttatacccaattctagcttcattctaaattcccttgtcaattattattctaattggatgaccctggacccctaaatctcagctcccctccttgaaaactgtcaataataatacctaaataggttgttgtgaagattctatgaaacattaatacaaagccagagctaaagccctgatacacaataagcttcaaaaatggtagctggcatcatcactatcatcacccccatttcaagggctctgggagtttcctggtatgaaacagtgataatgatgcttactgtttaaggttatagaattgaggagactatttgtaaagggcctcttgcgatgacaggcacgtaatagagaaaaaataagtattggctcctttctctctcctttcttctatgatgtcttcttacttttctactttagccgaggtagtggtacatcattactctttcataaagtgacacaatgtcattgaggaatgctcaaaaggccccagcagatggatgctcatagctggttgaagcagagttaggagggtagcatggaggggaaggaggaatgagcagcactcgggaatgcaagacagatcttttctgccaaacctggatgcactggaggctgccatcctaaagcttttgtgaagtttctgcctgtttctggagttatccatgtaatccttgagagaacacttctgtttgcacaaatcattccatacaacgtaattagctacttataatacagaggacacttgtgatcccaaattcaaacaattgcaaaagcaaaagcagtttattcatggtggtgtacaatgataattgataatgagctagatgactgtgaggtgctatggaatctcaaagactcttctgaattctcaaagggagttcaccttattcataggatgactttaggttagcagaaaataatgactttaaaaagtattataccataacaatgaatacattacttatattgttcatgtaattactagttcttcaaaaaccaaaatgccaaatttacaatgattagaaattaatagctaacaaaaacatcacactaactcgatgccctttatttgccaatgattctagctaatggagagtttttacttgatgtgctttattttttaccttctgacatctgatccatgtagaatgaccagccttcctggttttctaggaaccagctattttagcactaaaagtcctagtgaacttctcatttctaggcaaattgggatggctggttattctacttgaagcacctggtggacctcttttcaggacagcaccatgtttagactaacatctgactgacaactcaaaacgaaaagaatctctggttccagattatttataacttttggatcttgttgatgaagaaaatttttatgaaaaaagaaaatagagttgactacttttctatttatttaaataataacattaacaaattttgtctatccttgccatcattttataagacaggaaattacaaaaccaaaaaagtagaaaggagtagaatgtaaattttacaagggttccagagtgatgtgtttatcactatgttcccagtgcctagcagtgtgtggtgtggcatagatcctacataaatatttgttgaataaatgcacagtgcataaatttagcttttactacaaatgtactacactcttcttatttttctttctttctttcttttttttttttttttgttgtttttgagacggagtctcattctgtcacccaggctggagtgcagtggcgcgatcttggctcacggcaagctccgcctcctgggttcacgccattctcctgcctcatcttccagagtagctgggactgcaggtgcctgccacaacacccagctactttttctgtatttttagtagagacggggtttcaccgtgttagccaggatggtctcgatctcctgacctcgtggtccgcccacctcggcctcccaaagtgctgggattacagacgtgagccgctgcacccggccatttttctaaatgtattatagattgatgaaaactttcccttagaccattgcttggggatcaatagttgaaatctaagtctgtggactgtagagttttttgatagtaagtttttattgtaaattattttaatggcattctgttgtttatcctagtctcatgttcattatagttggtgtggtcaacctcccatgagataatcattcagataagaccaagtttccgggcctgtaaatcagagaatcaggttcatttaacatcctcttagatctcaacttctatcagtagcaagatacatctttgcagatacctacatggagatttcactacatctggcagggatgagccaccggtcctcattttcttaattcctggacaaggtttttgtgtattctaaccaagtattcttgcttttctttgttctgattcattcatctacaaagtgtggtcagaaaccttgaccaactgctgatatatacaaatatcacaacttctctaagtctgggatctcctaccacagttgagatatccaaatcattcacagttttgtcataactcgtggattaaaaaaatcattgataaatcatatccggtatttctgaagaggtttagaattttggtttcatggatagcataggaaatgtaaattatccatcacaaatgtctttacaagttacaaaactaaaccaatttgagtgttcatttcagagaggcttaatactctcagttttgttgtttcttttaatcacaaatcaactaaccatttccctttctgcagctaccttgcacaatccctgagcatatttctgaccttagccctctggtgtcatagctctgattctagctgtttggctttggatggggttgttggggtgttgcagcatctgtaaatggttaaaggagcattagactcaatgtatcaggctcatgcctgtaatcccagcactttggaggctgaggcggcaggatcaggaggatcaggaggatcaggtcaggagatcaagaccatcctggctaatttggtgaaaccccgtctctgctaaaaaaaaaaaatacaaaaaattagccgggcgtggtggcggctgcctgtagtcccaccttctcaggcggctgaggcaggagaatggtgtgaacccaggaggcggagcttgcagtgagccgagatcgcgccactgcactccagcctgggcgacagagcgagactccgtctcaaaaaaaaaaaaaaaaaaagtggatttccttatttatgctctcataattaagataattttagcatttatatcgtgtagtgaatatacacaattcccatgatttttttcctattgttttatgatccgtatttatatcccaaagtatatggttaatacctctaagtttttgctgaaaatctagccttgttgagcagatacaggttcctttagcagctggtgaagggtgcttatactttaaaaaatcagataatgtatgtgaaagtggtttggaatatgtgacatgctatgcaaacgtgtatttttttttttaaagaaatgaatagctcgtctcccacaggcatattattgacaggggtctttgcaaaagatacacaaacctaaataggaagcagcatgatctaatggaaagcatatagtctttggaggttaacattggcttgtattttggatctgctttcaactggaaatattagaaggatttagtcccttctgagccttagttttatcatttgaaaaatgggctagtaaaactttatttcacagggcttttgtgagggataaataagaaatatacaaagtatcctaataaaaagttctcatttcagatgaaatatgagcatgtagatatgctatctctattaataattcatttgttctgtgttgttttgaactcttgtaactttaaatcactaaaacaggttaattcttgtcaaatgctatttacatcgtgtttgtttcattgaagcataatacaggttcaataaatgttaatttcctgttctttgtatgctatagcaaaaataaaaaatcttctgatgcttaaaaagactggtaatagtcggctgggcgtagtggctcacgcatgtaatcccagcactttgggaggccgagacgggcagatcatgaggtcaggagattgagaccatcctggctaacacggtgaaaccccatctctactaaaaatataaaaaaataaaaaattaaaaaaaaaattagcctggtgtggtggcgggtgcctgtagtcctagctactcgggaggctgaggcaggagaatggcatgaacccgggaggcagagcttgcagtgagccaagatcgcgccactgcactcagcctgggctacagagcgagactctgtcaaaaaaaaaaaaaaaaagagactggtaatagcctgagatgaagaaatgacaaaaatgaaataaatactttcttctagttttatgcaccatattagtactataattgaatatgcaatcactaaagattttcttctttatttaggtttcttgaatcaggtcaccgatttttaagtctgcatccattttagagaactctccctccccactccccttcaacatatcccatcctctttcacctatccattcagattctttcatttaattatttcagaccctgggaattagcagtcccttcttgaaagcattggaatggggcagttttaatttttattagtatcagctttctcctcctcactgccatatttacttctttgggaggaaaaggaagtgcatatgtagctataaaagaagacatagcccaggtttctaggatttgcacctccgcattggcaaattttcccagtctgtgtctccaaacagggttttaatcacctgggctcttgtccttggcattgaaagctttaagagtactgcagaaatggtaaattaaccacatttaacaaaatagaaagttttcattgtgtcataaaaagccctattgatcttgttcaggcattgactccaggtccttttaacaagccactctgtctagacttgcaggctagagcccacagtgctaacaaaggaggagctgggctgccctccctccccctgcaggggaaggctaagaggatgggcacagattcaggcttctcaatggggattttcttaaagaactagcatgattttattctgctgtggaaaggaaaagcattaggagacttgtggcagatgtacctgtcacttactccagactccagccttgtttgactctctgtgtctgctgtggaactaccccatcataacagattaacgtgtcttccatatccctcagcttccagcaacatttcctcctgttgcccttaggaaggtaggctgaactctgatgccaacgcacggagcagtgggtctccagaaagagcgtggaaagcaacgatggggcaggaggaggaattggcaactttagaatcactgtgaccaactcaacttcatttcaattcaattccacaggtctttacttaacaaattctgggtaaacaggagattttgaaaaggcaagaaaaattgctgctcacagcgtatggttaaaaagttgacatccataaatcaaataaccaaagaatcattcaagatttattgggcggttagacgttttattggcagcagagatttaacttttcaaaaaatgatgaagtatttcaaacataaaacatgtagaacctatagtagaggatattgcaaacattgctttacccatcactcagattgaacaaatcttaatgttttgccatttttgctttatatctttttgtaaagacttagtcatgttcgaataccttcctggttccatttattctcttcctcctccaaagtaaccactacctgaagttgatggggagattttctgtatacatatttcttattcttgttacatacaaatagagctgtagtatcaaataattagtgatcactatatagctatgtgtatgtatgtgtatatatatataaattagtgggggtcaattttatcagcccctcatcatttatattcattattctctatatattctgggctgaaggaaggacatgttaagtaaaattctttaataccttatacttccctgttcatcacccaagcaaaacttggtaccacctctagatcccactttcctgttttaggatcagaaagcatttggctcctaaaatatctgtaggaagtttcacataatatctgattgtcttgttttctctagatacttaaaggtggggagttttaccaaaaatataatctaattgcagatttattaaggcaggaagtagattacattgtcttctaagatttcttctgatactatggtgataattgttacagagaattctttacttgttttcatcttgggctaaagagatatttgatagaaataaacattttaaagttcatatggtaaaaaattcatacttattgctttgaaatatctaaatatctgtatgagttttcccaaattctgtaaaccttcatgacttctatattattttctaaacatgtatgtgtgaatatagtgagtatctaattttggtagcaattagtgttgatatgtgtgctactgtatataaaaaacatttcagatgctctactttgggctctagattcattgtggatatttttcattattattaattttgtttgtatgaaaattatacaaaaatatacagtgttactagggacacagacctctcctctccagctctgtgtccctcctaacatttttgtccttatgaagtccacagaatgtagtgtgacagcatggcatttgctattccagtataatcgccttagttattgagtacttttgatgattctttttggtcttggccaagggtgaaaggatatgtaagtttgtgagtatgtatatattgtacaattttttttgttcaaaaacttcaaaattctatgtgaaacttatttataggaagtcaattctggttaagttctccaccatcctaattacttatatactctgtgtaacttcaggaaatgtatttttaggaaacactgtaggctagagctggctttgacattattgatatattttcttgtcattgaactcatgtggctccagatgtgcctattatccctccagtcacagtgaaagcaacccaaggaccagtttgatatcctgaatttctcctgatacttttattttggtgcctatttcaatatttgttgagcgctgaggtgacaaccataacatttccctctgatttctgaactgattgtgtaatagacataagagtcaaatcataattgtgtcaaggatccaaatatcagttctattgctggtagagttagagcatgtggcttttactgcagtaaaattgggcttctttataatttttcctttgaattaaactcagctactcagcaacagttagaagagccagaaaactgcaggccttcttccataagggcagagtttactgtggtaaggattactgcatgggactgcctaaaggagaactcacaagccttgtagaaagaaatagagtaaaaggcaggtcacctgggaatagtgactatctaattacgaaatgtagaactagggtatcagacccttactacagcaccaagcagatgaatcactgcaggagaatgaataaaggagacatggtcaaagtgttactccaaaatgatctcttctggggaatggggaggaaatgttctcgtggagtcacgggggcaggaaaatggattcccctctgtaagacggagtgcactatttgtgttcaatgcttgtttgattgactgacccataattaaaatgagaaacgaatactgaaagaagcataattacagttttgcttatatggatctggtggttgacggaaagtaaaatatacagtacattacataaattattgtaagtgggaagacaggcatgtgcagtacaattggcccaggttgtgtatttctttttttattttttatttttttagcaatatccgtcctatcttagaaatgtctcctggatccctatattacataaattattataagtgggaagacaggcagtacaattgtgtgcagtacaattggcaaacaattggctcatgttctgtgtttttttttattttttattttttagcaatatccatcctatcttaggaatgtctcctggctccctcttcacctctctagccatttgtccacccactggacccctggtacaatacaagtataattgtgccactcattagctgaatttcttctctgctaattccccatccccagtgctcaagaatgtagagaaggccccagtctgcatcttgagcctatacatgtgtccattgctctagccaccttgcacttttcaccttctcctaaatactctgtgctcttctaatgaccacaccaatggatatgctgtttcttctaattagcatttcattcctccctttgtaggtaaactattcataactcaagacacattttaagtatgacctcctgtatggaaacttctcttatgcccagggtcagttattccctcttctgtgtgcctatatcacctaccaaacccttactacactggtaattatttgcttgtgcataccttctcaacaacaatgatagctaacacttctatggctgggaactgggccaagaactttattgtattcctgcctcacagcaactctatgaaatatgtactatggttattcccattttgtagattagggaaagaagggttagagaagttaagtaataagctagagttccatagatttagataagtttcagagctggctgccaaacccgcatctgtctgattgaaagcttttctcatcacagttcataatgtaagtccactgttcaaccaggcagagtgccctgttaacatgaatccgttgtcagggcctggcacatagcaggcattcaaaattttttagctttacaatttcttttttttgtaaaatgtcagctaatgatttatacttacaaggttgccatgtgacttaagtgcattcagcactgaacacattacctggtgcatagtaggcacctgtgaatctttactttttaagtgaataaacaaaaatgtaacttttattgtaatgcagttgacagcaattcagtctttaggataccattagctttctagtgatttcagtgaagcgtggttttccaggccattcttctgtggacggaggcagcttccctcaccaggatgctggctgtttattttccaagtgacaagttgatttactattttccttctcatcactttcaagaagcatctgcaggctagtgagtgacccaggcagtgtggaaaagtctatttatttctctgctgcatctttcctacggagagtctgaggataagggttggaaatggcctcaggaggtcagatttcctgtgtattttcttttgtagtgcaggattgctcagggcgacacaatttcccgtctgctggtacactctgcttttaaaatacctgtgtgatgggatgtgtcaggtaaagaattttgttgtttgtccttgggggatggctctgcagcttgatctctcttaatgctttctttggccctaaaatacattgtaagggaaatgagacagggagagccaagagtgcagttcacttgtgcaatcttttgccttttaacacaatcattctgttcctccctaaattctagcaggaaatgtcattaagtgtacaatagaattcactccactaaaagaatttctactttcccctcacttttgcaaatatgatcatctcacagctcagcagataacttggatgtctgctcacagcttcctaagaggctcttagaggtaggtgttcctgttcagtatattggattcttagcaggttggatagtaaggaaacagacttgtagaggaacgaactcatacttgccttgttcttttgccagcaaaatactcaaattgctgttttagctcaatatacctttcagcactgagggtatatgcagcccctccatcccccaggaatgagtagaactgtgcaatcgtggacttattccctagacgtttctttctgcagttgtgtactcttttgccttggagccattacttcttttgtcattactgaggcttctttgcctggaaagcactggccagaattgggtgatctgtgagttcacgacttgagaacctccaacctctgattgcagttgcactggtggagaaggcacaatatagcccctgctgggtttgtcttcacagagagtaaatgagttcacaggctggccacaagaccacaggccatctctttgcctagcaggcaaggcaatagtagcccacgtgtttttgtgcctcattagtttccaggtgggccaggccaggatgggcagccaggttatctttgcatgaatacagactaaagtactgcactgtgctgctgtacgagaccaatttgaaggacaaaggctgcatgctacaatgagaacaatttcgctgtgtctctgaggctcatcatcaggaagctggctcccactcctttctggagctcagcaggtgttcttcacaggaccactggctacagccacttcagaggggtcagcattttaacgggctcttctaagtatctaaaaattccatttctaaggctctctgttggaggtaaagagtgttatcttctcagattggcttttttcagcttgttgttgagaatttggaaagaaagtcaacctactcccctacttgcctgctttgtttcctgctgcctaccagggctcttgtctaccattgtcagtagttttacctttcaacaggttgaacctcatgcagctgcagaatatcagatatagggtgctaggcatctgctttgggaatctgagttcctggcaaagtagtggtatggtgtagtaggaaaagcaatggaatgaaaatcatagcgttacagttttggaaatggcactccgtagtaccttgtatgacccctgtaaactctatgtgtctctatttcctcacattggtgtaatcatagtaaaatgacctcacagaacattgagaggatacaaataatgattaagaaggcatttggaaatccatgacacgtccagatgcatgtaaatacctgcttgcaaatggccctagaatccttctttatcaatgtctgacatgttttcattttcagtcctttcttgactaattctttgtctttttctgccaaattttgcctttggtctttggctttccaatgattgcatttggatcttaagtatccacactttggtttcctcctgtgttctctggcttgctgtgcctctgcctctcttaggttgttctgctaggaacttctgcttacattcttgcccagtgaagtgtaaacctcactatatccaggaactatatcaacatctaggctgaaccagttccaggcaacccctgaaaaagtagttcaaatgtatttctaaaagattatgcaatctcttaaaaatacaggttgaatccttctatccttctcagtaaaattatgcaatggttccccataacttatagaagttcaaattttttgcccttaaagcccagtttgggtttttaagacaccaagccattaggaatggcaggcctaattaaacagttgcatgcattttccccacacttcttagattgcatagtaataaaatataacactgagtattttaatctgctttggaatttctcagagaaatagagtgattattatataaattataagttgggtgtcttttagggggaaagaagtgaagaacagaattaagtaaatgcttattaatactaagtatatatcagtattgaattaatcagccatttgaaagatcagtacttcatatatcttatacaaactgatttaaaatcttgagttatacatatctagattgcatctagtgtttaatcaattggacacttacaaataatggataaatgatttgttgtcatacagagttgagctttgcttttcatgcagtgagaataatacttttcatttttacacttatgcagttgattgtaaactttgggatgatataatttaaatggatctaaacagtccattagctatgtcagtgcctcctctcttgccaagctatagttttatgctaagctgttgtgtactgtattacataatcccctgcattcattttctccacctatttagcttgaataaatacaaggtgactgcattgtctcttcaacctacttctcagtaaaaacaccaagtataaaaaacagatttttgggtgctattttgttttttctaatggaggattcaaaggattgaataaggttagaaatgcatgtttgtcactatttggttttgccccttttagttacccttactgtcaacttagtatggttttcaaggtgataagagagtggttgagtctcagctactggaaggaaattaagatagattggaggtcttagaagaaaaatcatgtcagttgtgcaagtggacaaaacaatgatttcttcaaggtcctcatttttttctccttctcctttctagcccttgatttgctcttttaaagactgggttattgggaggcagagcttgcagtgagtcgaggtcgtgccactgcactccagcctgggggacagagcgagactctgtctcaagaaaaaaagaaaaggactgggttatgcattgctagtgcctcttaccccataacatgtaggggaaaattattccatcacttgaaaatgatatacatttgcttatgtaggatacgattcagagagaagctttcagttgtctattgtttgttgaccaatggaggagatatcccaacatggtaatgctgatcttggtagcctcctctgactcagggaagaggtaaactgagaaaattcttcactggatgaaaagatggggaaggttgtgaatggttacagcaatttctgttaaatatttgcaaaggaaggcacttggccacataaaatcttcttcggtatagttgcatggagattagcataaatatgcatgtgatttgcataggccttttcttcctcacgttggttttagttcttatttatttatggtgatattctcttctctacactgatgccattttttcccctgtggcctcccacataaaagaagtgtttttgctttaaatacagatctaagggctgaaagggaaacatttcttttggtgaatgagtgattcatgtaaggtgagaggaattggtttctggctcaatttattcaaagtttgggatggtttgtcagtcaatgcacagttccatggaatcatctgtggcctttgacaagacaagtaggagcatctggaatatccagagtgatgggcaaagggaagataatgaatatttagactaagaaaagaccagacatgccccaagcccagagtaccacaaactaactgtgatgtctcaggcaactcacttatttctagtcatcaatttcttccttaataaaataagggcattaaatcaggccatctctaaaatcccttatagctctaaaatttattattttgacagactccttgctctaattatataaaaaatattaagcaccatgtagcacattaaataatatctggtgccttgctgttctgtcaaacttttcccctttgaagggtactggatgattaatttaagcttctctttataggcactactttccttgctcatttttctcagttcagtgggcacacaaggtataacttaaatgtttatagaagacacccattaatataccacttgcggtgccaaggacatgcacagtagttggctttgtggacatccatgtctgtagaaaaagagcttagttgtgataacgccatttgatttgtcaccttctactctagatcagggtcacctccaggtctcctgagcagggccttgtccaattgcattttaacaaagacgattcttcagaaatgaggggagagatcatgacaatagacagaacatttggggagtggatagaactacttcaaacacgcagacagtgttgaatttctgctttattatttttggggggctatttctgctaaaatccagtatgagttatgggctaactacttatacatgtgcaagctaccctgtgagcatttataggtgaacaggtctcttttgcttataccaatgtgtgtgcaagcagacatatgcaggtagatacatatgactgggctgctctggaacacacaagagaaacttgatctcttctttaactccctggagtatgaagctgaggctgatgttttaatgatgtcataatgctaagattaatttaacaatatgtagtgggtagaagtcttttcacattataaaatatctcctttttacagctcttactttatgatgaaaaaatattcattttgcctaagaaatttacctggggctgtaatggttaacacagatctgagttgaagtggacttggctttggttaattagcctggagtgtagttccggcagggaaaatataattctctcaaccttattttgtagcctccaatctttagagggaaactgtatacctcaactattgttgccattttcttttagtaatgaggtgcttttgatagcttttgaccaactctggtatgaagtagaccattctaagtaaggctatctggcaagaagacaaatggaaggtcataacactgtgtgtcaaaattatagatcgaatcaacaaataattaaataaaatatatttcaccctcttaccttgacaaatatacctttaaaactagttggaaagccaggctcaaatttagagtttttggattccttggagttctgcattgggaaatagcagcacaaggggaaccagccaacccctagtcctcaacccatggtctactcccttctcttcccacctttggctttgtcctatatcatgaagggtctggtatgaatgcatgtggttgccccagcctaatggagaagccttatccacatctctgcaaatagtctcccacggctactcctcagaccttgcaatatgtatggtttgcctttagaaagatggatcaagggctgggtgcagtggctcacgcctgtaatcctaacactttgggaggccaaggcaggcagatcacaaagtcaagagattgagaccatcctggccaacatggtgaaaccctgtctctactaaaaatacaaaagttagtcgggcgtgttgtcacacacctgtagtcccagctacttgggaggctgaggcaggagaatcgcttgaacccgggaggcggaggttgcagtgagccgagatcacaccactgcactccagcctggtgacagagcaagactcagaaaaaaaaaaaaaaaaaaggaaataaaaagaagaagaagaaaaaagaaagatggatccagggaagaggcctgcacaagccctgaaaaacaggcttaaggctttttgggtgggcaattacagggtcccagtctatgaaatattgtcttgaaagagtatatgggctccagtagaatgcgatcttggccccatggaactctagttctgtggggaaggatagttctgtggggaagaagagaatgccgtcctggccctgtggaactctagttctgtggccataggatagtccaaccagggtcttcaaaacaggataccctagagcagagagtcttgagtttaacagtggtattgctgtcttatcaaaacatatcaaattaattctcttcccctctccttacctgctgtatcacctgctcaggtccaacctcctacttaacaactcagccatgttccagggggcttaggactgtattatagaaaccaaagttagctgagttattgacagatgaaaatcccagccagatctttcggggtaatttatttttagttattggtcaataaaagctacctggagctagagagtcctttgtcagaacagttaattatccattctaaaccagctcttctacaagcatttaaaagcaattcctgaagcaaaagcaactcgagcctcacttgatcattttgcatgaaacctccctttaggtttttcttgagaaaattcgaaggaaaggcagcaatctcttttgcaccatcttgttttgtcttctaccctcgtgtggacacgtcgtttctctgcagtcacccctgctgctagtttccctggtgtttcgatataggacttgcagaagaattgaagggagtgctgtgttggtatcagcacaagaacggggcagtgcccctgcggtgtgttctctttggtatttgcataggtctgactcttgccagacaagtgctgattgctttcctcttttcttttcctatagctcgagaggagaatgtggccactttccgaggctcagagtatctgtgctacgacctgtctcagaacccgatccagagcagcagtgatgaaatcaccctctcctttaagacctggcagcgtaacggcctcatcctgcacacgggcaagtcggctgactatgtcaacctggctctgaaggatggtgcggtctccttggtcattaacctggggtccggggcctttgaggccattgtggagccagtgaatggaaaattcaacgacaacgcctggcatgatgtcaaagtgacacgcaacctccggcaggtaatggctgaggggagagaattcctggaaggctcatcttaggtggctgggtagtaaatttgtgaagcaggtgatgggtgtgaggtggagaggggtggagattcagggatggagatgttaacgtctaactttctcccagtctttgcaatttcacgtggaaaattattaaaatatgtttctccacatacttcaattctctctctgtgcttgttatttaagaaaaaaaaaaacaactcagttgtatagataataaaagttgtaagtactttcattccttttattctgctttcctttgatcattttcttaattacatttgaatcttatcgtattattgttaaattcaattagggactgcattttgtttctgcagcttcgtagattttcctcattctttgaatatatgtttttctttttaattaagttagccattgccacgatgccataattttaattccttccagaaaaagtcttccttttcctcttttaatttactaccctttcccaactatttttttcttttatgttaacctctagctttggaattaattagccgggatctttctgaattcctctgtttctctgttcttgatgcggtggtcctactctattgcccctgtctctccctccgagactcttcagttgactgggaggcctggaaagtggaaggacccaaataaaaaagtcaactttggagcagcctttcctggttctgtccgtgcttgggaactcccatcgcttgccgattctaagcaggcacctccgtcaggtgacaacattctcagaaagccttagccaagtgaagttgttttcaatttcatgactaataataatgataacaataataatacctcatcagctcacatcagtaaaagaaaaccgtttcctataaaaatcaaagtctgtgctgagaccgccttttccaggttgccattttcacttggtttttctatttgcgaatctgttgttaaacccagttggatggcatccaggctttattaaccagaaaacactatactttctgaagtgcttatcaaaaagtgcttaccaaattttcttctgccacatgattgatttaatgtcttctaatgtcaatgtgaaagcgtaagaaatgataggtgtctgcctacgttttctgtttgataaaagtgtaactccttacgaatactaaacaaatggtataggctggcacacatttgaaacacatttccacacttaggtatgtcaaggaagccatcctgttgggagattacatttatctcaggtaaaaatgccaaatgacacaagacttagagtccccaagcatcttgacattcatgaatctgatatttttgaatcattgttctatgtttttcctccaaggccaaagaaccctattgctaatatcttctttcgtcattcctcatccatacttacccaggagagaacgtctcaactgtcaagagaacccaaatcaaatatccatttgctaacacataagggcttgttacatgagagctgcagagactagacctaaaagtgaaatacaaccttttgctagttttgattggcaggtacaaaataacacgctttaggcattaatcagtggaggagagacttttcatgtacttcagagcacaatcaggtcatgattctcaccaatttgtttctctacctctctcccaccacccttccttaccattctggaatgattccaattctcctgtgaaaggctcacttttgtttctactaaaaacacttttctaaaatagtatcaggcacacttaagtcctttaaatggagagaggataaaccaaactgtaattcaaatattgtttgtgctgttttaatcagagcagctagaggaaaactaccctggatgtttttcccgcccctgcccttcatgttctaaggcccaactctgctctgtgcccttgggcaagccatttgacctttctccaccacagtctccatttgcaaaatggtggttacaatcttccgcagccatgtgtggtggctaaatatgcaaagcaccttatgttccagaaggattatgagctcatccatggtctaggtatagacgtgctgtgacgtgcacatgatctacaggctgagctttctgtttcaaaggtgactgcatctgtctggcaccaaggatgcagctaagtgcaattctctgttctagacagggatacagaggccctacagtattgggggtatttcttggcagagggagtattaatcttctgtgagaaagtgaacctaaaattgaacctcattgaaattctgactaaattttgcatccaaatgcaatttattgaaagaggaaaatctctgaaaagcaaagttgattttgcaaatgcaattattttaatgtgaataatataagattattattttgtccattaaaataatatttataacatctatttgagttccctgggatacatttgaatggtgggatcttcctgtctatttcaattaaactataaagagctccataaatatttgacaacaaacttatagcagccttattcatatttttggtaagattgaatggcttttatgacaaaaattcattgagtaaagtttacctggggtttcccggagtacttattaccaaatggagcagaagtctcctcatttcttccttcatgatcatctattcatggttttgcctttaagccaggtcaggaccaaggccaggtattttattgtggcttacaattaaaggaaggaatgtggactacctgtatctattgcaaactataactgggattagggaccaaggtagtgaggaatttgtgtgtttgtatgtggtagtggggtggtaattggtccttgacattgcctgagtccaaggtcatggccataactttcattgctttacctctatgtgttaacttttgttaaatcacaaacacaaaactgaggttaccagtcttccagtcttccagagggtttttctaatcatgtttaacctgccagtcttccctgctatccatacaataaattacataaaagcttgaaaagcattgttcaagaggaattgggggagagagattccaaagcattctggccaagtaaacaaattaatgaccttattgagtaataaagaagattctaattttttttgatacattctattaattctaaactgaaggaaaactgtttctctctggttgcacacatccacaaaaatgaaataggctgtagatgtttaattatctatggaaacctagagtacactacataaggcagactttctatgctaggtttgatctgtaaatgctttaagttttttcctttttgggaggatttcatgatcatttatccacattgtagtcatagtcagatgtgaaaaaagtaaaccccaaaatatttgtatttcagttctttgtatctgtttttctacatgtggaatggtacctgttggggggtctttccttttggaagaggtggaatgggtttgtgttagagggtgggaagggagtgggcggtgtccattcagaaagcccttaggaagtaagtatggtgctaattctaacgggtgaggtgtggtctgagagagatttggaagaagcagggagctgcaatggcatgtagactgcagctccttttctggctgtgccccaggtggcatggttttccatagagtcctggtctcattgtcttccccccactctctttttctgtgtcgggtgccttttttttgagaaactaacacaagatcattcatgcaatgtgtcattttactaaccgactaatgtactaacaccctaacgactcatctttgtttttagtttttttaattaacaatcgttctgttcacaatttttaatttcctttcttcccccttctccgcaaagcactcaggcatcggacacgctatggtaaacaaactacattgtctggtagatatcattcttattgtctctttttttgggtttgccgtgtgttgccccccttttcctctccaacccccccttttatcctctttagactcatttcttcttttaagattttgttacattaaatgcaagcctttctttttcttaaaaaaaaaatggaaggggatgcacttgtcctaaaaatgatatttggttgaattttgtggggaaggtttccttttctctagttttcaattttttcccccaaaaaatgctttttttttttttttttaaatctctatttggctaaatttgttttcttttgttttcttattttacaacttccaagttacatactagggacaacagagatttatagtgagaacttccttctttctgtgccttcctctccctctcactcttcctcttttctttttttctcctttcccactccttagtcccttttctctttcccttttatatggccacggctgccacaggtgatctggggaggaaagtactccacttcctagactctttcttacccttcttttactttactcccctaccgtggccaaaaggatatccaccaattatgttctccatacaaactctgcatggcatgttcctgtctcgtgaattttcctacctgcatcagaatttgtttcctcattttcctcctcattactaacaacctaccaatcatcaacccaatttcagtttcttctcttttatttttccccactcttcattctcctttcatctttcatatatttgggggttgggtttggactttttcttttcttttcttttcttttatttagtaagggaggtggcaggcagagaaaagactaccttttagttttgaatgcttttttttcacttccatcttgttcttcggtttgttcaatgcatgtaagtgtgaagtggattttgattctttccctaatttctccccaccctttcccagttttgtttttcttctgccttctctcttggttccagataatttctgcatgggtgtatcggtgtatggtgtgtgcatgctttgaggccccatcgtttctctctgccctctgctcctttcatggatgttgggtaaaagggtgctatttcttttctgtgggcattattatttttattgttttggttattattcctcatcattcattttattgttgttcttagagttgcctttttggtttgggtcatttcttctcttggaggtggtgatgggagccaagggagggtagggattggtgtcctggggcagtccatggcatgtatcatccatgaccatatcagaatcaagacccttctccttccctccctgaatgcatgtttgtcagcgtggtgtgagccaaaaaatattaataacaataaagataaaagaaaagaaaaaagaaaagaaaagaaaaaaggaaaaataaaaccatcaacaaccaaagaccaacccctaacaaatttcatcatcaaatgtcttctttgctgtttttcactaccaccatgaataacaatcatgtaagaaataaacaatcattttagcaatgaactgagacaagtgatatcgtctgaggatggttccattttctagcctgactgtgtaaagattgcaatgggtagaacaaggtgcccagcttggaaattctaacaaagtcatccatgagtctgcagggaaatactgaaggcttgagacccagggaggcagaccagaaaatggaacttggctgcacataccaaaatcaaatcaaattagaaagtatatctcatgaaaatcttaatgaaagtgatgccacaagtaggggaagccactgggttatgataggatcgtaaggtcattgttgggattttttttgtccctatgtccctccaccaggtgacaatctctgtggatggcattcttaccacgacgggctacactcaagaggactataccatgctgggctcggacgacttcttctatgtaggaggaagcccaagtaccgctgacttgcctggctcccctgtcagcaacaacttcatgggctgccttaaagaggtaaagttcacccaattctatttaatgcaccatgtgattgtttcatttataaacaaatgacatgtctaaatcaatgactggatctgtcctcaaatctatgagatgatagattgcagcagaaacaaccttgaacttggaagtaggtgtcctacgttttcattcccgcttaagctggttgcatgacttggggtttgtcactttagtactgtattagtctgtttgcatgctgctgataaagacatacccaagactgggtaatttataaagaaaagaggtttaattgatttacagttccacatatctggggaggtctcacaatcatggcagaaggcaaggaggagcaagtcacatcttacatggtggcagggaagaaaaacttgtgcagaggaactcctctttaataaaaccatcagatcttatgagacttattcactatcatgagaacagcatgggaaagacctgaccccatgatttaattacctcccactggcttcctcccactggctccctcccacgacatgtgggaattgtgggagctacaattcaagatgaaatttgggtggggacacagccaaaccatgtcaagtaccctgtagttctatttcctcatctaacaaatggaagctcttatcccacagatggctgtgtttataaattaaatgcagtcacacaggtgaaaggccattgaaatcacaaggaactagatgagtgcaaagtttgattttgtgattttgacctggcaaataggaaagctctagctaaaagtggctcaatctgttgttgtgtaccctgtctaaaatataacatatgtattattttaccttcactaagcctggtgttcccaagggtctcatagttgagacggaagaaaattcttataatgtgacattaaggctcagaagactggttttttcctttgcttcttcttcttccctgagagctagtagctgtgaaaaaacagtgggactttgccactacttgtttattaccattgtagctgatgtattgagacctctttctgagagcaaaggagcttcagccaagtgtaagttcaacctctaaggtcaattgttgaggcaaaaagaatcagactaaatttggtagagctctttcagaacactgtggcatcaaagcagtgcactgcacattttaagctaagcttcattgccgaagatatctataccatctccctggggatgttacttgagaagcaaacagtgttccttcttgtagataacaatcccttgtgacatcttatgagtctcctcttggggcatatgttttattcttactatggttatttgaaatttgttgaacatcatttgtatatgagatggcactgtccatgcattcattcatgccactgccctgtgagccttgtccaggcaggaattgtgtctgttaggcatggcacatagtagatgcataataaggatttgtttgtctatttatctgataatcattgagtaccttttttgtgctgtaactaaatttggtggctctttttaagccatgatctccatgctccaaggctttgccttgtaggaagggagatgagatcagtgagtgaataagtatagcataggagtacatgtgttcagtggcacatactaaatgctctaattgagtagaggaaacataaattttaggtggaagtcagttttagagaaggagtgacatttgaggcagtccttgttgtaataaatcatgtgcgaattgagaggaaggggtagaaaagagagacataataaaggagagaaaatccaattgtagctttgtattgttctcagcctgtaggacaaaataagaggagcacccaaagagtgctattatctctctgcaggatgttacctaggcttctgctggcttcagagatttcatcgtcatttctgatggaattatggtaggcatagagcccttcctcactgggatttactcctatttggatagaataaaggtatagactatgcactgtctagtgaaccctgaaagactcttaaacactgttaaatcacactacattggaattgcactctcatcagaaaaagactgcaacattcttgttaccaaggacatggctcaggaatgaatgaggcattggttgctgtggagtgctcattcagttttgtagtgcaacagtcctgagcatggagtctctccaggacaggatttaggtcttgcctttaggattaattttctcctacacacaattatattgagctacctctccattatatacttagagacaatggagcaatttcccaaccatgaatcttctatctattaatcaggaaggatgccctgaaaattttgaaacaagtctcataaaaacacaaaggtgtctctgatgactttatccatgtggaaacaaaagaaaataaaatacacacacacacacacacacacacacacacacatttttgctgcccagatagagagcagaaagcttcaaaagtctgtcagaatcattctgaatagcttaaaaggtaaaggcagttctgaaaaacagtgtcaataatagaaataactataatcagtgatgtcaatatatccttatcttagctagcagcacaaatatgcatttaaattcagaccaagttagaaaaaggaaagttcaaaacactaacggaaatgataggcaaagctagaacttgataaactcctgccccgtctgttttccctgtacagcgtgatagtctttctaagggactcggaagtcttcttatttgtctgagtactttgaacagatcactttgagtctaacgtagtgctggcatattatttctttgcatttaataattacacttcacttttctgtgggcaggtctatggagatacttctcttgttcttggtatttgtttttgataaatcagtaaacagcaaaggctatgttaggattcagctacctgataaaccccactcacccacttaaaccatagaacagtctttaattatttcacaatctcttcttccccttccttttcctcttgctgccttaaaaaaatcttctcttgccatttgtggctttaagttgtcctaaatgaaacaaggtgattttatgtgtaattttcttcaaattagggacatggcaaagggcctatgcaatttctgctccagatcatcaatatttctttgtgtgtggcacaaaataggttttgtctttgggactgtagttacttcacacctaaaagctaagttctggctccgtgattgtgccaaagggactggatattacttgtgtgcgtacttcctaacttcataccagtgtaaaagccacaacaaagcgtccacattgtcgtcaaactatgatggttctctacacaccttagttatcaatatgcagtttgtgtccacttaactatcatgaagtcagcatcttgttccttttcatgttttcacattttagtgtgtctgtctcatgtttgttcttgttgtatccccagctcctagaatggttcttggcacttagtggctctcagtcaatatttgctgagtgaaatcacatgattgtacattaataaatatctttcctaaatgaatgcttttaggtactattgaccacttgactttcctgggatgactaaagaacatcttgacatggcagtggttgaatctttcaagaatcttctctgcctccccctgagctatcagatatgagaaaaagattatattaaaagcctcagcaaggctaagaggaatgattggaagttcctctatgaaaaatgggttagaaaaggctatgagggagacatcatagtataatgaaaagaatactgggcttcagatcagaaaatctgcttaagaatgctagctttatcactggctatataataagaccactgatcttactccagtctcagttttctaacccataacaaggagataataaaacttctgttgcattcttaagaaaaaaatgaaatgatgtacataaaagtgaaatcatacagcattgcaaaatacaatgtttttgcttataataattattaaggattatatattgcattgtataaaatagtttacaaatagaaatgtaagtgtaagtgaatatccattaacacatggaatctctatatttctcatattagcaaatcattgtcaggaaaaaaaaccccatcattctgaggtttgccctacataaattctatcataatgcaaaaatagggataactcatcccacctgccctcaatgatgactttgttttttgcctttggtcatttatttgacactatgttttcctttattaaaatgtgaattccatgagaacagaggtcctatttgcttacaaatatttccccagcacctagagtggaccctgacattaaaaaaaatgcactcaataagtatgtctggaataaataaataaatgaatatgataacctcatggagctctgaaatctggtggagtttagatgagcaatgtgtaagtccagacagctattaaaaagtatcataggctgagtggcttataaacaacagaaatttatttgtcactgttctggaggctggaagtctaagaacagtgtgccagcctggtcaggttctggtgagggccctcttctgggttgcaaattgctgttttcttattgtgttctcacatggaaaaaagaggataagagttctctagggtcccttttataagggcaccaatcccactcatgagggaccttcatgacctgaccttcatgacctcccagaggccccacctcctaaaactgtcacattgtgggttagaatttccataaatgaactttggagaacacaaacattcagtgcatagcaaacaatatatcccccaaacctataatatgccaaggactgtgctaaaatacaaatatgagtcaaacatgtttcctgctttagaggaactcacattagtggggagaggcagacacacgcataaatgcaataaatagcagttaatgcacaacatgaggcattcttagttacaatgtggctgctgaggagaaggacctaatacatcctggggttcagggagcatcccaaggtgaggtgcttgaagccaagtagaagtgagcatggaagcatggggaaagaggtgctccaggatgaggggcagggtgagcaaaggcatggaggtagagcatgttctggtgtctgggtgaagaacttacaaacagcttgctaatttcaaggcccaaattataagactgggagctttggactggtagctgcggttaggtagggaccatttcatagaggcctttatttcatgctatacccttggactttgttctctaggtaacgggggagccattgaaggaccttatgcagcagaacatggtcagattggcatcttacccatcaggccttcattctttgaggagtaatgttaattcatctaccactttcccctgatgtatgtttttgtcctaggaagttgaagatcagggatagaaatggtggtccctcggccgagtgcggtggcttacgcctgtaatcccagaactttgggaggccaaggtgggcggatcacgaggtcgggagattgataccgtcctggctgacacggtgaaaccccatctctactaaaaatacaaaatcaaaattagctgggcgtggtggcgggcacctgtagtcccagctacttgagaggctgaggcaggagaacggtgtgaacccgggaggggcagcttgcagtgagccgagatcgcaccactgcactccagcctgggcgacagagtgagactccgtctcaaaaaaaaaaaaaaaaaaaaaaaaaaaaagaaaaggtggtcccctgagcttcggcattagattggcgcctgcctctctgaattttaacattactgcagacaactgcttccttctgactcccatttcagtttccaaaaaccctccctgagaggacatgcatttctcttttcctctgtccttggcattactgagctgttcaatgacaaatgaaatacaggaaggccaagccaagactgagttacatgagtagggtccccatcaggctactcaagcccatcacagtttcctcccacgtgttggaccttctgtgtagtttgatttggttatttccacaccatcctcttttctcctcaatctgacactcctccattttcccaagtggagaagcgaaagtgccactgagacctctgggacagactggactctctcatctctcttttctcatggcatctctaatggggaggaaggaaaagcaggagaattgggagaatagaacacatatttaaaggaaaaaggattggatagaacatcattgtgcacattacattccacatccctttgtgattattagccatttaaaaccgaatggagttttgcagccagagatagtctctgaacagatgattaatggcttaatctgtaataactttacattttatagaaccctgataggcgtccacatctggtgagccaagctatttaaggctgtgttaattctgttaattgctatacgtttatttgaattgctggcacctgcgggctttgggataatgtgtttgttgttgctttttttcttctttaaaaaaaatactcattttattttaccctgtcttgcttgctgtctcttgttgctatctctcatgctatcacttaatttcttctctggattttcttttgggttgtcctctttcttccttactcattttcctccctcttccccatctccgttccgtttttctctaattcgtttgtttcccaagctgttgttttggtagccttcctgatttctcaggtggtgataatgtctctgtccataagcaggtgaatttaggtcatagctttgggcctaaatattcctttttcctgtcatgaagactactgtgcagcgtagggctagtaaaacccaagtgaggcttttagaatcaacatgagacatgagaagagggtgggcttcagcagcacaagcccagggtttgagtcttgcctagactcattccttgctagttgcatggcttttagcaagccgcatgactgttctgagcctcggtttcttcatctataaagacagagactaatactgatttcatgtatttttatgtagggagcaaatgggattagacaaatggaggtgttttataaaatacaaaacactatacaaaggttaatgaagttgttatttatgttattaattgaaacaaaatcaattagttcaggccaaagaaccacttactgctcttcaccatttctgcaattaaaaacctgcagaagttaggagagtccaatgtagtttaattaaaaaggcctgatactgggttcagttctaatgttaattagaaaattatacaacttctctggatatccttgtcttgatctgtaaaatgaggatagtaatccctgctaatccaaatgcacactactgtagagaccttcttgtaaatgtagcatagaacacacattattgctttgggtagcaaggtaaacatcttgctgtacatctttattccattaaggaagatgtacggaaaagcactctgtgggtttggagataagagcgtcttgacagaatgggagaaccaacacaaaaggtgaccagaagaaataagagttgagcaaggtggaaagaagtgaagatgcaaatcagaggaaatggaggaacgtggcagaagaagaaaacaaaaagcaattacggcatctcaggagctaactattggcttgtcatgggctgagtgatgtcctctgcaaattcatatgttgaagttctaacctttagtttgtgactgtttttgaagatagggctttttaagaagtaattgagatcaaatgaggtcatatggataggccctcaaacaatatgattggtgtcgttataagaaggagtgataaggacatggatatacaaaggaaagaccatgtgaagacagagggagaagatagccatctacaagctaagaacagaggcttcagaagaaaccaaccttgctgaaaccttgaacttggacttctagcctcctggagtgtgagaaaataagtttcggtaaagtcaaccagtctgtggtattttgttatggcagctctagtaaattatagagcttttttatgggttgaccataaaaaaaagatggccatttttggctgggcatggtagttcacgcccataattttagcactttaggaggctgaggtgggaggattgcttgagtccaggagttggagaccagcctggtaaacttaaggagactgtgtgtgtacaaaaaacataaaaaaatttagctgggcatggtggcacacgcctgtggtcccaggtattttggagggaggtgggaggatcacttggacccgggaggttgaggctgcagtgagccaagatggtgccactgcactctagtctgggcaacagagcgagactctgtctcagaaaacaaaactgccattttttgtgtgtgaggacaaaaaaaaaaaaaaaaaagtcaaatattggcaatgtcgggtgattcaatttcagaaagaaatgtttgtaaagaggataaattgaatcttctggaaaagagatgactttctggattacaaggaattgaagtgggcaggaaagagagagagaaagaaagagagaaattggcaatgtcagtcgattagagattcccattcccctggctgtggttgttttctttataggtggactcctaatgcagtttggacccataacatacagaggcacagaggaagaaggagcgaaaccctcagctactggggacagggatacatttgaggcttatttcagtaggaaccaggtgtgaacatttagccaagcgtggctgtaaaaaagtggtatgggcctaaggaagagtgaggagcactgaggtctcaaagatctttggtgtttcggtgctgtgacagacagagagtagttcttcagttagtgccacaataaaattactaaagaaggatttgctgcttacagttgatgggttgttgatgaagaagtagatttatatatatatatatatatatatttggcaactgggtattcattctgccttcatctgatacatgtttcttgatttttattcccctcattctcaatccaatgattcagtggcacctgctccactcccagctccgttagtgagcatgtgatccctaaatcaattagagactcctaattagagactcctattcacctggtcatggtttctttcttcataggtgagctcctaaaccaatttggatccataacatacaggctcagaagttttgtctatatgttgtagggaaacagctctctcctgctttgggctagaacttggagtggtgttaaactaagcttctggccactatcttgccaccatagtgaccaaaaaggaagccaggatagagaaaatcagagccaaaagatgggaagaaactaggccttagtgacatttttgaaggccctggtttaaacagttttcaaattagactaccccttaatttccacttatggttgaataatgtacctctgttgcctaaacctgttgtggctctattttctatcatttgcagcaggaagccctaggtgatgtagcagaattcctcatgttcctattttactcctgttttttgctaacaaaaagataggtccttggacagggaaagacagacaaaagtaggaaatgtaatactggaggatcttagaaatcagataatttgctctgtattaattcaaatttcctgcctcagatgaatgctatcccaggatacagagagaatttgtaaatacaatttttgaaacctagttggtggtttttgaggaacgctagtgaataaagaaggttcctaaagactagacaattgaaaaatgtagataatgcaaacaatgaacttatgagttgaactgaaatctggataacattttggagtgcaatattaacagaatgtatgagcccatagcagagaaaagagtgatcaatataactgccatcactaattaagagcactaagaaaaagctatatcatatcaaccaaattcacatactcattcagtagtattaccgatgattcagaaaagtactatggacctcatctagctaaatagcagcaaagtttttgaagacacattttgtgatattctcattaataagatgagcaatagggtttagatgcaagagctatcaagctattaaaataccaatgggccctgattaagtggatttttttggcctatatgaaagtttttgtaagatggcacaaagctctgtcttatattaaggacttgaagagacataagagaacatggcttgttaactttgtggatggcagggacagaaaatggtagaaattgtgcatctgtgttatctgaggttgaattaatagaggtctgacctgtgcaacaaaggaggtaacagttctgcagtataatttattggttaagaaagcaggctctggagttagagtttctggctgcaaagcctaactctactcccagtagctgtatgatgctggataacatacctaaccttctgttacttattaaatgggaacaataattatacctacttgatagggctgttgtattgagatcatgcatgtaaaatagctgacatgtagaaaatgttcagcaaatgttatttattttttttctgagacagtttttttttttttttctgagacagtgtcttgctctgtcgtccaggctggagtgcagtggtgcaatctcggctcactgcaccctccaccaattctcatgcctcagtctccgaagtagctgggattacaggcatgtgccaccacacccagctaatttttgtatttttagtagagaaggggtttcaccatgttggccaggctcatctcaaactccttcaagcgatccatccacctcggcctcccaaagtgctgggattacaggcataagccactgcgccaggcccagaataagcttttaacatgacaactaattgacagattagaatatctttagagctgagctgtaaaaaaaaaaatacccaaaaaactaaggcattcaagatcctaacaacgttaagaaggcttaactaatagaaccagggtcatttaacctgagaaagtgaagatgcctgtgcccaaggtttgagagtcgtcttcatacatgaaggactgtcctatggaagtggaagaaaatgtggcccatatatccttaagaagagaaactaagtctagtgagtggaagctgggtacttaacataaggaagaactttcagtaagagctgtccaaaactgccttcaaagtaatgagttctccaacactcaaggcatccaagtagagactgggcaaccattttgctgaggttatcgaggggattctggaatcatatgagtggttttgattttatagatagatctatagatagattgattttatatgatagatctatagttctacgatgaatgacctatctgcaaagaaagaataaggctaactgattagctcaggttcatcatgtggaagactttcctcattaatctccaaatcagttggctttacatgtcccacaaacatttattgggttgcccttgtggtaagagttgaggttcccagccactatcatcacctattactcacttacaagaatttatctttactcagtcctttacttgatcatctcgaaaaccgttacaaccacagcaattataatcatagcagcaacaataaagactagcaattattgaacacttaatgtgaacacatgtgaaatgtgtgtctacatggtgctatgtacttcagacttattccctacttatttcctaatttagttctcacaaaaaagcttatgagctggattctatgatcattactaacttgaatttaaagagagcgagtgtctttcccacttacatcattctaagtgttggagttgagatgtaaatactgtcaacatcctgattttgctgccctttctaccaattcagtcataagagttagtgacgaagaaaaggaagctcctctggaaaaggttggtgattctgtgtttaaacttactgtaaggaattgtctctcactaccgcttagagtctctacttcataggaaaggtcatttaatcaggcaaaaatgttctgttgggagactagatacaattacctatttctttcaccttgccattgattgttctgagaggaaggcagtttttgcttgatttcccactttgggcaaattgatattgctcaacctgctaacggaggaatgattttcattatggtacctgagagggaagatgctgctcttagtataaatgccaagcagtgcaatagtttcgtcttgagatgggcagcacattgtttctttttgttccagcctaatattttccatgaagttggagctatttgcctttaatgccttcaaaacacccaaataaggagcagctactatttagacttattatgaattttcagtctgattttgggaatcacttacttagctttgcatttttttttcttttttgctcgtcaagataaattcagtggaactcattgctttctaaaaatgtcacttatttacagcaaatgtaatctaccacaacattcctactgagacaaaatctcttgtgtctttgaaagcctcaaaggagattaaaaaaacactagtccttgtacacatatacctacagggataaagcaatcattgagctaattaattagcttatgttttcaaaaattgttttgcaaatgcagaaacgactattccattagtgttgcggtgcttttgtaaccttgtgttctgttcctcatgtggagagtgtgccacaaatagttcctgcatagatttcaagagagatacaaggacacatttttcacttctcaaatcagtgaagatgcagcttagggcagcaacactgcacaccaattatcaaccaataaaattctcctccttccctctcccttagcttttccctcaccacccaatatcagcagatgttctatctcatactttgtagggaaaatagaaattgttcaggtaatgcttgctaagcttctctctctccaccttaagacttaccttcaaagattctcattgctaccttcttcccctcatcttacagaatgaactttcccctcctctcttgcctcttttgagatttagcccctttaaagattccctctcttaatcttcgatctcccattctcctctgctccatcccttcagctagagacatactcaaaatcacttctttgatactgtctcctgctcaatttacacctaagctcattccccactttcaatgaaaaagttcttgggagaatggtacatatttctgatgtcccctacttcatggttactctttaaccctctacatttgcatgtcagactctgaactctaggatccttagcactttagtggaattgttttcttgttttaccctgcttaagttagaagtactttattatatgctcctatagctctcagttcaaaacttcaatgcattgcaattgttattatagtcctcatcacattgcactttaacatgcactgtgttcatatgtttcctcaatagactgagcttctaagagacaagaacaaagatttatgtagattgcatattccctctgaagttaaacataggtcctgacacatgaatagatgggaaatattcttcaataaattaataagtatttgtgaacatcagtgatagaattattgttccaaagttccaatttctgcttatattcattttgtcaacagcatgccactcatttacttattcatgaatgcagtaaatattcatggaatgcctactctgtcataaaatctgttcaaagagtgggagtgtgtggtgaatgacagcatgtataaagtctatgaccctatggaattcacattacggttgaaggagactaagaataaatgcaaaacagataattcagatactttcagataatgataagtggcatgaaggaaatgaaagagaataatgggtgtattagtccattctcacactgctaataaagatatacctgagactgggtaatttataaaggaaacaggtttcattgactcacaattcagcatggctgaggaggcctcaggaaacttaccatcgtggtggaaggggaagcaaacatgtccttcttaacatggcagcagcaaggagaagtgccaagcaaaggagggaaaaagccccttataaaaccatcagatcttgtgagaacttacttagtatcatgagaacagcataagggtaaccaccgtcatgattcaattacctcccaccgggttcctctcatgacacgtggggattatgggaactacaattcaaggtgagacttgggtggggacacagccaaactgaatcaatgagatagtgagttggtctccaggagcctgagtggtcagggcaggactctttgaggatgcaataattgagacctgagatgaaagtagcactcagttacacacacaaaaccttggggagaggccattccaatccaaggaagctactaggacaaaaaggacctaaagcaaggaaagcttggcacattcaagaaaagtccaggaggcgatggtggccatggctcagtgagagaggtggtgagaggaaagaaatatctagggctggatatgttgcttttctgaaaagatccaggctaggcaatgtcaatttatcaagcttatctctgcctcagagtcttcattttccttttatcccatatctaggttgattttctctttttctttatcctcgaaagtgaggtgtccctctatctttgtaagctcacatgttactgtgctcagtcagcatctccttctctccctttcaacttccgaattactcagttattctcattctttcttgcagtatatatctatatattttttcttttaaaaattgtggtaaaaaaacacatatcccaaaatctactcccttaacacaattttaagggcatgctacagtatttttgactatattcacacggttgtacacagatctctagaacttttctcttgcacctttgatatttgcctatttgtttcttcttctcagagttaaaaacaagtgttagtctatcctttcataaaacccctctcttgacctgcactttattaagctcaggaagataaaaaatgcctctttccaggagacggtagggaaaaagccaaaacaaaatggttataaggtttgaaaaaggaaagataagaaaagcagcattggatgacccataacttctagaagccagggtgggtgcagtgtgctaaatgtgagaagaatggggcgtggttatgtagaattcaataggtttagaacagctcatactgtcattacctattcactcgagttagaaacctcaaagtgagatgtgatctttctttctcattccccttcttcctttttgccctcatttaatcaaacacaaaattcccttggcaatgccctgtatatttctgactcatctctgtcctctgcttcctggtcctttcactactgcctctccctctgcccccatagtacttcgcctatcatggtgtcatgatgagtctttccacctctgttctctctgctttctttccatgctgcattctgccccgttttgctctttgtgccattctttggaaacatccagtgcccagcaaagcatgtcttcttcagcctcccactcaaggccttctgcagtttgtcttcaacttgggtgccacctcctcatagttcctccctaaatttaaccagagtagtcttttcctattactctaaatgtatgttttaagttctttcttctataacttgtttatttggttcttctagccaagaatttctccctttctcttttctgtctgatgcttaccctttcttctagaacctagctcatggtcacctgcttgactgatcactgggttaacagtggtcttttctcacttctgaattccaagcacacttaatataatatagggtgtttcagctcagatttaggaggtagacttccaggttgaaatttttgtttttctacttactacctatgtgccttggacaagttagttagtgtctctgaaactcagtttatttatctataaaactggtatcttaatagcacttacctcagagatttcttatgaggatcaaatgagatgatgcaataaagcctttagctgaatctgtttcgtagtgagtactcaagaaatactagctattttgtcattcagttggtccttacaataccccatagccatttgttagcttttctggcttgcatacaatccctttgaaaacagagtttttgtagttacagcaatgctgtatataatatcaaattattaaagacagtggaaaagaatttatatcccccaaatgaatgtcttgactgactgtaagaaagttgctgtttctccttattacattttgaccacaattgaaatgtggtcaaaggagaccatctgccaaaggagaataattacttcttcacagacataggaaaaaaaactcactcatggataaatatgtgtgcatatgtgaaatatgaatgcagtgatttcacatttttaaaattcctggcaatcaaatgagattgtgatagattatcttttttttttctgagatgaagttttgctcttgttgcccaggctggagagcaatggtgtgatatcagctcactgcaacctctgcctcccaggttcaggtgattctcctgcctctgcctcccgagtagctgggattacaagcgcccgccaccacgcccagctaatttttttgtatatttggtagagacgggatttcaccctgttgaccaggcaggtcttgaacttctgacctcaggtgatgcacccacctcggtctcccaaagtgttgggattacaggcgtgagccaccgcgcctgaccaaattatctttcttagagtaacttttcttcatagatattaatgtaacagttcttatggatgatgtttaaaatgcttaaggaagcaaaacttagctgtaaaattgggtattgcttgatgatcaccagtgtcccattgaggtctaaaatgcttatgaagtttaaattgctttgcagtgtgttatgatctttcaattatctttaaatgattgatttaatgagcttctattattatattttaggtatggtgtttggaatgcaaagtgaactggacagtttctttcctggaagatcttatagttcaggggttgacagcattttctataaagggccaggttagtggcttctcaagtggagacaagtttgaccccaagaaatatttgacaatatctggagactcttttagttgttgaaactagggtggaggagtggttggaggggagtaaagggatattgaagggaagatgctgctggtgtgggcagaggccaagattgttggtgcactgtaggcctacaatgcacaggacagcccttcggtgacaaggaattatccagtcctgggtctcaacagtgccgaagctgagactctctggaccagacagtaagtagttttggtttaatgagccatatggtctctatcacgactatcaaactgtcattgagcatgcgagcagtcatagatactgtataaacaaataagtgtgtctgtgttctagtaaaactttatttagaagagcaggaagtgaattgaattggccccagagggttagtttgctgactcttgctatagttaaatggcaggcaaaacttgataattataatgcaacatattaaactctatctatctatctgtctgtctgtctgtctgtctgtctgtctatctatctacctacctacctagatctatctgtctacctagatagatagatcagtcaaagttttcacaggtttacaatgaagccccagataagagcacttagcctgatctgagatattagagatggtctcctgaaagagaaagaacatgaacaaaagttaaaaaaaaattttaagagtgaggagttagacaaaaacagtaattccatagagagagaatagcgtcagtaaagtcacaaaaatgcaaaatagcatgataagcatagagaactaataataagctaaaggaagtagaagtggcggtaatggtagtagtagtagtagtagtaatagtattgttcccggaaagggatcctgatccagaccccaatagagagttcttggaccaagaaaaaattcagggtgagtccataaagtgaaagcaaatttttaagagagtaaaggaatgggaataaaagaatggctactccgtaggcagagcagccctgacggctgctggttggctattttatggttgtttcttgatgatatgctaaacaagaggtatatatttattaaatacctgctaaagaccaggctctgtgctaccgtgctacacaggtagtttgattattacaggtctgaggcctgtttgtccggatgattttagttcacacccatagtgacacacgggtctcttcttgcttcattgctttttccctttttctgggaaagggaagaaagggagggcgattcctggaactgaggattcctctcctttttagaccatatagggtgtcttttaacatgctaataactataattagtgtataatgagcagtgaggatgaccagaggtcacttttgtcaccatcttggttttggtgggttttggctggcgggatttttttaaattttatgtatttatttattttttattatactgtaagttctggtttacatgtgcagaacgtacagttttgttacttgggtatacgcatatcctggtggtttgctgcacccatcaacccgtcacctacattaggtatttctcctaatgttatccctcccctagccccccaccccctgacaggccccagtgtgtgatgttcctctccctgtgtccatgtgttctcattgttcaactccctcttatgagtgagaacatgcggtgtctggttttctgattttgtgatagtttggtgagaatgatggtttccagcttcagccatgtccctgcaaaggacatgaactcatccttttttatggccgcatagtattccatggtgtatatgtgccataatttcttaatccagtctatcactgatggacatctgcgttggttccaagtccttgctattgtgaatagtgccgcaataaacatacgtgtgcatgtgtctttatcgtagaatgatttatagtcctttgggtatattggccggcttctttaccacattctgttttatcagcaaggtctttgtgacctgtatcttgtgccaacctcctttctcatcctgtgacttagaatgcctaacctgggaatgcagcccagtaggtctcagccttgttttacccagcccctattcaatatggagtttctgtagttcaaatgcctctgacagcaatagcagttaacttttattgagtgtttaccatgtgtcaggaactctaagtattttacgtgtgctaacacatttcataaacatagagctcagtgttgctggagtaatgtaaaataaggtttaagatgtgtgcatgcaccagggctagggccttatttttaggtggatataactgggtatgagaagaccaacaaggaggtaatgagtaagatttattaactgattggatgttccaggtaagggcaggaagaagccagaagtttctggtttggcaacattaattgaatgtaggtatgctggaggagaggcaggcctaatggggaaagtgctgtttttgatgggttgagtgggaagtacctgtgttaactgcagaacaaggtcaagtcaaatagctggagttgtaactgtaattagaatataagcaatagagttaaattaattgaaattgatgagatcagttaagaaaccacatcaaaaggaagaacaatgtattttaaagaagacttctaagagtaactaatatttaaaagaaggcttaaaagggaaaattagtgaggtaggagaagaactagagaaaacgttgtcatcgaagctaagaaagtaggaagtttccaggtatatggcatagtcagcagaggtcagtgccaaagagaggaccaatacgttgagaactgaaagtgccctcatagctgagaatttagacattgtaggtaatcattttgttttgcttttgaatgacagtgataatcattttcaaattcagagagaaaaaaaggcagtggaagtggaaaagctaaagatataagaaaactaaatgttgaaacaatatcccagtgaataatttcaaacttttaaaaatgtatttattaaataaagtacatataagaaatgttgctattgggtactatgctcagtatctgggtgatgggatcaattgtaccccaaacatcagcatcacacaatatatcaacctgcacatggaccctctgaaactaaaagttaaaagtataaaaataagtaaataaagtcaaacatgtgaaaaaaagaaatatttcataggctttttttcagttgctctaaatttttaaaaatacgtttatgcattttcctataatttgtgttttgcatttatattctccttttctctaattgattagctctatcattagatttaactgatacttagagtttgattggctcaccatctatttatcataatacattgaaaagtcacagttgaaaactataaaacctcaaggatgtatttatgtgtttagcaaatggaacacaaacctcatagatttgtaactttgagacaccaaagaatattgggagacacttatcaattcagttgagttcaattcagtttaaggcatttgttgaatgctatgcatttttaacagtgatatgacaggatttttctttcctttcaaagcagcttgccatcttatctgtctgtatgtttattgcataaagaatttacagcagataaagatgtagttggtgcaaaaaatatacagaacttgaaagatctaatcataaagaaatataacaaaatgctatatcatatagcagagtcagtgatacaaagcaatttgtactaaagactttgggagggagagaccaacatgaactagaatattgtgagcatctccatctaatgtttctgcctaaatgctgttcttctctagacagaactcaaccaaattactcttaacagaagaacaaatgcaagtgatgaagaaccaagggacaagcaaaggcatcaatatattgtttgctatttgaggaccaactgtatttatttatctttgtatctccagggccaggcactatggctaccatgtattaagtacatgcagtcagtgctgaattgattacttctggtcattagattagcacagctgagctgaggtagcttggaccatgtgctatgtggatgcttccctattaatgatgctaatgacaaagagaatcaggtccaagagacagtgagttgggagtacgccacctatagaggactaggagagaaaatatttttgaaagagaagactaaatgctagatgcactattaatgggaattggtcacgcccacaggactcttccctctagcataacataccgatatataaaaacatgcttgctgtgtgaccgaatgagccaatcctggcttaacatagacaaacaaaaaagaagttgccaatgccttcttcagttcagtatctcatgaaagaaatgcaaggtgaagagaaagcttaaatgaaaaaaataaagtgaaatctgtaagcctggttctcatttctaagggtttattatactggagatttcatgaaaatagtattgagaatgactactctgtgatttttgctagcttttagtccctataggcagaaaagcatttctaaaagagatttgaaaattgtggactctgataacactgctagttgtcatgtttttctctaatgaacagcttatcagtaaatgtgctcagtggttaattaccacattagagtttattggcatcaaatgtagtagaatgccgattatccttatgcaaatttggatttactgcaggttaaatcctgtgacctgaaatctaagtcacctgtcataaattaataggtccaggtactaggcctgctgggattggcagtgacaaaagaccccatgagttgggggaatgaatcaaacctgcatgggcaagattcattctttggaatgtctcacaaagcctggtgcagccaattgtgctgcagaggctgtgtggtgtttttgtgttgttttgattttgtttcattttacagggcagccaggcagtccaagcaatggttcaagccactattgatgccagcggtgtcatccatgaggtggcactggcacttggaggttataggagtcaggtggagctatatatggttccaaaacacatgtcaagtttggggtgtgggtacgaaaataaagacagattcccagatgtctccgtcagttcaggctgccctaacagaataccatagactgggtggcttaaacaacaaacatttatttctcatggttctggaggctggaaagccgaagatcaaggcctgcttcttggtctgcagatggccttctttttgtatcctcacatggtggaaagcagagatcatctctcttgtttctcttctcctaagggcgctaatcccactcatgagggctcctactcatgatctaattagaaccaaaggtcccacctccaaataccatcatgttggagatcagggcttccgtatatgaatttggggaaaatgtgaacattcagtccatggcaccttccgtaggaagtcttgtcatggcccaatctaagcaaactaaagttcacagttatctcaggttttttgaggggagtggaacgtaagacagcatatccaagaccatcatccaaaaacctatgcctatagtgggcccatgtgacagagcagatatggctgccacccagtggccacatggcagcccatagctcatgagtgctctctgggtttgcagaccgaactgcctatcagaaactgggacagaagcagctattatgcctcctgtccctgtcaggactgggtcaggaatgagggcattagggcttttgtgtgtctctcagattaaactctgctcacttgaggttaaaacaaggcagaagctggcctgagataatcaaagcctctttcaaatctatttgcttataaaggcaaggtgtttttggtgtctacaaacttctaacacatttgtaggcactgattattctgcaaataatgggggacctttctgaagccctggatccctggccaatgcaccctactccaagcacattgaaatttttaacaaaatttttaataaaattgagagatccttggcatctcaagaacaggaaaatcattacttcttcaaatgaatcattggtgctcataagggaaaagtctttcatgcctagggcatgtatccagataattttggtggggaataacatttcttaccacattgtgagtgtttatgtggctggggcaaaagaagttgtggtttcggtgctgatccattagcagtgagtgtggtaggtgaaagttccttaattgttccccagagtaaaaacatcccagtatttatagactattaggggagagggggttggagaggcaggtgacttttcagccctacactgatgacttttatgtcttccaggtcacattaaaatgttttgcttgaattagaataaaagtagtcctttttgtccactctaaattcagtgtcttggttgaaagtatccacagaaaacattcctcagtcttcataatttcccatttacaatagagaagcaaggctctctgtacttaagaatagtacaagctattttagatgtcagatgtagtctaagaatgattgagtcaacaaaggagcatgaagacagtgatgagttctccacacagcaggtgctcagtgtagggtgataaagaactagaatggcagctaagtaggtggcaccagactctgaagaagcacttagtcattgtctagaatgtgccagaccaagtgcagttttaaagctctctctggtctccttgtcctgtgaacagacataaggcctaaataagaggcagaattgggaggctttttctttgcacctcaccttccttaccacctggccttctaggcattggagacagaagagaatctcccacatgcaaatcagcccccaggtcatcttatagcaacaaaagcctgggcaagaattaataaagaaatgagtggaatctaaaagtctctaaacataaagaaatacctgtaagatgtctcttctgagagcccattatatagaaaggagtcaaaggaagaagagaagccaagtgcatggatccaggagagtaactggtccagtgcatttctgtttaccatacctttattcctctaaattttttcagcagttctggagtagctccattagatccttgatgagttaattttgccctagatcaatttcaaagcttaaggatacagtgagaagagaaggtttgaaataccttagggaaattacaggatcaaataaattttattattatgccagctcagacagattggtagtgttgggaaagattctagtgtcacaggaaacaactatcctgaagtttctatggcgtcttctgggccatattttaaaatttgactattcaggcatacctcattttattgctctttaccttcttgcacttttgagttattgaattttcttttttcaaatggaagttttgccgccaccttgcatcaagcattttccaacagcgtgtgctgacttcatgtctctgtgttgcattttggtaattcttgaaacttattattatatttgtcaatggtaatctatgattagttatcttcgatgttactattgtaattgttttggggtgccatcacccatgcccatgtagaatgttcatagataaatgttgcatgggttctgactgttccaccaaccagctgttcctccagccttctccctcccttcaggtttccctattctctttgatacaataatattgacattaggccaattaatagccctactgtggcctccaagtgctcaagtagaaagaaagagttgcacatttctcgctttaaatcaaaagctaaaaattaataagtttagtgagaaaggcatatctaaagttaagataggctgaaagctaggccttttaggcctagctgtaaaggcctaaaagttagccaagctgtaaaggcaaaagaaaagttcttgaaggaaattaaaagtgggcacatgaatgataagaaagtaaaacagatattgctgatatgcagaaagttttactgctctaggtggaagatcaaaccagccacacatttccttaatccagagcctaatccagagcaatgccctaatgcttgagttttatgaaggctgagagaggtgaggaagctgcagaagaaaggtttgaaattagtaaaggttagttcaaaaaagccatctccataacataatagtgcaaattgaagcagcaagtgctgatatagaacctgcagcaagttatccagaagatctaggtaagatcattgatgaagatggctacactaaccaacatattttcaatgtagataaaaagccttctattggataagaaaccatctaggactttcatagctggagagggaaagtcagtgcctggctttagaggacaggctaaactctcttttttgaatctaatatagctggtgactttaagttgaaaccaatgctcatttgccattctgaaaatcctagggccctaagaattatgctgaatctactctgcctgtactctgtaagttgaacaacaaagtctggatgagagcccatctgtttacagcatggtttactgaatatttcaagccaatttttgagacctactactcagaaaacaaagtattttatgtaaaaatattactgttcatcgacaatgcacttagttaccaaagagctttgataaaaatgttcactaagattaatatttttatgcctgctaacacaacatcattctgcagctcaaggagtaatttagacttttaagccttattatttaagaaatacagtttgtaaggctatagcttccatagatagtgatttctctgatggatcacaaagccttttagaaaggattcaccattctagatgccattatgaacatttgtgattaatgaggaaaggtcaaaatatcaacattaacaggaatttggaagaagttgattccagctctcatggatgactttgaggtttggaagaagttgatcacaaccctcatggatgactttgaggagttcaagacttcagtggaggaagtaactgcagatgtggtgaaaataggaaaaaaaaaaaccctggaaggagagcttaggatatgactaaattgatgcaatctcatgataaaacttgtatggatgaggagttgcttcttatggatttgcaataaaagagcagtttcttgagatggaatccactcttggtaaagatgctgtggacaatgttgaaacgacaacaaaggacttagaatattacataacttaattggtaaaggaatgataaggtttgagaagattgactccaattttgtaagaagttcagctgaaggtaaaatgctgtcaaacagcattacatgctacaaagaaatcttttgtgaaaggaagagtcaatcaatgtggcaaacttcgttgttgttttattttaggaaattgcacagccaccccaacattcagtaaccactagcctgatcagtggttatcaaaactgaggcagaccctacaccagcaaaaagattacatctcactgaaggctgtcaacttagatgactgttagcattttttttaacaataaagtgattttaattaaggtttgtacattgtgtttttagacataatgctattacacacttaataggctacagtatagtgtaaacataatttttgtatgcaccaggaaatgaaaaaacatttgtgtaactcactttattgtgatagtctctttattgcagtggtctgtcactgaacccacaatattaatatttttgagatatatctgtatgtgtttatgtccttaagcaatatatattacactttgagtgttcaaaatttatataaatggtatcatactgtgcatatctgtacagcttactttttaaacataatgttttgtctatgttgataagatttatctatgttgatttcattcattcatattaactgttacttcatgctccatacttttttttttttttgtagagacagggtttcactgtgttgcccaggctagtcttgaactcccgggctcaagcaattgactcagcttccctaagtgattggagctaaaattatctcccaccacacccagctactccagtatattttcatccacagttgtgccagagtttatctagtacatatacctagaagtgcagtttcctgctaggtcataagctggatgtttataactttactaggtattgccaaattgctttccaaagtgatgtacaaattcacactcccaccagcagaatataaatattccagtttccttgcatccttgacagtttttggtattgccaataaatcaaataatgtagtataaaccaactcaatatagtgtaagccagatttaccctgtaaaacatatgcctaaagttcccattttaaggtccttgtttctactgagaatccagaggcctcaaaggtgcatatattgcacattacctccctcatttcctattctactaagccccagtgagtggccttccctgcaggtgtcagcttggagctggtctcttctttattagcaccaagttgctgtcttttaaatttagaactgttgtagttcttctagtcctgcagaatttcattactctggcctcaattgctcacatgtaccatctttcaaaaatgtcaggatagatgagaagatcacagggccatactctccttcagacgataaagcaaaacacaaccaaaccctcaaagcagatatgattactgcagcaacaggaaataaaggcacaaaaattgttataaatgattgttttcatagaaaaaaagtattaccaaaatacattcattttttacccactgtaggcttccctctttggaggcattgattagtagatacgaaatccttatcttctctctagagtttgaaatgtataattaacaatggagtctgccagatcaacaattctcatcacagaatgtcctgtgttttagtctttgtggaccatatggttgatctaccttatcattgttattagtgtggacccttttttgtgttagtctttttcttacattttctacaatagttaaacaaaatatttatttttgttgttatatgattttaaaaaccttatattattcagcttagcctgaaagcccaactgtgcaacagaaaatggctcttctcttaattaattaatttcaatttgatgaattaactttaataacatgctaatgtatagaaagctactaaatttttcagaataagtgtattgaaatttctcttccaagagtgatgccagctttgcttcctttatttgtgagtgggaagtgaggtttaatgctacaatggccttctagaaaccctgaagcagtagtttgacaaggatggaaacgttgagatcattgaattattgagcttgaataaacttctgagcattcattgattaatttatcaaataaccatgtattaaacacttccatatgtcaggcactgtgctaagtgttggagataaaatgatgatcagggagaagatatccttctcctggttcaaatccgttgtctagttttcatcagcttttgagtcaatataatgtttaaggacatgagattctacagccaaatagaaggatttctattgctctttggttttgacatttaacttgaaaagtaacactaataatgactaatctataatctaagattatataagtatatgtataattacatataattacatattttatattgtgtatatatgcatatacatggatggaactggaggccattatccttaccaaaccaacacaggaacagaaaaccaaatactgcatattcttatttataagtgggagctaaatgatgagaacacatggacacatagaaggaaacacacactggggcctgtaggaagacagagggtgggaagagggagaggatcatcaaaaataactaatgagtgctaggcttaatacttggtgatgaaataatctgtacaacaaatccccatgacacaagtttacctacgtaacaaacctgcacttgtacccctgaagttaaaagttaaataaagaaaagaagcaccttttctatttattactgaaaaaatacatattgtaaaccttaaaaaataagagacgacaggttcttgagcagaaactgtgattcagaattttggattggctgcacttgaaatactaacataaagactggttttgccagtggaatctgagtttggaatttgactcctttttttcctgctactcccttccccagcttgtacatgaatgcagtcttctagctcatttaaattagttctttaacttatagcaactgaaagtagagtggtttgattttatcaactggaacaaacaactcaacagtttttgtagtttttgtctgttgctgtccctctccttttcagatgtcattaagtgactttcctgggcttaagagtctaccctgaggacctcaatactctggtttctgcccaagttgtctggtctacctcctgaactagcatgtctacaatctgaggaaatgcaccctaaattgataccctgatattttcagtgggctatggattggcaggaagagaccataaacacacactttatttaatttctgagttaattatccagggataaaagtattatcagaaacatggtggctacacaggaaagcaacagatgtagtattcactaaaacagcttcatttggtacccagagtccttcatagcagcaagcagctgatagagacactccatttgggggttgagtccttccaaatctttctggaaagctcaattctttctatgacacagtcttatgtgcttggggcttatgtcacattctaaaataattgacattgacaatcgatgcatgcccatttaaaggattgtttttgaacactggaatctgtcagttcttaatgcaaatgtagcatagcaaggccacatcttcttctggagcgggagttagaatccacgtgcagatgttctggacaaatggctttgcttccagatttgcaaaatgttcttgaaaacccttatccctataggcacagataccataagagaaaaaatagaaataagtaggaatcgggattgggatttgcttgaatctttacagcaagaccctctccatattttcagttttcaaaatcagtgaaatacttcagatcagtggtttgtaaattgctctgtggagacctcagattctttgataatgccagaggaggaaacataagtatttttcgtttgttaggacctcaatcattcctggataatgaattttcagaggggaatggacttggtttattttatagactgtttgagcctaaaggaaaatgactacacctcccaaagcagatgactaattttcagaaattgttttttggaaaagtgggtctcctttttaatttcccattcgcaccccatgtatgttctcttatcagtgaaggagatgagaagccactctggggaaaagacacgtagaagatcaagaaagctcttttcctcattgcgtgattgatactcggttttgttttttttgttgttgttgctgttgttttatgggagtcttgctctgttgtcaggctggagtccagtggcacaacctcggcccactgcaacctctgcctcccgggttcaagcaattctcctgcctcagcctctccagtagcagcgattacaggcgagcgccaccatgcccggctaatttttgtatttttagtagagatgcggtttcaccatgttggccaggatgatctcgatctcttgaccttgtgatccacctgcctcggcctcccaaagtgctgggattacaggcgtgagccaccacacctggccgattgatacttttttgttggttcattccagtgctgaaaattgggctggatttgccaaaacaaatctgaaactggctttctatgcctgtggattctgttcctattgtctgtccattcactgttctgtttagttcatggattaagactgtcagcatcacgaagtatcagcagtaggatgtttggtgcagggaagatgtgagcacctgcatatcttccctgcaccaaacatctgatactttttttttttgaggaaataaaagccccaaggaaccaagtacgacactttgacagtcattgggctttttgagcctgggccttgttaaggcagctgcctgtaccgttgtggaatcacttcagctactgtctagtcctcagtgctacagcctcagggcattgattttagctaataatagtggtcaacattaattgagcatttactatatgctaaacagtgtcctaagtgcttacttgtaggaactaattcagtcctcgcagtaactctaggagacagatactacactgtcattgtggatgggatggggtttgggtggggaattggggtggggcttgttggggaaagaatctaaagcacaaagatagctttcccaaggccatgctgctgatttgggtttggaactgggattaaaatccacattctcatgggttccaagcccatggttatagtcagtcattatgttccacttcctcactagctcttcatcaagtattatcagaaagcaaggaattatttttcagactagcagaaatttactagtgacttagtaatatgtcagaatgtcatggtagaaaatcattccagagctttgctgtttagtacagtagccacaatccacatctggctgctgagcacttgaaatgtgcctggtctgaattgaggtgtgttttacgtttaaaatcacactgtatattgaagacttaataccaaaaaaagtgaaagatcttagaaaaagtttcttatgttgattatatgttgaaatgataaaattttggatatattaggttaagtaaaatgtattattaaaactaacatcactggcttctttttacttttaaaaaatgtagccactagaaaatttataattacatatgccacttattttatattgctattggacattattctagagaattaaaaatgtgcaaattatccacagccatttcctcatacctgtgacactcagtcattcatccgaattagcttgtggtcagtttgaggcagtttgtctaacgtttgagttacgagatcagagcaagaggtgctggtccattttagacgtgctttatttagtttgtagaaaaacacactgaaccatcctattccgctacagagtgccccagcttcacaaagcagaatatggaagggtagactagtgaaaataagtaaatacagataaataggttatgacatgtagttgagattcagataagtggagcaagattccgcagattgcactgtattagtgacagtgagtgtattctaagagaggagaggatctttatgtgtggtaaaagtagctggggaccaagttgttgagaattttgtatgtcaggaaaaggaatgcatttggagtgacaaacttttgtcactttccaaagactccttttagaattctttattgatcaatagaatattttgtcgtgacttacttcataatttatgatatgttaaaatttccaaattttctgtttattttatgttagttacatcttagattgatgattccctggtggaatttggaaagacatcttaatcacaccagcagtatttatgtaaaccatttttaaggatggtttacttcttagttaactctaaaggaaggataatgtcatctattgaataaagattctcacttttctacttggagatcatattgtcttcttaaatctttgtcccttaggctttgataatggactacatctcatctgggggcctctcttctctgactgtattaaccatacttatcttggagttgaaagaccttggaaggaagccaggatctaacagtcagggtctatggatctttggcaagtattacaggcaggccctggatgtgtggagtaacagaggcctctaacgagggggcacaatagggttggcttatgtggacattacattctgaaattggcacatgaggttaaaaaatgcttataatcaaatttggcctggataaggcttttaaactactcctaaattagacgcttgaaagctccaaagccaggatttagcattgttgattttgctttgtatttcttctgagacacccctttccaggagacacggaagtcaggtctacttggaatgaggaaaagggttatgtggtaaatagaaaattctcagtccaggcacaatggctcacacctgtaatcccagcattttgggaggctgaggcaggagggtcactcaaggtcaggagttcaagaccagctgggcaacatagtgagtccccatttctacaaaattagctgggcatggtggaatacacctgtagtcccagctacttaggaggctgaggcaggagggtccattgagcccacaagttcgaggctgcagtgacccatgattgtatcactatacttcagtttgggagacagagcaagaccttgtctcaaaaacaacaacaaaatatcctactccctctcattttttccccaagagtattgaaagctgaatttgtgtaagttatacataaatatcatgcaacttcattgtactgcttattttcctaataagttaattgacttgtattatgctttacatattttgggcttgttacttgtttgtgcctaatgtatgaaaggcagctagaacctatctttctaaactgaagagctctaaatctggttagggaaatagacaagtaaatcaagggttataatgcaaattaagaagtactttaacaaggcctttcctcagtgctttaggaccacagaggaggagccattaaagtgatctgggcatgagtaaaggctgtatgtgacatcctagcctaagctaccatcatttctcattgcattggtgcaacaactttctaaatgctttctctgtttctgtttttgcccctggatctccctctctcccaagtctatagctccctagcagctgcagtattcctcttaaaaatgtaagaggcacatatgctcctatctactcaaaaccctccagtggctttccatcttgctcagaatcagagctcaagttctaaaaggcctataagaccttgtacaatctggcccttgctgcctctctatcctcatctccaatgtgcacctcctcattcaccctgatgcagccacaccaatctccttgatgttctttgaacatgctgttcacatgactgctcaagacttttgtccttactgtagtctgtctgcttggaattgtcattactcaaatgtctgtatggcttgttctctcatgtttccaaagctctgaagaaatgtcacttttttttttttttttttttgagatggagcttcactcttgttgcccaggatggagtgcaatggcatgatctcagcccaccacaacctccacctcctgggttcaagcgattctcctgccttagcctcttgagtagctgggattacaggcatgcaccaccatgtcagctaatgtttttctttcttttttttttttttttgtatttagtaaagcctgggtttcacagtgttaggctgatctcgaactcctgacctcaggtgatccacccacctcggcctcccaaagtgctgggattacaggcgtgtgccaccgcacccggccatgtcacagttttataggcctttcctgactaccctgtacaaataaaaacaagaataagcctccaccctatcctagcactccttcttccgtttagcttgtccatcaccatctaacatgccgtaaattcacttctttatttgccccatccccttagattttaaagttcatgaaagtaaaactgcatctgtgtcatctactttggaacagttcctggcacttagtattttaattcaatacatgtttgttgaatgaataacttacttttctctctggcatggcttccacatttatttgcctaatgagtggatcgataaatgaatgatgactatattctcttggcactagcagaatctgttatttcccaatgtaccatttctctgaaataactttacagttctttattggaacaaaagactttatcaggacttgtcaggagctcttggattctgccaagacagcatctcactcacagatggaaattgccattaattgtctgctttgatggtggagcacaacattggaaaagaagacgcctcctggaaagcaggttttgccattggtgagagagaataagagtgaattgggctggccacagcctccctcatattgagaaacccaattggtaatactcagctagcatacagattagtaatgtgtgagtgtctgcatgtgtgtgcatgcttccgtgtttatatattaccagtgtatgtgcgtacctttgtatatatgagtaaaaatatatatgaagtaaaaaatcaaaatctaataactcaaaatccaaagacttgaacaccccaagggaacactgaagtctcagcagaacccttgatgcttgggaaagtagaaatatagggaaggtttgcataattccctgtgttcacttctagctcactgaatgtgactttctgctgagcctaagcatacagcaatgaataacaacaatagtaacaacatgaggggtccctgctttcatagagcttgcattctagtaagtggggcaaaaagcaagcaaagaaatctaagttatatatggtggtataaatgctatgaggagaggaaataaagcacaatgagggagaagatgatggagtgcattttagaaatgggaattgatagaatctgggatttgcttgacaaaaagttgaaggagaagcagatgcaaagacctgagattcaggtgcttgttgaattcaagggacatgaaaaagaacaaattagggaaggtcaagttatataaagcctttaagccatggtaagaagtttggattttattctggttacaatgaaaaagccatcaagcgctatttagcaagggagtgactggtctgaattaggaaaacccccctggctgttctatggagggtggagtatggtgtgtgctagaagagacagaagatacatagatggctgttactgcaacccagggaggaaacatagcaatgtggattagagtagaagtgatgggaattgtaagtagatgagtgtgggatatattttggaggtagagtcaacaggatttattgatgaattgtacattgagtatgcgaggtgagtaactgaggataactttattagtcaagataagctaggctgtgttgtggcaacaaactgttccaaaatctcagaggcttaacacaaaagaggtttatttctcagtaatttgtatatccctgtgttttggctggtggctttgctttgtttattattgttcttactctaggacatgggatggcagggtaaccactaactggaacattgctggttgacattgaaaagggataaataaaatttaaagggtttcaccctgggagtgattaagcatttggcctcgacatgacacataacacttctgctcaaactaattggccagaagtaatcatatggctccatcctgcacaaggggccgataaatacaatcctgtcttgtgccaggagacaaaggactagagcctactcagacagcaacaccaatgactctatagtatcttcctggtttgaataactgttaatggcattatccaagtgcagatatttgaaaggaatgagctggggggatgtgaaatccatatttcttttttagccttttttagtttaaaagcctattgagtggagatgtcaagaagacacttggagatatgattcttaagatcggagaaaatctaggggtagagaaataaatttgagcatccacaacatgaatatgacacttaaagtatcaggacttataggtacctgttgagaaccctcaagttctatctttggattcctataaagaaggaattcctatagagaaggaatccaaagacagaacatgagggctctcaacaggtagagatcttacagagagaaaaccaacaaaggaaataaaaagagagaggttctcatggtagatagaaacacaagagagtattgaatcttaaaaggcctcaagaagtaagtattgcaagaaaaagggaatgctgagaggtcaaggaaaatgagatttaattattggatctggcaagctattgaccattttactggtttggtataaagaagaggctaatttaaagggggctgagaagagaatggtaagtgtggaattgatgaaaatggtcatagacaacttttggaagagttttgctgtaatcatagcagtaaagtggggtcagtagtgaaaagggacatggtgtcaagaagataggtggtcaggaaagggagcaggtttgtgggccagatgatggttttgtcttttgaaatatgctgacctgataaaaaggtattcaaatgaaaagcattcagatattagttggagatataagtcagacatagagaaaaaccagtgccagcataaacatggaggagccctcttcatagagaaaagagaacagggaacacagatgggctctgataggaaaagtatagagaaaaaagattgagcgctcacattaataaaatcaggagaaaaaagcagattatgtcctagaaatcaaggaaagaaagtttaaatacctttgcaagaggtttttcttcactttctatgttcctggaaatatgtagtctatattctgtactctctggccaaatttgaaggggatagtactgtagctgattaaatatataatctaagaactgtggaataaagataggattaaaggttttttaaatctcaaatcagtggggttgatgctctttgtgtttctgttctttttgttattgttttctcttgttattttgaaatttctctaaaaactacttaaaagtatagttagtgccatactcatcgttgtatttttcttcttttttacctcctcctcctccttcatcaccatcttcactaatgattatcactagcaaaataatcatcaccatcagacttcattaaattaactattttggtattttaataattcagagctatttttcataatttggttagaactactgaggggcattcattttagtataatagaacatttttatagcacttcttgttatttgagtacttattaaatgcttactttaaacatgggcataatttctgccctaagtccttttcagttaaatttcctaggaaagatacaagagttccaggatggaaaagaagtgctcagagggaatacaagagattaagaccacaaatatatggtatcactagaataatttggcagaggtttatttctatttaggttagttggctataataaacatatgtagataaatagtataggaatatagtacagggtaaaatggtgactcaatatcttaatatcaaatgaaaaatgggctgcttcctccttctaggctggaataatgtactattattgacaccccttctctggagtataatttggcttagttctggtggtctgttgagtggcttggtctcactctctttctctctctctctctctctcaacctctctcccctctcccccttcctcctctttctctctgcccttccttctggctgtccatccttctctccctcctccgctcctccccactatctctcacttctccaactcagttctttctatcagtgtcttgacatctaactagttaccctagagacctcaaagcaattattctttccttaaacattctttcaaaacccagtcgttccttaggcatattgacttgaatcatgtctatctttgccattgctaccttcttagttctaatattcatcattattttctgggttacctccatggcatcctaacttgtgcctgcctcttttgttttattccactccaatgatccctcctattcacatgcctctcctccaaccttctcccatcttagttattgtgcttaagaaaattatggatcatagaccaagtataggatagcagtgtgaggaagtagattgaaggagggagacataggagttggagttagaactagttcggaagttagattgtacttgtcaatgagagacttaatccagattccatctctctaggacagaatagaccatttctatctacatggagtatcccttacatgatatccatatttctctcttaacatcattgtacacatatgtttacatgtgtaacacttctactaaattgtaagctccttaaggtcagagaccatgtcctaacattcagtaagctctccatggttgtttgttgagtaaacaaataaaatatggtcttaaatagaaccagtgtcagaaggaatagggtggagaaaatgaatataaaaaagattggatatggaattaaatggacttagtaaaatattaattctgggacaatgaagagagaaggttcagatatatctacacaaatttgagcttaggtgaccattaacagaaataaggaagttgggaggaggaaccgatgagtttgcttttaggcaggttgattttaaagttctgtagagaattttaattttaggtggatgaattgttccagcagacaattcagatttgaagcctgaagctttggagggagttttggtctagaagtaaagatgtgttagtgagtgaaattaccaagacaccgcagtgaaaacaggaaagagagccttcatcagatgcgtgggggaagcctctttttaagaaatttggaaaaggagctgacagaaaatgagtctgaaaatgagaggcagaaatgagtcatcaaagagttacttggaaagtgtacagtcaggaaacccaggaaaagaggatgttgaggaaggagtgagagaaatgccagctattgcacagatattgcatattatgagaatggaggcctatataaatttgagtagtagaacatcagtaatattattttagaattatttgctcttgggttaaatatgttttctcttaggaagcaactaagttaaaacacgatatttagagtgctgcagagacaaggttgtaaaaattctctcctatatcatcggtggttgaataaaattcctttattggtttttcttggaactgtaccctctagccaaacagcccagtggaatccagtgatagaagccaaagaaataaaagctaagtgtctcaatttatcctgttgtcactttcagctttctctgctcattattagataccaagataagcaatagatttaggttttttgatggaattctagtggatgccttggctctctttgtcctggatctagggacactctagtcagattctcaaattttttcttttttcttttttgcacattcatggcttgaataagggtaagagagcccgggatagatgctaacaatctttcagattgttatctgaaatagatatcttgagatatgctgttagtattttcttcaaggcatgccatgttgttagcattttcttcaaggcagcccatgattaggccagaggaggaggatgccgctattcacttctaacctccatccttgaattatggtaaatacagaagatgcttgctggtcagaagagagttgactcattatgtcaggtagtaaaccaaaaattttctccctttatgatgaaagaaaacgcagataaaagcatgaccaataaacaagccataagaatggggaaaacagtgatgacacggggttagtgctatagaagttcccagaaaggtgtttgaaaactctgggcctataaatttaattatgtactattatttactaatattatatactaatatttactttgtttggaggtagaaacgctttactatccacttgtctttagtgtgaacactttcttaggaagcattaatgaaacacctaatactacctgcttccatggcagtccaaaattaagctctaaagattgaggagtcagaggtaaaggtcggtaggtttttctgtggtcttgacttcttctcaagatatctatttgatttccagtaataggaagtggctcccaattacatctattcccagggtccctccctattctcttgtcatcttgatttcagtttggcctgattagatggtactaagttttctatatggtaatttatattacaagaaaaattggtaaatggtgggatactgcttcaaatctgcagcaatataggtaggtgtctttggtgaggttttgtttgcaattataggattccctagatggggactctttcatgaaaaatcataacagcaagtggttgaataaaggttatttctagactgttttctccagactaattagagtagtacaagggccaaccatacagcctcatagtttcaagggtgctttgggagtcagatggacttgagtttaaatcttgcctctgccacataaaagctttgtgagcttggacaagtcatttacttctctcagcctcagttttctcatctgtaaaatgagataattatggcatcttatagaattgttgcgataatttcagatagtctaaatataaagcatttggcaggccaggcgcagtggctcacgcctgtaatcccagcactttgggaggccgaggtgggtggatcatgtgaggtcatgagttcaagacgagcctggccaacatagtgaaatcccgtctctactaataatacaaatattagctgagtgtgtggtggcacacgtctgcagtcccagctactcaggaggctgaggcaggagaattccttgaactcaggaggtgggggttgcagtgagccgagatcatgccactgcattccagcccaggcaacagagcgagactccatctcaaaaacaaaacaaaacaaaacaaacaaacaaaaataaagaaataaagcatttggcacagttcttggcacttagtatctagccttcattattagtcttagatggaaaactggatgcctcaatagacctggccaggacagcattcccacagtctccatcaagtcagcaagctttatcagctttatctctgatatttctttctagacagttcctctcctttttcatcattaccactactgctgtagacctgggcactaccttctcttagttggattttttggtaatacttatacacggttgccatgtagttctcataaaacttgttttgttttgttttgttttttcccccactgctcaaatacctgctctagatccctggtcctcagctttgtacttaagactatgatttggtatgagccagttttatcaatttaatcatctattttttattttcttcacgcatttctccccaaacacacatatcatccccaagccaataataattcctttcaaagtactttttgtacttttggtcttatgtatgtcatgttgcaatagcttttcaagttgattttcgtgtgtgtgtgtgtgtgtgtgtgtgtgtgtgtgtgtgtgtgtgtgtgtgtgtgtgttctcttgctttcttttagttcattccctatgtgaccaccagattaatcttttatataataccaacctgacctcgtcactcttctgaaccagagcgatttcctagtgcctttaggatcaagttaaaacttctacatcagctggatgcaggaggtcttctggggcatttttcagcctcaactcaactgtcactcccactatactgtgcaattcaactatattgattgctcttgagactacacatatgccaagatttctcactctcatttcttgccatccgtgctatttcttttaccttcctatttcaaaacctggctaatgccactcatttatcaggtctcaccttagtactccatcctttcaaaggcatttctgattgccccttccctctgcccacagcttgaattaagagctcatccctgatttcatggtagtttggaaatatctttttagaaacctttatcatgcaaattgctcattttgattttctgactgtctcctcttctaaaagaaggcttacttgcagtattttttaatctttgtatttccatagagcatgacactcaataaatatatgagtgtgtgaaaaactgaataaatgtgtgtatgtctgtttcttttaatagagtaagttattttagggaagggccaatgactcttttctgcttgtaggctccacgtttcctagcatggtcctttgtatataatagttgatcaataagtagtgtctgaataatgatatacatgtctatcttccccagatcattctaagtttttcagcaaaaagattgtgtcataagaattagatagcctccagcacaacgaattacaaatacttcatactctaatgcacatgtttaatttttgcttggagttgaacttaagttatggtgccttatgagagagtcaggcagcttctctgtactacataagcatgtactcgatgaagcttggggtcaaaaacctggaaactaagtttagttggaaatttaaatgctggagactggatgcatcctaggagtggattactagtattgatactcctagacaattttctattcttatttggttctttctccataaacctgaccagtccatgtatagcaagcctcaaaggatgcaagccttgttctggtgttttttattgcaagtcaaagtctatcaggagctgaggaatgagcagcagtgggagggtgtattaatttcctgtggttgctgtaacaaattatcacaaatttggtagcttaaaaatagtaattttattttctcataattctggaggtcataagtcagtttcactgggctaaaataaaggtgttaacagggctgcatgtcctcttaaatgtcaaggagagaatctgttgcttgactcttcccatttctgatagctgcccatattccttggcttgtggcccttaatctctatctccatattcacatcatctctctgtctgtatgtgtgatcttcctttgccttcatcttataaggattcaagtgcttgcatttagggtccacctggagaatacaggatagtctcacctcaagatccctaacttaatcacatctgtaaagactcctttccaaataaaataatatttacagtttccatggattaggatatatctttggggaacattattcagcctactacagagatacctttctctttttgtagattcaaagtgcttgatcttctaagaacattgtttgcttacagacatatttcaggagtaaatgacttccaaactgatggtccgttgaaaaaaagcctggggctgctgtcaggaaaggtctaatttaggtcagcctaatgccactgaacagatgtatatggcaacattcccaactcccattaggaaaataagccattaattaatacttattgaggagctgataagtaactggaagagctggtctgagttctggacaaggaatcagtgacaatcagtttccactgtctggctgttgtgggtagattgtggtccatctctgtaggataaagtgtgcacagttggcttggcactcactcttctgtgtccagcagtagctcttgccatctgtcttatcaagagaataaaaatgggtctaagttgtcactgggagattactgagtatcagtggacactatgagctcgagtgggcaaccccatgcaaggttagagcagggacttcaccaatgtttgaattagggaacttcagtacctaaaattgggatgcagatgtttcttgacttcttcatgtcttttccacctctttcatataatctaagggggatatggaccttggaggagtcttcctcaaggctttggcaggtgctcctaaacatgcttcatccatgcctacttgagtgtaatctgctatcttaagccacaggcaggagagatcaatttttctagtaacttcttttataatccagctagctgaagaagtgtgatcaaagaatcttaaaagtgtgatcttgaagaatcttagtttctcttctgttgtagagagaggatagtaatagttgctaagcctataggctctgaagccagacttatctctatttccatgctggctccactacttaatagctgtgtgagcttaggtagataataaaatctcagattcccagttttctcaattgtaaaatgaggataatagtaaccaatatatgcaaggtgccaggagatattctaagcatgttacatgtatttaaccttcttattctcacatcaaccctatgaggtaaatgtactattgttatcctacttcaaagatgggaaaactgaggtacagagagattaagtaacctgtctagatcacacagtaacaagtcgcagaacaagaatttcaactcagagtatatgcttcaactcagaatatacttcaactcagcatatttgctgttaactatattttatgctgcttcttgtgcctcagattgtgaggatcaaatagggtggccatctattccaggtcaccttggaaagttctgggtaatatctcctgtccaggtgaattattaatagtgcctccttcttttattctcaaaggtattgtcacatcttggtttgaatatatttcacatttggattaaatagtctttacatgtgaaacactaagaacaatgaccaacccataggaagctctctgttaatattagctatcactgtttctactactgccatcaccaccactgtcaccatcacccacattcatcccaagtctgggacccttagggttaggggattaacccaagttctgcaaaggcatgtcatgggagccactgttcccagttcccacacccgtagcagacattgctcgttgatcacagtacaacagtcttccttacttagtgtcatagacaaccattcgtgatagatcacgtttgagatgtgaaattaaaattatttatcacacctagttttatttaatctcagaatacaaaatcccagcgtatggagaatctgaatttagtctgagcttgtggttttatatgaaaacttatttgattcctagaagtgataatgaatttgggacctctttagacatcctatgtcccttttctccaatatttctttctacctatttctctattatttctacctcttcttttatataaatataaaagaaatttaattcatcagtttcctattctctgcctataattttatatgttataataaaagactattgaaatactaccaaagtggacacaatataaataaggcaacggagtgagtcatcataggaattacagttggcacccaagatcaaaggcttagaaaatctatctttaaatgtgatttgtgtaactggtagtgaaattcatttcaggttgattttgcatggcataagggacatctagtggtgatctaggtctctgcagatttactaaaggtaatgcaaactcataggtaaaagtattagggcctatataccatcaccttgaaagggagtcccaagaaaggaggggaccttttgttgcatgactacttttaagctagcaaagtgtaaagaaaccttttttggaaaaaaattaattcgagtaccagcatttctgtctatattattgtcagtttgcacccaactcttatttgctgcctcctgtaccaggttggaaatcattctgttatcagctacctgccaacctgacatattcttcctatcactttccccacctcttttgctgattgcagaggggctctttggagcactttgaaaagccacctgattaaagccttcattaggctagaagcagaagtgcttcacaggccaggcaagaaatactttgtaattgcttctgacgggcagatctcctttggcggttgttgagccatcaggaagccgtacagcactggtccacgtgtattttgtataaattagtgggcttgacattacaagaggttgcccctatacgcagtcatcttcttagccccagagttctggaacttacccattagcctgcacctctttatagaacccgtcttacgcatggttctgaactaactgcttctgtcacctggattgcttacaatacctgcttgcctcatgtgctactattgtttccaaccaactatgctagacttcttaaaggttctatttcattgaatgcttttacagtattttctatgactcttttgtctttgagcctctcagattagctttttctacaaaagctgtttggcatgcctattgtcatctattttctttcagagtagctgctaacagccagaagctgctagttatggccaaaggcctcattgttggagagtcgttcttgttctttgactctaggtagagaggatgaaggctctgagatactgtctcaaaacattcatgtgttttctatgacaagtcaaagctacattgtcatattagaggtgtccagtagccccttagcgtgcctcagagtgggaggtagtgttggcaccgaactttgtcagccagtctcttagaggatcttactggagtttgtgattgagcttttacttcttctgttagtgttctgctgagacatatacactaatgatagctgccactctggggtgcagaactttccatatagattgccttaaaaataaaagcaaattttctatgcatacatgccggggaaaactctactaaatattcagtggttccaagaaatgccttttaaccatttgtaatactttagctttctaccttttcatctcattacttattttcaggcagaatagatatagaggcttctttctgcattatagtcttcacagacttaaaggcatcaggaagtagcccttgtgattttccttgctcttcttcttcccatttttccacctcctcctgtaagcacgtactttgtgtcaggcattgagagatacagagagaaaaggcataggtttctccccttgagaggctcctggtctactggaagaaacagacaattccagcacaatgtgatagatacaatgatagcagttagaacatgaagccatgggggcggagaggaagaaatcagctgtgggtgggaatggagtgggtagaaatattgaagaaggtttctaaaaagaggtgatgcctaaactgtgcttcaagtggcgaatagtagttatccaggtagagaatccaggcaagatttatccctggaatgataaattggaggacctgctgaacttttgtcaaggctggtaacaatgaagtgaggactagatcaggaagaggtttttatataatgcttcaaagtttgcatttaattctgaagttgataaagaaccatcgaacaattttaagcagagaatgacatgttattcccagacatgttaatagtgagacgattagagtcatttctagtcctcggaataaaaataacagtagtttcctagtggttcagcaaggtatgttttaaatttcgtcatctttttaatcaaactgcttaaggcttcctttctactctaatagttacctttttcccctaattgcataatgtatatatttttagagcttttcataatcaggtaccacctattcacctcatcttaattcctctgctttgtgacatgtaacttttactctactggagttggtgccctcatcaaatattctaaaacagaaggaaatgtaggcattctctgggtaggtttgtttagtgcctaagaaaatgcaggaaatgagagtgtgtatttattgagcttctactatgtgccacacactttgctaaatacagggaatgcattggttatcacatcagaaacacacaacccatgtgtttatgacgcttagtttagaggatcgaaacagtgccatccctagcaaccagagggcacagaagtacagtttcaatcaagtttatggtcataggtccttgtacattaattgacatgacaaatatatctcactccaattttgatatgaaaaaatattccccccttaattgtccttcaactttctctgtgcatgttgttggcagcaattgtgtctcatggtctatcctccatggtctagagctaaagatacagtggttatttagtacatttacatgggattttgtttctaatattctaatatagctaatcaattcatattaacttggcttttgcgttagaggataagaaaagtggagaataggttcatctcaatttctggctctcagtgactggtagttaacctcctggagcactaccttgagaggattctgaggcttcatctgggttgagtggaagtagaatagaaatatgtctattgatgatgaatgccatctgctgggaaaggagggtagaggcacatatttgccaacatggctctaagaaatgggagagctgctatccagttgtgtctgaaaagattaactggcagctagaaacttttaaaactacccattgactagttctatctcggagaactacaccccctacttgccagttcatgtcttatgtctctgcctgggtctgtctatgtcaagttcttatttgttaacttagtagaagcttagtggactctgtgaaaatgataaagcttgaaagagcaagcctgtgatagactgtgatagactgagcctttatagtatccttaatgctctagaaacttgattgactggaaactttttctttttctttctttctttctttttttttgagatggagtctcactctgtcacccaggctggaatgcagtggcacaatctctgccacctgggttcaagcgattctcctgcttcagcctcccgagtagctgggattacaggcatccaccaccatgcctggctaatttttgtacttttagtagggacggggtttcaccatcttggccagcctggtcttgaactcctgaccttgttatccacctgcctcggcctcccaaagtgttgggattacaggcgtgagccactgcgcccggcctggaaattttttctataagatacacaaatacattgcagcctgttcctgatcagccatttaagtggaataaaagtcctaagaaagttcttcttgagaagaataaaattgagacctccactctgaacaggcatggagcattcaataaggcaaagggtcagaaatcttgcttaacttcttactgttcacatctgtaactgggcataaacctataggatcattttcctttcacaaagaatccatcaaataaatacttgttaaagcctacgcttaacttgagcaccggtagtaatgactcgcattatcagcggggcttttgggcttgcactcatggctctgtgattcatgagggcagaaaaactgactggcttacagctgtctctctttttctggctggcctgcctgcatgcctagataactgaatggcttttttcagaatgaggtatggtctaaggattttgctacttcaacgtcagtttcctggatcttttcttctactccagcttgccatatgtcccttttatattttcttggccactctcttacaaatagggccatagatcagagatggtggccccatctggtgaaatctagctttcagatacgctttgtttgacccatagagtgttggatcacatagaatttttaaaaattaattaactgtcaacattgtactattgatttcaactttatctggagtctttttaacttttattttgagctctagaacttggacattttctggctcctgccttgcaagtctgaacctcagttccagttttctatttttggtgcttagtgtttttgtctttggcagatcctgaccactgttaacaaaatataaagcatgaaaatggtggcatccatgcgatgcagcagttgggactatgagccccaggttggatgtcagctgtatctcagcaggtggagttagtttactgacccctgttagcaagaccagagatgcagatgtgactctggtcatgccagatattaggtttttcagactttgggatctaagaggaccatctgctgccacatttgtgcttggacttcactgttagagtttgatcaatggcatcctgtgatgaaaaatgatgttcatgaatatgaatctaaatctgagcaagtgtttggtgtgtgtgcatctcataaatgtcacattaggcaattaagtatatacaatttataaataagtatatgtaatttataaatacatatatgaagttcataaataaataatatataacttataaataaatatataaagttatgattttatagtttattaaatccagagtttttcttttgttatagccctgcctcttaggcttgacaattggcttagaagttatcctcaagagagaatctttctttttcttttcttattttttttgagatggagtctcagtctgtcacccaggctggagtgtagtggtgcgatatcagctcactgcaacctccacctccggagttcaagtgattctcccactgcaggatcccgagtagctgggattacaggcataccgcaccatacctgctaatttctgtatttttagtagagatggggtttcaccatgttggccatgctggtcttgaactcctggcctcaagtgatccacctgacttggcctcccaaagttctgggattacaggcgaaagcccctttgcccagcctgaatctttccttcttaatgactccatgctatactgtctgttgatttattctggcttttctcagtaaataacaaaattaatagtgatcgccatcacttattgagtgcttatcaagggtcagaaactatgtgaagtacttttatatgtgggaccatcatctcctttatttcttacagtcctatgtggtaagatattatctacattctacagtataagaacataggctgagacaagttaaatatcgtgcccaatgtaacacagttggtaaggtgtccaaaccctggttagggtgtctccaaaggccataatcatgaccatggcactaaactgctacttcaatctaacatctaatttaataaagatatgaacatttgttaagcacctatatagttaggagcaatttcagatgttaaaaggtgtaattcatatttcttgctcataaggtgttcgaaatctattgaaaagacaagacttgtgctgtacaaagataacaaagttgagagagttttaagtgatgagtgagtggagtggacagtttagcggagggagaaatcacagcaggcccaagtcatcagctgcctgagggagagaagggaagtggggcagagacagtgggatgtgtgattccgtggagaccccagaagcaagattctttcacaacacttcttagtcattcttttaccctgagtaggaacgttatgcaataataagattagcccagaagttttatctagaagctgtatcatcctggaagctgaagagaataagttcatttcattattatctattgtcaaaggattaaatttggaagggagataagtatatatttatttttttgcttgttgtgagtaaatgactttgcagttaggtatacagttgaaaagctttattgagatttgtagtcaactctgctccactcatggtaccccaatactggcttctccaccattccatttctccaacttcagaaaatgtccacagcgtccttactttccaacattctccactgatgtggagtggatcattggtgctcaggcctcaagtcacaaacctgtgagtgacatggtcttatccgctgacctggtgttttttattgaagttgtcctctatgcagatagtttaaaaacaagagaaaagaaagaccaggtggtaaacctcctattccttgtcaggagaaatagtgccaagaagccatctgggcactccagggcacatgcccacatcccctcattctttctagttcccttgctggagtgcatagggatggggcatttacaacagaacacgtggaaacacattctcagaaagttgagaacagagtggcctgggataagatggcagagggagagaagaaaatacttctctgagtggggactgtctctaattcttagtttattctcatgcacctgccttctaactcaaataccttggaagaatttgaagtaataagtgcatcatgtagggttagaatactctctctttttccaatcaagtgggttgggcaagagggcagacagcttcctcattggtaggtaataaaaggattctgatttatcagattgtgggatcaccaagtaccagagtagccagggaaattctcaaatggatttgaaaatcctagggaaggagcaccatttagagaggctggagagaagagaaaggcactgcagcctaggaaacccagtgaacaagaatgcagaagcaataacacctgggttcatacagaaacctttgaggtgacccctaagcggggaggtatagacatccattagaaatggattgtgcaggaggggaagggctttgcacatcaagatggacttgggtgtggtttttgtgcgtgactaaggggtttctgctttgtgtgtaggcatggggtacaggagggcctagaaattgccctctctggagcatatccttaccccagtgcagtcagagagataagggctcaagttctgtttatgcatttaatagcctacatgatcttgggcaagtatgtatccctgctgaactccatgtctgtaaaatggggctaatgctacctatttcatttgcttattgtgtatgatataaaacagtgtttgcaaagtacctggcacatggtaggctcttttcttatattgttccggctctcagcttgctttactcctggtattgctcctgtgtgtctctgtattaaagatcatggaggaatataagtatatttttttcctgagagactttgtcttaactttgagattctgtcctcagctgttttactgtctggtctcctaagcatgagtcacgtgtccaaacagcagtctttacaagcccatgggtgggatagtaagaccagcttgtcactgtttgtgactctgcttctgtacctcccagtctgtgtgacatcttcccccatggggagccgtttctactttgtctttaattgctcctcaccgaggcgacttgtcagccaaggctgctttctgtcatttgatgccacatctcttcctatttcagccagccatttggggacattcatttagttgacagtctgattttacagagaacattgtaccagacaataatttgccttgtaagggggtccagcagggtttcctgcctccatgctgacccagggtgccagtacacttctgcgtggctgtggctgtggttctgcacagagcaggtggggaaggtgaagatattaacaatggagagtcccagttgagcatcactgggctacaagtcccttgccctcctgtccttttcctcttggtagataaaccttcacagaacctcaattcaggaccctatccatttccaacagaaccccaacaccatgggagatgaagatataggattatttcttcctaggtttgtgtgccggtttagaattgtctgtgtcctactatgtctaacatcccacttgatcttgacaacagccctgtgagctgggaaagagggacagtttgtggaacagatatcgaggctcttacctttggaataaataaaatgggactcagaagggttattcagctgtcagtgagagtggtgttggctttttattcacaacagtgaaaactccatataaatagacaggtaatttcagggccatggagtagatagagcactcaccctcaaagagcctttgagagaagtctggttatctctgtctggccagtttctggcccttgcttctcttacctatgtcttcagaaatcttcattccggctattcaccttctctcccagtctcagttaggtacccttctcacagaagagttcctcttcactgctcttgtatcttgttaaaaggcttttttttccctcctttttattctgtccccagcctgctgtagcaatgcctgatctctctttctatttattgttccatggagccaaacctccttctgtccctttgggatgacctattgttatacattaataattaacctttactaggaactctagtcacaggcatttaacccaaatgcagaaaaagccaaagtttgtttatgacaaagagttctcacatgctaaggtataatagtgaaggttagaaaggagaagctgacactcattaaacttttatgatttcttttctggtttactcacttgagtgattgcctgaggatcctgcaatatttccctttgcacatggtcagcccagtttagctaaaatgaaaaattcagcttttgaattgtgaagttgagcatgcatgactttccatgtaatgttaaagataagcctcacaggtgctgctagtggggcctggttctgagcatatggaccctggggcccaaatgcctaggttcaagtcctgctctgccacttatcagctgtgtgcctgtgggccggttccctaactgctctctgtgtctgtttctgcatctgtaaaataaggcaatgattacaggtatctcaaatgggtgttgtctgtatctaatgggatggagaggtgttaaatccttaccatggtgcctggtggtaggtgcttaataagtgttagtatcattattttcaatgttattgactatggttaggtccacggtcaaggttacataatagtgagtcattttcaatgcttcgccatagttatatatcactcttgtaatatccattagaatgcaaacagctttgcttgattctctcctggtgatgagagatgggaactaattctacatttaaatattggggattatatgatatgtgctggagtgacccatccaattaactttgtctcacagatatggacagatgaggcttattttagaaattagccattgttgttttggagatgataatgcaaccttttcagggctgtggaaatagcgaaatgagattaacaataaccctccaaatagctgcgacttttgtgcccttatgatattgcattcctaagtgcttcacatgttttaaatcattttattattacaaaataaatagtttgtttattcctatgttcccaatttcaggagaggaaacagactcagaaaatttactttgccaaagtcacatagcttgtaagtagtaaatgtggaattcaaacctaaatctgggtcctgacttagaatttgaataaggtaatataaagaaaataggaaaatagttgggacgctcaatactcagatccttgtctatttcccttccattgttttctgcttattaagtttttatggatacgacattgctcagagatcagagcgccaaaaaccattccagggtactgtatcaaatttcagttcaaataagagtaaaacttttttgaaattctaatttcatggagaaagattaatttctgcttttagatggattatacctggtttagaaagtcataacagatttttttcccataggttattggggttcaggtggtgtttggttacatgaataagttcttaagtggttatttgtgcgattttggtgcactcatcacccaagcagtatacactgcaccctatttgtagtcttttattcctcaccctcatcacacccttcccctcaagtccccaaagtccatgtatcattcttatgcctttgcgtcttcatagcttagctcccacatatcagtgagaacatacaatgttcggttttccattcctgagttacttcacttagaataatagtttccagtcttatccaggtcactgcaaatgccattaattcattcctttttatggctgagtagtattcatatatatatatcacattttcttgatccacttgttgattgatgaacgtttgggttggttccacaattttgcaattggaaattgtgctgctatacacatgcctgtgcaagtatctttttcttataatgacttcttttcctctgggtagatacccagtagtgggattgctggatcaaatggtagttctacttttagttctttaagggatctccacactgttttccatagtggctgttagacagtcataacagatttttttaactgccatcctcacgttctccacctacctacccactctgcaggacagtggccatggctttgcagaagtgtacactaaccttgggtagggcatggaggcagaaagctctgctggacccccttgcaaggtgaattagtatctggttcagtattctttgtaaaatcagactctcaactaaatcaatgtccttgactgactggctgaaatagggcttcagggtgtctcattctaccactgtacagagggcacatgcaatgtgcaaaaaataaaaacaaaaacagacctctgtccccaccagcttttaacacttactcttttctttcaagtaatatatccacatggttgaaaaaaagtctaacactgtaagagggcacagtgaaaagtaagtcaccctcccactccagaatattaatcccgcaaatatactccccaatgacaattttatagttccaaagagactttatgcttactggagcatatatacatataatgcccccacgcccccacacttttacacaatgataacataatgcaccctctatcctgttccttgacaatttcacttaacaatgtgacctggagagcttccacatcaaaaccaaaagcaataccttgtttgcaaggcctgcctaatattccattataacgctgtgccatctgctattgatggtcatttaggttgtttctggtattttactaagggtgcttcagtaaatcactttgtatgaagtatgtgaatccatgcaactcgatctctcttgatttttatttgcaagcttatgttgtataactttctgacaacacaagaaattggccaggagacaaaagaaattctgtagaaatatagaggcttttttggagcttgtgtgcacatcagatgtttcttcagatacctttttggttcctgtgtctcattgtttctcatgttgttttgggctatgtcctgaagcctctttttgggtcatttttccaggtgcccagtgagtgatggatggatactgtttgcaagattgattcacatggcacttttgtttggcttttgacaggttgtttataagaataatgacatccgtctggagctgtctcgcctggcccggattgcggacaccaagatgaaaatctatggcgaagttgtgtttaagtgtgagaatgtggccacactggaccccatcaactttgagaccccagaggcttacatcagcttgcccaagtggaacactaaacgtatgggctccatctcctttgacttccgcaccacagagcccaatggcctgatcctcttcactcatggaaagccccaagagaggaaggatgctcggagccagaagaatacaaaagtagacttctttgccgtggaactcctcgatggcaacctgtacttgctgcttgacatgggctctggcaccatcaaagtgaaagccactcagaagaaagccaatgatggggaatggtaccatgtggacattcagcgagatggcagatcaggtaggaagaggcaggatgtgtgactgagactagacgaaagctgtagcttctcagtttgttttttggctttatgtttcttaattttcacccttgcatgcttgttgattcttttgctactctctttaatggctgttgtaaaattatgtttctgaaaagatacctgtctcatagatggctcacattctccgcttatctctcttgtcactcactgcgcaattgtctcagtgatagctctacgatcctggagctaaggatggttttacaagtagcatttccactgctaccagagcaactctcatgtcactggtgtgatccgcccccattgccccattctttgcttctctttttcctcatcaccatggaaaccgattgtgacatcacagatgctgcattatgtgattattttgtaggataaacttcactgtgcaagaatttatgcaacaatacacccttcagtaattggcaagagtcatgttgcatggagaaattatgacaagaaaggaaaaggcaaattgatttttcctgaagatacattcaatttaaagccttcctttggtgtaaaagcctatatttcactctttgttcagacctcactaactctctcttcctcttcataaccttttacattttgtttaaatggctttgtttctgcagctgcagatcaaacaagctagccccaggcagtacatagctactatggaatagtaacaaagtgggggtgggggtggggcaaaatagtcaggggtttttgaatgcctggacagtctgcctagctttctatggaccatgtggcaatgaaggtcacattctgtgctatcagaaagggcattttcccaagagcagtaattagagcatttgccatttcagactcatttcctgattctccatttaggtaggatgtactcaagaagggtcttggcttcatgtgccatatttatagagattcactttcctgatgaacattaaaaagtctctatttggatattttctttctaggtacatttggccagtaagagagagcaataagttccccaaaaggctgaaactgggagtgactgagctttggtgggttggcttttctgcataattccaaagctaggctgacggcagagatagcaatattgcccttaggaagagctggatgggttctttgcagagggcagatgggtggcagattgcagccctggctattttattgcccagtaggaatctttactggttgtctgaaatctgatcagaaccaagagccttcaaattaaatgtgctcgttaagcaagaatgaatagtgtctacccttttacacagaaaaacacccaaaaaattaatttctttggaggctaaatcccgccacaccccccatacttcttcttcttcttttctttctccttctctgcttttcagtaaaatgacagcaagagcagagtcagaaagctgttccagaattataaagaaaacactgctgttggtttttaagagcatgtgtttgggatctctgaggttaggtcacggtggacgggttttgtgtctgactaacctagaccttggcacagcataaaagttaccttacccgtgtctcaggcaggctaaaacacacaaaattgccatttgttcatttctgtctgttcctaatacaaatttttctttcaaacaattttgaacaaaggggaacagtttttgttgtttaaaccaccagtggacccaacttcaacaaatatgtttgaatttcagaagtcttaaatttcatacctgggagctaaagcactggctaattcttttctcttttttttttttttttttttttttgagacagagtttctctcttgctgcccaggctggagtgcaatggcgcagtctcggctcactgcaaactctaccttccaggttcaagtgattctcctgccttacctcccaagtagctgggattacaggcaccctccaccaagcccagctaatttttgtctatttagtagagacagggtttcaccatgttggccaggccaatctcgaactcctgacctcagatgatcaacccatctcggcctcccaaagtgctgggattacaggagtaagccactgtgccaggcctggccagttttttgaactactgatgaatttgatcaaagcctattaaaaacttactgagtaaacaaacaattgtcccatgaaagcagtataatctaaaattttaatacagtctgttaaactttcattttttcatgagaatgttttctggtaacttgttttagattataaatctatactaaaggatagttataaaaacaagtgtatctaaatgtggtgcctccttccctgataatcttgaagaataatataacaaacagtgatctagaaaaacttttatgatcactcctcacttgggcaagtcagtcttagaacttgttaagtgcattcaaaactgttatggtcacacattcagagaacagattttcctcaggttgtatttaaggctctaaaatttaaattgattctagtattgtctttacttggcaatagatgtctccccattttagttggtgatcagattagccctgtggacctgtgaggggtaaagaaagaaaactatgcaacagagaaaatagtaagagatagagacctcaacttcctcctttgtaagatagagaaaataataactcctacctcccaatattgttttgaggatcaagtccaaaaatgcacataaaatagttaaaatggtagccaggacattattgttgttatataagtgtttgaaagattgaaaaacaaaaggcaaagcatatttctctaggagtaaacttctaggagggagtagtgaagcagattgttaaattccccttaatatcctttctatgcttctactcttgtgttgactttgcactttatttattgtttttaactttagttaattaattaattaaatttcttgagagctagtctcactctgccacccagcttggagtgcagtggcacgatctcagctctctgcaatccccacctcccgggtccaaggaattctcctgcctcaacctctcgagtagctgggattacaggtgcctgccaccacacctggctaatttttgtatttttagtaaagatggggtttcaccatgttggccaggttggtcttgaactcctgacctcaagtgatctgcccgcctcagcctcccaaagtgctgggattacaggcgtgagccaccacacccagccgactttgtactttaaagtgtatgtttcattcttgatcacgtctgatcttcgcagcccttcaggttatatacccttcataactgaagaaactgagaatcagacagaggtgaaggctgactgatggatggcatgacccatttatcttgataccaataaagcacatcaagaataataaatacctattttaaaatttctgacaggaagtttagatatcacctagtccatttccttaattttccagttcgggaaattgagccataaagtggttcagggattggcctagggtcataaagacatttaggactagaatccctgctctcaaggtcccaggttagcttgtggggtttcatcttctacaatctcatttgatgctgtccaaactccaaccccttcctgggtctgcttagctctctgacttgatctcctgctcaccccctcttgccttctctattctagccacacatctgcctacctcagggcctttgtaggtgccatcccctctgcctggcatgctctctctcctggactttgcatggctgaatccttctcaacattctggtttcagcttcacttttacctgcctagagagaccttcagtgactctacattttaaagtagaatgcatgagtaactagcacaccacccattttactctcttcatagcaactgcccttagctaatttatttcatttattgggttacttattgtattagtctgttctcatgctgctaataaagacaaacccaagactggataatttataaaggaaagatgtttaattgactcactattcagcatggctggggaggcctcaggacacttacaatcatggtggaaggagaagcaaacacgtccttcttcatatggcagcaggagagagagaagtgcagtgccagccagagaaatgccagatacttataaaaccatcagatcttgtgagaactcactcactatcatgagaacaacatggaggtaatgtccccataattcaattcacttcccaccaggtctgtcccacaacatgcagggattatgggaatggcaattcaagataagatttgggtgggaacacagccaaaccatatcatttattttttgtccctctgttctggaacatctgctcaatgagaggagagacatgcctatcaagttcatctcagtgcctagaactataccagagacagaataggtcttccatacacatttattaaatgattaaataaggaataatgtttcagttaaaatgtgtcacagggaatgctcaaaatattcactggcagggctggtagtgaatgcccaatctagagagtaccagtgcatggagagagagacagaagaggaagttccatcttttgggggttggtgagcccttgaagaaaactcaggcaaacatatggaggcctcattctgtctcagtcactcttaaaagcactttgcatatattcactcatttaatcacaccaacctatgaggtggggacagttattttcccattttacaaatgaggaaactgaggcacaggaaggtgaagtcacttcttcacggttatacagctcatacatattagagctggaatttaaatacaggcaggaactgtgctgctctcaacctgtatggtctcagccaagagggttaagtagagaaaagatacactagatgttaggtcactgagatttttctgggtcttcctaagggccagcttgacttagctggcagagattggaaccaaacggcctacattgtcttttccattgtcttgtaacatctaattctcttgcttacattgttctctcctggccagccaatggctgggctcagcactcacctgttaggtttcttacatttggttaagcaactggcagactcacctgagatctgtcttcccaccccaggtactatatcagtgaacagcaggcgcacgccattcaccgccagtggggagagcgagatcctggacctggaaggagacatgtacctgggagggctgccggagaaccgtgctggccttattctccccaccgagctgtggactgccatgctcaactatggctacgtgggctgcatccgcgacctattcattgatgggcgcagcaagaacattcgacagctggcagagatgcagaatgctgcgggtgtcaagtcctcctgttcacggatgagtgccaagcagtgtgacagctacccctgcaagaataatgctgtgtgcaaggacggctggaaccgcttcatctgcgactgcaccggcaccggatactggggaagaacctgcgaaaggggtgagtcggcctagaggatggcaagtgagggcctgagtggggctgatgtgttacagttggatccctgggcagcccaagccttcgcacctacctgcactttctttcttccaagagtttttgggtttactgatttccagattgcaccctttctagttctgaatgcttgggtttgtttggctaagactgagttgcagaaagggaagctttataataaatattactgtgattatgatactttttgattaaatattttctatttagagagggtaaataattctcttttgggactccagggggcctagccaactggctgttttattcattcatttgacttgtgattctttagtgctttctacaagctaactcctgggttaggctttagaaatacaatgttgaacaagacaggtacatcgctgtttttatggagcttgctgcctagtggaatatttagccattaaataactgattacaaacatggtgagttttataagaggcagagtgatgtattagttaagaacataaactctggggccagactgggtgagaaatctggccctcatgcagtgatgggaatttcatcatggtagtcaatatctttgaaacttgacttcctcatttgtaaaatagaaatcaggtacctacctcacaagatactgatgatgattaaatgagttaataggttctcgagcatttaatgttagtgattattatagtcataattattctcatcaacatcattaaagagaaggtatagagaagcttgggaggcccttggaaggagacctaacataccatacaggttcactgtatagtgagcaaccctgacagttgaggacctgaacaaagtccagaatggactggatgctttgttcccttctgaaaaatgtccagaatagaattggggaactgttggggtggggaggaggggcatgagaggggaccaaagagatgagggctgaccctgtagactgggccagaatgctgggaggattcccttttcgttcaccacttcagtatctgacatttgcacccgatttacagtttaagtaaagggcatagataaaggcaagaagagggacaacatcaacacaaggagattccagtcaagctatttgcagattgcagcttggtctatttttttatatgccaagcacacagaatcaagctgaatatccgcaggctgtcaacttctatattcaatgaaaggataatttgcatcaggatcaagtttttgctaagggtatagctctagggctttgagaatgctgtacctgtatagttcttgccctcaagaagattatcatttatttagctgaggagttgagacatctatataataagctgtaataagatgatgtaagacagtagcatgttagtggacagaaaagaaggacatggagattcagagacagaagaacgttttgaggagagacctgcagggtctcatctctacagaccagtggccagtggcctatcagaagataggtgatgtggatggatcctgggccaggtctagaacaagggctgaatgaccagttttcaaggcctgtttttttgtaaggccaactgtggggccaactgtgttactagctaaggtatatttcaagagaactacaaaccctttttacagtcagatcagaaatagaatacaggacatgaggacaaaggaagaaaagagagctttcttggagcatatggaattaaaattaaaattcactgaattttcaagtcagcaaccaccagaacaggagctatgataaggaaatactcatctgggacaggaataggccacaaggggctggtcagtctgtcaggtgcctgggctctttccaagtatgtttgtagggtaacctaccctggtgctggttggggaagatagaaaggtcatttttgtctctgagatgcgtgagacagttttggtgtttgccaaagtgttgcagatcttctgttgtctatgaagacagtataaaggtcatctcagacatctcacttcttcttgggtctcctcttaactcaagcaagggccttgtgattgtcagaggcaggacacagtgactgtagccagctgtacaaggtgtctctgagctcacccatttcaagggtgaatcaacgggagttggtccaaaacttgccaagaacagtgaaagtcactgcaccttttacattgtcacttctgactagtcattaaaaggcagctgattggggatatatgagggacaattattcttggtgcagtgcagccaagagtcatccattctggccaaatgagaagaagcttagcaaatttaagatatttgatctatacatcgctcaaatcccagacggttcaactgattgttttgttcccctactaattgttttttgcccctggattgttcctgacaccatgttcagaatgaatcagtggagtgtaaaaattataggactcttctctgctagcaaagaaaagttgagattcccaatgacattgtttttctttatggaaactgattccttagtggagactcttttgagtatcttttgttcatttttcctgcaggaagttgacatatattgaagccctagtgtgttccaggcactatgtttgaggttggaaatgcaacaaacaaaaaatccaaaacagaaacaccaacttgacacggcctttacttgtgaacaaggggtgtatagtcctcccaggaagcaaaggaaaatgtgagaaatgtttaacatgtggttaatgttatggcagatgtctatagggaaacagtaggacaaacaggcaagaatggccacttctatatggaaggagtgatggcccagagaaggggatccaagctttcttggattttagatttcctatttctaactttaggcatccactctaggcacttctgaagaagaatgaagaaaatgtattgggtattctctctatacaggaatggaatacttttcggattaaggagccctgccccattcaccataacaacatcaacacaatcactcagtttgccattctctctctaatttttattatgtagaagcattctagaatcaagtctaagtctagaatggatcatttgtactaaatgtgttaagcctaagacaattcttaaggctgtgtgtcccagtagctcaaactgtgttctctactggaacttccttgggggtgagtccattggtataactgggcccacacatgaatgggagtgttagaaagaagcacttgtgtatatacactgaagaaagcatagatggaatgctgaaaactggagttttcatggcccaggtcagacactagacactacatcaaaatagaccaatgacccaagcaaagtcagcaacagataaatctaagagacaattcctggatcaaagtcatcagccaagtataagagagtcagagaataaggcctgggaagtagaaagtgtgtatatgatactaagattaatttgcatgtgtatgtttctcttacagtaaaattggataactcctgcttctaccctcataagagtgcttcttctgcctgtgaagatgagctactctaaatcttgatgtctaaaaataggcttgattgatattgtatttagatttttttcagcataatctgttgctattctaagatgtagctgtctctacctatcccaactgtttagctctaattatttttgttggctattcatagtgatgtgagagacgtctccatgacctaaacagcaaaggcctgttttaactacttaattctaatcagataggttgaaattctttagtatcatagaataccacctaccatccagtgaagtcctgttggacagaggaaacagtctagctggtctttagcctgctctggagttagtcctacttaaggagctatgatcacttgacctgggacaacatcttatctttgctggtatagccaaactgtctagttcaattggtgagcatcaagttccagcaaggcaaagccaagggtttgatttatttgtacatcatggagcttaaattttagaccattgctgaatctatgctcttccctgaatggctttttctaaacatatcctggcattcatttggcaagaaagtaaataaagctcagcacaagttcatcccaatgtcaagaaaaataacctacagtacaacatttatctgacatatgcaccagctgaacacgaagaatacaagtatttttacttctctccagtgactcttgttccagtgggaaaggcatgcaggcagcagctgctgctcctctccattcggggcctccctttttaggcaacctcctatgtgatcctgggtagcagcagcagcagcaaaagcaaatgattctgcctggaaagggtgagataccaatcttcgatgaggctggattgtgtcattgaaatgctacatatatgccacatggaaatcatgtcataagaaaatagtagggttggcagaggccaggagtggtggctcatgcctgtaatcccagcactttgggaggctgaggtgggtgggtcacctgaggtcaggagttcaagaccagcctgtccaacatggcaaaaccccgtctctactaaaaatacaaaaattagctgggcttggtggtgcatgcctgcaatcccagctactcaggaggctgaggcatgagaatcacttgaatctgggaggtggaggttgcagtgagccaagatcatgcagttgcactccagcctgggtgacagagtgactccgtctcaagaaaaagaaaagaaaatagtgaaaatagtagggttggcagataccgttagtgttacctgcacctcattcctgttttggtaaatgaggaattggaagccctgagaagttaagtcaacatcagtttagcttggaattgctatagaatggttagaatttatgattcctgattcctaatgcatcaggctttccattacattgagcagcctttccttcatatatactgttatatacatatactagatggttattaaatgtgggagggctccagggtttctgttttaggtctcttcttggcctgcacggttcccttggtgctcttattctttgccacgatattaaaggtcatctatatgttagtgacttccaaattgaggtctcttgcctagaactctccctgaaatctcagattcttatgtccctagttgtctacttgacatctccatttggatatctgatagattaacttaagctacttaattaatagctacttaatacatagctacttaattctaatcagataggttgaaattcttgaatatactggaagagcacctgccaccctgtgaagtcctgttggacttaatcgtatcatggaacagcttaatcatatcattgaaaagcagaaatcttgaggtcttccttcctgccccagacttcttttactttcagtttttccccttcttggtaaatggcatccctactgtccttgggcattttcttttatttttgtcctatgatattcaatctatctcagcaagtctcatccatttctcttataaacccatcctgcatctgtccactctctcttccatctctatcattttagatcaaaccatacttatcacttctttggacaactatatagcatgtagtatatgattatgaaaaatccaaattcattttgtgtcttctttagaatattaaagttaaattattaaaatttctatattctcaacacagtctatcttaaatagctttagtttcagtggcttttggtccagaaaactgtaggaaatgaagctatgatgcttctttggaattaacttcagcattaacatagagattccataaacaggtatttagctcttttctgtgtcaggctttgtgagctgatgaggatatacatttatattaagagaagacacactttctgtcctccacgagctcacagcacagcagaggggatagagacataatctgcaaactctaatgcaatctaccagtgtcaatgattcaggaaataatcacaggaaagaaaaagataacaattagaaagcaagatatgacgcacattttataccattttataattagttctggattcactgaggtcttgctcagactatctcactggtgtgggaataagagaaacctgggcttccaaggtcaaatataataatggtggttgctttcactggtctcagtgctattgaggaggggaatctgcgttatggctgtgccctcatccctcgtaggtttccagatcctttatttaaatgtctgacctggagatggatcctctgacctttcttttctgcaagaataaaatgaggcagttgggtttcacgctctctcaggcccttttcaactctaaaactctgattctcaaatgtcatcagcttggcaatgctttctcttatcccaaggagagagagaaaggtgaatgaagggcagcaatgtgagtccttgttccttacaatccgcagaactgtctggattaggactcggtttagttatatcagcactgcaatcaaattttcatctccctgattcattcatccaagaaaatgaataccttggtgtactgagtacacttcaggtccatcagacctgagttttaattgatggattaacgaatcgaaccttagatttctaaagagcattaaaaggctgtttcctctttggtccattgtttactctttttgatagataatgacatgtatctgagaaaggggcttcccaagaaatgtgcaattcatttacataaatcaaactgtctccttttttttttgtttgtttttttgcttttctgttgttgcttaagtcatacaaatgtatccctggtgacagccaccagcagagcacagattcagcctctttttttttttaacttccggttctgcaagtttccctttccacaagcacagggttttatgattgcagaaagcttttccatagtacatgaaccctagctgagagttattccaccaggtgagagtctgagctacctctgatcacagctggtcctgttactctaaaaaagagtatcaggattgtagattccggttattctagagtcttgaaggtttcgaggtctaagaaggacaggctggggactttggagatcttttaagaatcgacacctgcattcaacctgagaatgtgagggtcagcactttggtgcagtgtgtgacagctgcttatgaaccaacggcacacctgctgctggctgcagtgctgtcaaatgcagggactcggtggccatttacattgccactgtgtatctttattactgtgtgtgctcaaagcagcttaactgccagcagacatctgcccataataatgcaataattgaaatgctgctaaattatgagaaacaagtgctttgaaacacaacacaaggggattgttgcaggcttttctagcatctctggcttcatgtttcttttcacagagagatgaatccttcttcactacagtttggattaagaagaaaggaaagttaaaagacctactatttattgaaaaaaatgatgtgccttctctatgtttggttcttaatatatactgagtcatttaaccctcacatccactctgcagactgcatattattatcctcactttctacgtgaagaaattaagggccacccaattcattctgaatacctactgagtgctacgtgccagggactgtgttgagcacttgggacacaaaggcattgactgtggttctcataaatgtgctattatattctggtatctgagcaattgggacatgagtgtggggagaaatatcatggaaggcatcacagactggtgccactagagctgaggcttggtggagaatcaaagatctccccggcagaccaggcaggggaaaaaaaattccaggcagaaggaacagatgtataaaggtgacttcaataaacagtaagttttccatgtgggtggcatgtagggcttaaagagtgaggaggagggatttgaggggaagttttcgaagatgcagctgtaggggtgacagggccagccagccatgaaacactttgctctcccaacaagtttaggcattatcttataggaagcataccacgtttaacaatgggataaccaggtcagatcactgaggcagaagataaattgaatacagaagacaggagaccaacaggtcagcatataatagtccagtttgcattggtattaattcaggaatgagagataagagccctccctgaagaaacaagagtggaggtcgagttttcgaacatatctgataaataaaaaaggggcaatgtcaataggacttagttagtaatcaattacacacagctaaagaatagctgaaattgaattagagcaagggtttggccatggaagccttttgcttcttcctttcttctgagccatcttgaatcagtgggagattcttaggaggagtggggaggactgtggtgaccattaagcagatgtagctgagagtcaaacctacacctgctttggtcccactcggaacatatgtatttaccttctcaccttctctctgtgcctccgtttcaatatttgccatgacaatattggcagtgggtgtttaactggcttattgtgaggctccattgtagaatcaaagtgtataatgtgctcacatagataacaaagttaatattcccctttcagaatctggagtttagcaatgcaagaattgaaaaaatgatctggctggtgtttttactccatttttttttttcttgtgtggtggaaatgacccaggtcttatttctgtgtttaaggcatatgatacaggttagagtttaaaattgagaaggttggaccataagagaacataccaaagcatgcctttcttcatactttaaatggtgtatttggaattaaaatgtgactcttttgtaatcccgggttttaaagaattgcattaaaatgatctgttatgactgtagtgatctcaaccaagctttggcatatgtttggtagaaacaatgagttgtagtttgtctctctttgtcttgtaaaactggccatatttgaaattaagctaaaagattttttttccttggagatagaaaaatcatattttgaacttctccctattctggtctctcatttgggatttatagtgatgacacccgatactgagtattacgtatgtgtctgtgcctagagcacatgtgtatagttttcctctagcttctgagaagttttctgttttatcatgggttctgttttaatcccaccaaggactgttaagaggaaaaagcagcaaacatgtagtaatcaagaatagaagtcccaaacttaaaacctaaaacttgactgacccaacaaaaaccaggcagagtataaagagttgtgtaattacttatcttgccagtagaatagatgctcagatactatctagcaaaaccacccacccccaattttagatgaagaaactgaggcctccaggtgggaaatgagtggtcaatagaatagaatagaatgttcttagtccctcgttttggttcctatttattggctttttcaaagaaatatacatgcatctgtgcatctgtgcatatttgtgaagatatacttttatgtctcatgatcttctaggcagtagtcatgccgttatagcaaagccatttggtaaatctccagtaatttgttctaactgataaattttatttgaaatgttggcaactgatttagagggaggaaatgtggagggaagagatgtatatatttctcttctctttctgtttcatcacttatcccatcttaccccaacaaataacccagcccaacagagaggatactggggtgacaagtacatctggaacttgaggctggacccttcaatatgagtggctcttgaaagacccccttctgtgggctactggacagctatttttctgccaggtagatgcagtctttcttggagaagatcatttcatgcttcttagcatgtttaacctttatagcaagacactcttatcaaaatgacaaaccccaacagagccttctaagaggccagtaaatcagaagcctcatgaaatctgtgcgattagcatgttccccctctttgtttctgcagggtaagaaagccctgtgcatttcagatttcaatcttctctgcaggccccttgtttgaaacctcctgctgtggctcactggtatttaaatactgttttcattcagtcacctggggccacatactgacatcagctaaggctggcacattgtttatctccatcagcaatgttgtaaagaaaagataactgctctgatgtttgtttagttgaattctccccatcctggaaagcatcctttctgggtctgaagatagcagctgattcctaatgtcatcattcctgtagtagctcactgttgctcagcaggatctcatctccagccagttagttgtctctgatctctttgtcccatggctcagtctgtaatgaaactttcacaagcaacctagcatcttcagccactataaggtggagcctccttctgtggaaatccacaaagtcaaggctatattgagagtagaggtagaaggagaaaaaaatgatgaataacagttctgttgtctgtatagatgataaaatatttattagggattgtggggggtgactcttttatcggagtttacacatccatattttcaagttggaaaggacctctgaggtttttgagtctaactcaatatctgatgcatatatacccctggacaaaattcctaaattgctgtgtagagtctataggaatatgtactcttatctacatatgatgtactaaatgcttagcagtggttagcttatttaatctttgcaataactacataagatatgtgctattttcattcttaatttatatctgaggaattggggttaaggataggttaagtaacttgctcaaggtcacccaagaatacgttgaggtgatctctgggtcttccactcctgagtcctctcttctgtgatcgatatactttactactctcagtaacaaggattctcacctcttcatgaagcagccattccatttttggatattactaagtagtctaaaaatcttcctttcactacaactgaagtcccttttttgaaacactctttttattttattttgttcctttttttattatactttaagttctgggatacatgtgcagaacgtgcagtttttttacataggtatacatgtgccatggtggtttgctgcacccatcaacccatcacttacattaggtatttctcctaatgctgtcccttccctagacccccaccccctaacaggcccagtgtgtgatgttcccctccctgtgtccatgtgttctcatttttcaactcccacttatgagtgagaacatgtggtatttggttttctgttcttgtaaacactcttttttaattgtgataaaatacacataacataacatttaccattttagcttttttttttttttttttttgagagaaggcctggctcttttgcccaagctgaagtgcagtgatgcaatctcagctcactgcaactcctgctccctgggctcaagccatcctgccaacctcagcctcttaagtagctgggaccacaggcatgtaccatcacacccggctaatttttgtattttttgtagacatggattttcaccatgttgtccaggctggtctcgaacttgtgagctcaaacagtctgcccacctcggcctcccaacgtgctgggattacaggcgtgagtcatcacacctggcctcattttagccatttttatgtgtataatacggtggcataaagcacattcacattgctgtgcaaccatagccatcatccatcttcagaatctttcttttggccttggttcaggctttgggagctatacaggatttattcactaaaaaaaaaaaaaaaaaaaccttcactaggtgcttatcatgccatggatcctagagatgtccagaacaggtcaagctaaaacccttctctacaatagaccttcagttattcaaagacaactatcaggttttccactgaaatgttgtcagtcattctcaggataaacatcactagtttcattaaccagttctcacctattgtggttttaagttccttgctgagttaatccagcagtcattgagagaagtgggggaaggtgggagagggttctgtgttctgaaaggaatgatggcttccagtacttcacaggggtctttgtgaagcaggccatgcccttccaaggagaaagcatgtattgttaatgcagtaactcacatgaatatcagagatagtgacacatatggactatgggtttgtgtagttggcaggattcactggtacatttatggtggtggtggggtgagtgcttttgttagtttcttatcctgtaaaaatgctttgggccaggcacggtggctcacgcctgtaattccagcactgtgggaggccagggcaggtggatcacctgaggtcgggagttcaagaccagcctgaccaacatggggaaaccccatctctcctgaaaattagccaggcatggtggtgcttgcctgtaatcccagctacttgggaggctgagataggagaatcacctaaacccaggaggcagaggttgtggtgagccaagatcgcgccattgtactgcagcctgggcaacaagagcgaaaactccgtctcaaaaaaaaatgctgtgggcccacttcaggtaacatcacatttaccacctcgtcttattcctcaaaatagtcctagattgagtgtgttaagtcacatatctcaaaagcaaagctaaatttatttttgaccataggaacatcttagggtaccactagacaaggaaatcatgattttgacgagtgtcagctgacacaaaatcattgaatgctacagctgggcagggccttaaaaaatcaactattccagtgcttataatttgcaaagaaataactgagattcaaagtgattatataacttgcccaaagttacagaggtagtaagtagccacgctgggacttatcactcagtattttgaatccttgatgagatctgtctattctaaagcaatttcagaggtgctcttgctttgtacctttgggctggtcctttgtagctgagagtaagatgctcctgctgtgtgggtcagaagatttcttcacaagctcagtgggtccttgtgattttttttaacatgtaatcgtccctttatttattgcaaataagcttggcaatttatttagttagcaacttatggtctggaaaatctcattatccaaaccttacattatcaacacatctgtttaaaaagagatgcttaaagaagtggtctaaatatgcagattcctgatcatcttgaagaagggaactactaaaagggcaacctgggagggagtagacaattgtagtgaggccatgaaagccactgacattcacacataagggagtataaaaagggaattcacatttattgagtacctgcatgtgccaggtataatttggtccttaaataagatgaaccaggtttggagtcagacaaaactggatttgtgggggcggtggggaggtgcacagtggctcatgcctgtaatcccagtgctttgggagatagaggtgggcggatcacgaggtcatgagttcgagaccagcctggccaacatagtgaaaaccccgtctctactaaaaataccaaaaaaattagccaggcatggtggcaggtgcctgtaatcccacttctcaggaggctgaggcaggagaatcgcatgaacccaggaggcggaggttgcagtgagctgagactgcaccactgcactccagcctgggcaacagagggagactccatctcaaaaacaaacaaacaaacaacaacaaaaagctggatttgaatcccagttccattgctcactattatgtgatcttggatgtgtttttaacccctttttagcctcagttttctgatccatcaaaaagccattctggggttgttatgatgcttcaataacataattgtgtaaaaatcttggcaaaatgcctataattttgtaagtgttcagtacatggaggagtattattattcttctctcttttaatttttagagcagatcttataaagtttgtggtatcattcagatttttagatacttaaaccaaggatcagaaaactaaaataaatttccatagtcgcaatgttagcaaatactaaaggtaggaatttttcacccagtctatcagattttctattattctttgccattcatttaaacaggaggccttagaggtgggattaggtactgtgggagggagagagagctgtaagaaatgagatggctttttttgttcctcttccaaccttgtcagttctctgctttaggactttccaaggggcaaacatgagaaatacattgggatggaagctgtccatttggagtaaattcaggattgagaaaagcagtcaggatcttccacatcttttcattcacactgtttgttcctaggtggtggagaagaactgtaaagtttcatggggctggtccagaagagcatgaaatgagtacagctcaaaacttttggctcatcataatttatccagggctgcaaaataccctaactcatacctgcatatttacccacatgtacaaacacacacacatgcacatgcacacacatgcacatgaatgcacagacacaaattcttcggccataaacctggacctctctaatttttgctttgctcatctctccttctctagacggggagccatcggctatgtatccccagtgccaaggaaaaggagctcaatctgtgtttgtggaggaacaaatgaaagaatgaatgcaaagcaaaatgaatgggattatttctaaagttaactatagttagaattctggtttattatctgacaaatttgaaggaacttagtacctgctagacatctaaactgcccaccctcacccccaataacaagttaggattttcgtagttggagatgtgcctagagaaaaataatgagaagctcccctaggctggggcctagcctcttgggcctgtagcaactattcctgtaactcagtattagctatagagcggcaagattcagtgttgcttaaagtggacaggtgggcaggcatggaatgaatgaatctggaatagagcgagaagcaggcttatgcatctgaggcaggcatttctaccatctaaaacaatggggtgactttgcagctctccttggtgaaaagagcacttcgtggatgatacccttttgttccccctcactccctttttattcacccctctcctgtcctgcttaccttttctttttcctgtttcctcttctttatcccccctattcttcattatttttttccctgataaaccccacacagtcctttcttcatttctatttatcgtttaagcttgatgcagcaataatgtctattgtttaaagggcttttccctcccagagggatgagattgacccttatttattcagaatgacttgactcagggctgttataaaatgtgggctgcacaaaactgcaaggtggctggtgcctaccagctacctagataagtggtatctggttgaaggggaggacaggcccctaaggcctctttgagcacattgtctaacctggaagtcatctccttttgaaccacaataaatgagaaatggtcttagcaagacaaaacaatgactataaaaccaggtggctaaaatatggctgaggaatgcagaagagtgcactggtatatcaatctctaattggggaaatgatttggctgcagcacaaaggagcccctctctgtctaacattgggtttgccccttgagctttctgcaggcggagattgatggtggtggcgtgatggtcaaggaatgtgtcctcagatgaggctgagcagaattatttctttgtaaattttctttttcccctttcttcctccctcccttcagatatctcactttctcacctttctttcaccttccttcttttcttgcctgtgatcctttcaaaccactttagtttttttcttatgtggagaacatggttgacccattcaatttcttttcactacagagtagcgttcctgggggctttgatgggacaattgatataatgaatcttgactttggtaggactgttattctgtcttcataaaatgctactcaataaaccagtctctagattatagctctgttaggagtgtttatcactgttgaaaagaagccttataaaaattgtcatctgtgggttattgctaacattatagattatgaatctccatttaaaaaaataaacactgatttttataattctaaaattaatatatatttactgtagaaaatttggcacatggaagtttattaattcaacttattctttggccgacattaactgagtacctgaatacaaaacctgtggtggttctacaaaacgcatttcatgataaacaaaaataaatataattgagcataactgtaccaagcagaaatggttattattaacatatctgtatgctttattctattattttgggaatgtgtatatatatatgtgtgtgtgtgtgtgtgtgtctctgtgtgtgtgtgtgtgtattctattcttgaatatatactatttgtgaatacatatattctattctatatatatattatttgggagatatatgtgtatatatataacatgttaatgtaattttataagtaattattctaatttttccagttcctgttttttttcaaaaattatctcgtagttgcataat[450 bp omitted]cactatacccactctagtggaagggactgcaaagtcacaagcaaaggctgtgggtatataattcagaaacaggggaggtgcaactaattatgaacaataaaacagtctactatagtagactacctgatattttgttatcactaatgtccataggttgatccaagaagactagttttttatcctttctgttaacctctaatgtgccccaatattgataaatgccatgagacctttttccaaacacataggcttcagaagacatcagagtcttctccactgcccattttctgtttggtggttctaatgtatcttcccattgatacttcaactcatcatatctctaggagttttatttcttgcttcacagaagtctcttagaccaggtaagaaactagctctgattttaatgcagagaatgcttatgaccattattttagatgggcttaaaacaatgaagcctgagacctaaaagggccagttccagaaaatcattagcttcaaaatctagacatgagagaaaggttagatggtttgaggatggttctacaaaatataatggagggaggccagaaaaggttagtgggataaggttctcagacacttggattctctaggagcagtaaggaatgaatttagttttttgctttttggaaaatttagaattactgaaatttgctcaagtctgggattctttttctacttgaggttttctcagggctttgaagaatatgcactgcatagggttttggtattcaggcttcattatttttggttccattctttgtaacacctggggtcctggttctctgctgatgggcctcttaattttgtttattttgtgtctgaacctcagattttagtttgtatttattttttgaaataataatctggttactgaattagacaccaagctcatggaaagcttggaccatgcctgctgcactattttctgcctcatgcctgggatatagaacgtgctcaacacattgttgttgacggtgataggttcagggcacaggtatcctgtatcctcagtctttgcatccaaaacttgacaaatccttttctcacccatatattctccctctcatgcaaaccttcttactttagacttatattttgtgtttaacagtcaaacatttcctctaggatgcctagtctatgtagccatttcaaagataattttctaaggaagaaatgcgaccatccaagcaaagtgtactaatgtcaaggaatcagtgagtgctagaaaagccaattcagagtggtcagaggtaacaaggagactaactaaattgattagctttaataacttgtattgtctcccagagagaaaatattcctggccagaattttgtcaggagcttgttgctctaagtcaactatattgcatgaggactcagagagtaagtgtgcaggaaaggagaaatttatttgggaagattttgtagtggaagggatactatgtaaggctaatattacagaatgttagcagaaagccatctgttaccactgtggtttactaccattcagagagtatttattgagaccgtattatatgacatgcactatgataagaagaaggggtacaaaggctagccttcaaggagctcaaggtcaccctaagaataacaggtggctgcctccaggaagatggattgaacatgaagtctattgaacaaagaccctgctcttactgttgcatgaatgaccttgtttaagatgcaagattgactgtagatggcagaggagggggaaagagaataggcctaaatctcagtcagaatagaacttcaatttctccactctcgaatgcagtgagcatagtaagacttttctctactgaggcaaagaaactttggctacagttgaatcagggatttagtgtgaaaaacatgtaggtttaaaagagccaaacacacgtatctgcatctgaaacacacacacacacacacacacacacacacacacacacacacacacacccttttcatcttactaattcctatatttcccattacttgagagataacataatgaattttggatgcaagatgaaaagaaagtcattttatccaaagggatgttatttcaaagacatacatagatgagcactcctgcatatcatgctattcttcacaatgtcattttaaatgatatttactcaaatattagttagtgatgactaactgccagataccatgctagtccttgagaggtacaatggtgggcaaaatgtgatgcatctttggcctcatggagtttatagtctagtgacaggagaaagacatttaccaagtaatcaacaactaaacatgcaatttcaaacttttgaacttgagaagtatggagagccagccctagttgaggggtgatcagggaaacagctccagagggaatgatgcttgacttgacatttgaagaataagaaggtgttaccagacaaagatggatgcagtcttctaggcagaaggttgttacaaagcccaataggtaaaaagaagtatggcaagttagagttcaaggaacagagggtaagtcaggttggagcacagaaggtggaagtggggaggagagggaagaggagacagggcttggtcatgtcatcacctactggtagagtatgatactgatttagaatttatcctaaaagtaatggcagacccttgaacagctataagcaggagaataacatgaccagatttgcttttttaaaggtcatcttggctgtaggacagtgagtggattggagaagcataagaatagatgttaaaatactagttctccaggaaagagttgacagtggactaaatttggactagggcattgaccagggatgtgaagggaagtcggtgaatttgagatatttatagaagatcctatatttgtagcacttgagatgtcaaagaaaaacaaatcaggacttagtaagaagagatttttattcaaaacaattcttgtaagagaaagaaaaggacaattgcaaaacggagaatgctataacaataaagtttgcaaacatctcaatatcaaacagaaacaaaaatgtttttctttcatagggtaaaggaggaggctagcagagataagcagaatctttggggtgggaggaagctggacaaacaaggggaaataacccctggagtctgacaggacagagggtcttgctgtcaccagctgattcccaggagaagctggtaagcaggtacatgttccccttttatgtgtgtgctcagactttgggacaagcagtgttcaggaacctgtagaaatgactgaagtttggttaaggcaaaacagaaggatgagcaattgtgaacactaggttagagaatgtaattcaccatgacctaaaagatgacttcaaagggatcaagcaggagaggtagaatcttctcagtggatcagtcaattcttatcctcttctctctaggggacagttgatatctttaattcatattaggggtttgttttaggggtttcaaagtcttctcacatccttgagttcatttaccttcacaaattcagagaagtctgttagaattgaaagacctaagttagaagtcagttttctagtcttgttattttacatatgaggaaaacacagtctagagagggaaatgtatctaagacatccccattagatggaaaactgtgaccagcacccaggacttccaacatccagtctgggaatgattcctcctttatatggccgtttcctatctgagaattctcatgacattctcatgacacttcagtgtagcactgtagattcctcccatggagcaaactaaggtgctttccacccaccctatcccctatacagctacacacatagatatttactacacacatacacatagatccatgtatcttattctgaaagctgccagatgtcaatttgaaatttaatttaattggttccttgagttttcggttccccatcatcctgctccacctttcgcttagcgtggccatcctggagttcaagatgtagttaaaaggcaagatggtgtgatggatagactgtaggttttggtggcaggcagaattggtttgaaagcctaatagctacatcatcgaagtgaaattatttaagttttctgagccttatatttttttcactcatagggctggataattgtaattgtctcacttgattcttgcaactattaggtgagggtataataatattagccaccattttattgggcatgtactatgtgccagacattgcacaacatgcttaaaggacattgccccatttaatccttatgccataacctgatgaggtgggtaatattaaccctactttaaaatgcttaagagttcccaactctaatagtaataaggactattattcccacaatcatttatttacacttttattcattcacttattattatgaagtgcctattctgtttcaggcattcttctgggtactagggatacagagaataaaaaactgacaaagcttcttgcccccatgcaactaacaatctagtgaggagaaataaaaaataagcagaatacagtaaaatatatgtagcttattagataaatgttcaggacaaaaataaaatagagcaaggggatggagaagagccaggatattgctgtgtgtagtgtagggaggtcatggatgtgaccatcgattgaaaatatattttatcatttcagaaaagacttcctggtagattacatgaactgttaagttaatttgctttttgggaaaatttagcacttggtatatcctctcattcttccctttccccttcctccttcccttcctctcttaatgcctcacacatttgtgatattggctgtgttagttgctgagaatgtaaagaggaatgtttcttttatctgcttgtctacctaccgttcttcctacttaatcccctatttgttccacaaaggattaagacacatacaaacaaataggaatggtccagccttctaattcctctgctcgggctgtgcccatctgctgggggtgatttgggatttggaagctgaactgtcctattggtacccaaaggtaccagtaggggtccaaacacagttcccaagtgcactataggaaatccggatagagttggccctaaggcaccttaccctgcaccccaagatgaacactaaaaatctgttcagctcattaaggggcctcccagcagggtggctccagtctgtgatctttgcagagcaaagtgatgggtgccctcattactgatgtagtaggctcttgacccgtgagctgcagctgcacacagacagctctgctgcccaacacactctcatcccagtcctcaggtggaggagggatagagtttactgggaaatggcaaaaaagggggggaggggtagaaatgggaacattttcaaattaatttcagaaatccagtcttagctctaaacgacagctgtgagtttaatcactgaaactctctttctattcaagagcagcatgtgtctcctgaggagggggagcattatcaagcagttaagtcgttggaagctgcttaggggctggtaggcagtctgcagggaaggggaggatggcttcgcttttggcagtgacctgggtatagtaggtactgcttacctgctatcatctcatgctatctccagcagtccctgaggattgctctgctctgtctatcactgcgcggggtgggaggtaacatcttgtacaacggaagccaatggggccaagaaaacccatgcctcagcatcgggctaaaaaagttaatggatttcttgattttaagggttggggattcaggagggaattttcctttccatctgttaccaccacagcagtaacagcaactgcaactacaacacactccaccaactacaagagctaatgcttatggagcacttcctaactccctaaacattcacgtcttcgttcatttatgatttactgagcatcgactatgtgccatacattgtgctaagcactgggaatagagcaggagctaaggcaggtatcatccttccccttaaggagccagcagtttagtggaaaagactaaatgggcatctgatgaactcaaacctggtccccaaagatgtcagctcacccgttcgaggaatgagtctcagccttggtccgtcacttccagcctaggtgggggaatgtcagctgatatgaaagctttaccctcccctcccatttacctctcagaccccaccctcaggacagtggtatctgtccgtggctcccatctgtgtgttgctgcccatcacttcagaggaaccagaagcacctgccagagagctttatgtcatcagccatgggaacttcttccatgctgtttgttgcactggcctattttagggaaaactctacgcatgaagagggaagctgaaaagacacagggcaaaaagaaatattccccaccccattctttttccccactatgattttcttcttctttgtcttttgttttatctattttatgattttgcttttcattttaacactgtggtgaggggtgggggggtgctttaaaaccagagccacaagcaaacaggaattagatcagggaaataagaaggcagatggaagaatgatttttgagtaaagcccaggcccagtggaatctgccttgaccatgtggtgctcgtgtgggcccacagaaaaaaacccagaacattgcagtagcaaagtgaaagctctgtggactgtgaatgcagattagaattaaaagatgtgcttaccacactgtctctgtctctgtcccagagcctgcctgtgaacgccaagcctccactctcttccccagatcctattctccgtcataagttctccatcacacattctcacctcttccatttgagtctggattaacacagtagatgctgctcttttttgtcatttttcctctaccatgaccaagaatagtagtttaggcaaataaagatactttcttcctacatatcaagaagttccaagcgaggcagcccagagctggtaacagcccaacaatgccgctatggaatatagtccatattttgctccaccacacatagcatgttggctgcgatcctcaggtttgttaccttatggttacaatatggttcccacacatccaggcatcataacctctttacaggctggaggaagaagaaagcacaaagaactttggttgccctccacagagccttgggtactctttcacagacaactctttatatcttgttttattttttgagacggagtttcattgttgatgcggctggagtaaaatggcgcgatcttggctcactgaaacctccgcctcccgggttcaagcgattctcctgcttcagcctcctgagtagctgggattacaggtgcctgccaccatgcctgggtatttttgtattttttagtagagatggggtttcgctatgttggccaggctgctctcgaacccctgacctcaggtgatccaaagtgttgggattgcaggtgtgagccaccacatccagccatctccttgtatcttatgttcccatcccaaaaccaatcactggaggaagggatacaattaccaggcctggtgtggaccaatcatgcttcatcttctgatcttctgtgggtgtggtaggggcctactttctctcagaacaagggctttctaaccctaccttaacaaaccaggcttctgtggtcagagcagaaggggaagcaatgtagttgataagcaatgagcaatgggtgccacttgcctttgaggtcctccttttgcctaggttgggtgccctggcatctcttaagttgggggtggatgtgagagagttatctctttatgccaatattaataattttgatgttcaaaagaagcccacatgcagtttctgacattatgttccacttttaaactctcagagccctagtctctgaattagaattctagttttagaagtttttctgggcttgcttttctattagaaaccatttggttttgtggccttgtttgaaggcaccattgctcactggttaaactgactccatttgcctgaatgattatcgcctgatgtcttgaggcttacagacccagagaaacctttattcttttctcgtaacagttaataataaagcacttgttcccttgtctccttttttttttctgccacagtatttctcaacctactatctttccatcttttgtcagctagtagtaaaattcttctaaaagacacccaagttcaccactgtcctcactttcaacatatagtagagcactttaatttgcaatttttttcttctcttttcttttcttttttttttttttacacattagccattaaccctgcaccactgccctccacatctttgtcttctacatgaaacttctgtaaaaaatgtctgttaacacctagtgttcttctcctggataatgaggaccaaagaataacccaagttctctttgcatgttggcttgcaggaaacttagagttgaaatacacagctcaatcttataaaatcttatgccctaattatcagtgataattttcttctctgagacagtatcttatatctgaatttatattttttctggttatgacttttttttcttttggttagctctgatattttaatttaatatgttttcagtaaacatataaaatcttttgtcaaataaaacaatgtatttaaaagaaaatagctctgtgcagtgggctttgctgttcttattttacatgttaggatattggggaaactaaaagtcagaggtggccaagatgttttcctattaggtacctactctggctgattggcaaatttcaccctggcatgttaggtagagaaaccttgagaatctgcatccctcactgggatagagatgtagttatcaattagcagtgactgttgtaggtttcatggaaagaggagaagtgtgatatctttcaaggacacaattttcctccagaaaatccaggaatcctcattttatatccatgctgaaggctcctagagtagcattcctcctcttccctccctctccctctttttttgctgtaacaacacgtggggagatatgatggaagcgaagaacgaagtggactcttcagctcaatggaaaggcatcaacacttcatttgatttggaagccaaagaagcaaactatgaaaacctcaccagcattgcaagggagtgatagaaatatataactcacaaatcattatagcttctcaacgtctcagtttttaaatttttactgtgtatttttttgttttgaatcactttattgaggtatgactggcatacaaaaagcagaacctatttaatgcatacaacttgatgagtttgagaaaagtacgtactcatgaaaagcatatgttcatgaaagcatcaccacatatctatcacgtcccacccttttatttattattatttttgcaataagaacacttaagatatactctcttagcatatttctaagtatactgtacggtattgttaaccaaaggccactatcgtgtacagtggatctctaggacttattcatcttgtataaccaaaacttggtacccttggactcagctttttttctgaatgataggttagatgctaatttgcctgcggtgcctacagaagttatcagtgacataggggaagataatcttccccagcctttctcccctgtctagtgttcaaattgtaaaattttcttgaactggactaaatgccttaaaaccctggaatgttggtgtctttgaacccttactttgagctctatggagacctagattgtccctggaggtagtgcagcctcatttcaacaaatcaggttgtcaaaatggctaattgtttcctcgcattactctccctgagaattacctttcttagctggcttcccacggaaactaatggtatttggcaactgtctacttccaaatcttcctctagaatattgcaagaatgtctgaaagcacaacatttttggacaggccaagatgccatgggagaaaacacacacacaagcctacgtgctttctccaaaacttggctctgaagacagtcatatggcagtcacaccacaatccaatgaattgttttacctcaggttttggaagtttcactgctcccaatagcttgcattaagccctaaataataataatgaggaaattctattaagaactatttcagaagctagagaatgtaatgattataaataagaaagggaataagccatatcaattgctgcatgtatattgtataaatagcttgttttgcttaagcattagttaagcaacattaaatttaaagagtgtttctattagccaaaggtatgtagtgtgtgatatagaatgattcttggaactttgaccagattttctgtctgggatgggagaaaatctggccagagtgtgtcttgtaggttgatcacaaattcctaatgttcatcaagagtggaattttgacggtataatgaaagcctattttaactatgtaatactattcttattccattatgtaggtaatgaaagtttgtatgtaaataaaagtttaagcttctctttataataatttatcacaggaactgcctgcaaatagattctaacgataagaatgttcttcttttagctataaatccttagttttctacttcttgcaaataaacagcttagttaaataaactcaagacaccatcattaaacaattcaataattaaggtctaatactccttttattattaatcataatcacttttttatttgaattgagctttacttagtttattgcctctattattgtctgagaggagcactcttatattgtctgctttatgcaggcaagtgtggttttaagatgagcttgggtcaaacatcaaagcaaaaaagatttgactataaatcctagcttcctcattaaccagcttggtcacctatcacaaatgattatagcctctcaaagcctcagtttttatttttttgaaaaatatgtaagatactactttatctactttgttcatagtagttattgctgacatgggacaagatgatctttatgctctatttggtgtttgaattatagaatgcttcatgaattggattaattaatgtaaagtttttgaatgttggtgtttgtttaatcagtattctataatactgccaatctcttactccttgctatccacatatcttcctgggtgatctctttcgcttgcacagagtcaacttttgtctgcctggataactccaaattctattccttttgtgcagaatttcccatgagcattaggcacacatagctcattgcttgcctgacatttctaactggatatttcataatcaactctaaatctacatgcccaaaagataactcttatcacatatcagggtatcaaaactagatatctgggagccatccttagctgaacatagtttcttaagaccaaggcacaaaatatttgtgtagaggagacatggggcaaaggagagaagaaaagcaagaacgaggttgtaaagaaccttgtatgccgagtaggaaatgttcatctttattccgaaggcaatggagggatccttcattgaaagccttctgagcaagggtgtaacatggtcagatttaagtcttattaagattgttctaggatcatctaggggatacagtgaagagaactttactgaattcaggcaaggcaaagagaaagctattgcagtcaacctagcattcaaagagaacactccattgtggacaataaaatcctggttgtttaggtctaaactttggccttggaagggctttttatataatctagtaaattttcctttaccaacaaagtaacagatactccagaagtttttaagcttgcccaaagtgactcagctggcagatggcaagtaccaggctgatatcctgcaggttttttgtttgtttgtttgaaatggaggagtctcactctgccacctaggctggagtgcagtgacgcgatctcagttcactgcagcctccgcctcccgggttcaaggaattctcctgcctgtctcctgagtagctgggattacagcatacctggctattttttgtgtttctagtagaggcggggtttcgccatgttggccaggctggtcttgaattcctgacctaaggcgatccacccgcctcggccttccaaagtgctgggattacaggtgtgagccatgtctcccggcctgatatcctgcagttttgagatacagttttgtgtgtttgccttggagaaaaagagaatttcagttgcccacgattcatacatttttatgtggcagcttccttgaaagggaacaaacgttgaagggattcatttggcaacattattcccattttatagatgtgggtttttaggcttgaggaggttgtgacttttctaaagtcatgtaattaattagtggcgaaggtgttatttaatgacagcatctctcaatatccacttccacacctttttttaatgacgctgcactaaggcaagtgcctcctctgggatagtttctgctctgttcactgctataactgcacagaggcctgcagtttgaatgaagatacacacagagataactgaagtttcaactaggaaagggcaactggggcatgtaggggcaagtgtcaactaggaaagggcaactgggtcaccttaccatgatgacttcttcatggtttcagcctggacagcaaccttgcagagtcagaatcctgatcagcagttttgaccagcacatcaagagtggctttacctcccaggcattgatccagcattagtcaagctacaagacactgatgtagaaaaccataatgtcagtttactaatgtagaataagaaataaaatctcagaagacctgagctctcctgtcagcatgacttgcacttgtacttttcctttttgtagagaagctaaattataatcagaaagttgttttggtgagcttggaatcagaaaataggagtttaagtcatctgttcaacatgcagctttcctcagctgtgatagctttttcctgctgtccagtcttcatgtggagcctggtcaatagcaccagaattctaagtctgctggccaaggtgctgcctcctgcagagagagaaagcccatcaaagttgacttcagtgactcccccttcactcacccctcatcttccacggccaaccaactccctttttgattgacacatcatttctttacatacattaatgccttccatattaccacagagagtttgttagactggaaatcattttatttctttgatctacttcatctttctctgcattgagcctttgcgtactaatttatagctattttctcacaggatagtctatttccattatatctatattttctagtggtcctttgcgtttgcctcttttccagactgtatagggcatggtgccaggcacagtttatttgttttattctatatgctgatagtatcatcttttccatctttagatgttttatctcattcagagtgagaggggcacttggtcagtcctttttgcatctcaatagttgatcctcttttgattaaaaaatatttaatttctaataatgtgtgttagagtgaaaataacaggaattattaggcccagtcaagactaacagttcttgactcatagttccaaatcacagttccaagatttccttaacctttctgatcctcacttccctcccaaaaaagtaagaatggctataattacctacctcatggaaattataaggcttcagcaagattaaatgtactcatttatttaacatgcatagtaagaactataaatgttaatttattcttacttacattaggatactgacttatgaaacagagattaaacacattctgcaaaaggactggtattgacaggctttgattctaatagctcaaaagataggccatggcttgctagagaaaatgaaaggatactcaaggctcattagattaaaaggctgctaatgttctctaagctgtaagtagatttttgcccacatttatgaaggttgatttctaatcagattagaaatggcataggctggtggcgtcatctcagagctgccacagcattctcaggagactcagccatatcatgttgggttgctctaagaacacacagagacctttatgctttttcacaaaagcatactctttccctggagtgtgtaactctatgtgttgacctttagtgggataagttcttacaatggagctattctgggtacaaaacatcactactctgtgagatttaggaagataacactgtttgctgattttacaagcccactcgagtgtcttgatgtgtcaaaatgggagtccctgaacacggaggaaattcacaacatcctaagcaattgtaacagatgaccttatctaatgagaactggggaagtcctctccttttagggaaagtgaaaaatgtgaactaaataggactttctgtaggagagatgcctaaccacccatgggcatgctcacttctacttgtgcagagagtttgcacaaccccatctcatttggtcctcacatcttctttgtattcattcactcagctaggaaggggaatggaagaacacattctccaagagtagtgcctttgcaacatatttttcaagtaaagtgttgacacaatttttgttaagactatgatgaaaagacaattgagaaagaattgtgaaagccagatcttgacatatgcataaaagtacatggatgcctggctctgggctgattaatgatctgtggttgttaaaatctagttatgcctccacttgggaggagtaggtaagctcccagggcaggtatgaacctcaccattttagagaggaagaaatctcagtgtcaggatgttaagttagttgccaagacctcaaaactcataaatagcagagccaggaccagggttgaaagtctggtgtttcacattctgccacacctctctggccagtgttgttcgtgaacttcgggactaagactccagctcaaatcctatgcggatgtaggtcaatttcttaacctctctaagcctcagttttctcatccttgatgtggggatcataaatttacttcttacgaagatgaaatgaaataatatatgtaagcagtgtgttcaataattgttagttcctttgcccttcctattttctcaccaaggaaatcaggtgcaataagctttagtgatctgctaaggctagataactggtaaatagtgaaagaagagtgaggagtcaacagatgattctgcttcttatttcacgtgctttagtggtatttacagagccctggtgcaagagtttctctttgtacttagagaagttgattttctttttcctaatttcttcttatttgaactaagaaccctctacttctctccatcccatctgtattttttctgatgagttctgtagaatatgatattgcattcaagcttcatcatacttttggtagcgcctttgcttgctacatgataactgtcattttagctgcaatttttcaaaaatctcctaaaacactcttctcacacaatcggcctctcttaactaacttgtagacaattttgcccttctgctcaagatcttttctgcctcctttagatttcctccctatccatttctgtctcttctccctatgccttgatctaaagcttttgtgcattatgggactttctccgaatccattttgtagtcattcactcatgtaggataaatgcattttttaaagcactttcattttcattttacatgaaagagaacacttgggtactggtgaaatgcttaggtcagcaatccttttgggaagatacacatgaggggtattatgtatctcgtctttccctctttcaacattttctaattcaattctatataataaatatttactgagtatctactctctgctgggtattgtgctaggttcaggggatatataactgaatcagacagaacccctttctttacagagcatatatgatgatgtcatctcaaggggagcccaggatttcaggtcacctatgtataaagtgagaaataaaggctggctaggagtcagccatgggaaggggatagaataagttgaacattcatggtaaagagaatactgtattcaagatcctaaagcataatatgttggaaaacagaaaatacagtatggccagaaggcagaactcaaaggagaatgagagccagcggatgcggtaggaaatgtggggaagggtagataaagaagttagggggtttattctcaagacaatgagaaattattgaaagagctaaatgaggaattggtataatatgaaatttaaaaaaattatcctaattgcagtggtcagatgggacaggaggcaggcagcaagtggagaaacagaagacacacagtaaaggagccaacctagactcagtggtaacagagatagcgataagtgaacagatgagaaagatctgggtttagaaatggcaggacatgctgatgattgagctatagaggaagaggaaaagaggggagtcaaatacctgtctatgcactgttcataggagatttaatctagtcaactgttttgagctaaaatgtgaaaatacaaatgccatggccagagcaaccataactattaattagcagcaacccttggcaccttcacccaaagcaatcactatgctgggaatatcagactctgcagtagaaccaaatccaggacatccgtgtacagcctactcacatcacagcatctaactgtgttcacataaaaggcagtgtgaggcataacgacccaactcagaaatgccttttttttctggatgttcttttcctcacaaaacatcaaataagagagtctggccacattctgatgatttctcttagaaacttagagaaggggagaacaataatttcctaaggaagtgaaccaattgaattgtcagatgggctgagcagtgacttcttcctggctctactgtgggcctcctgatggatggacatgggccctgtggtaaagagatggttctagaaatgcacagaaactatcgattccaagttgacaaatgagaaacaaatccaatctcaccagccaatcgggactcatcattttgccaaaacaatgcccatagattgcctaccactattattaagaaaagcttttatgctcatttcaccttcagtgcccttgatccaaggtctcagatttatcctagtttcattttcagtgaagtattgatttgataaaagaaacgagtcctgctgctgattgcttagacacttgttagtttcacctgcatatgtaaggtggagttggctgtagttcaagcaatagaaagaagaggtactattttaacaacagttttcaaatctgaagctgatgttctggaaaaattagagccatcggtttattttattgtttcatttataatctcagtgtgcatgtatcttaattctttgggaatagagaaatggcttcagagaggctggctgaatggggaggcagaaacatccaactctgtccctctgggcttctatctccctggggttcctttcacttttcctccaactttgtttctttaggccctggagctaatgcaggaattgccaaaaacatacctatgtggcacacaggtcctgcatgttcttgttctagtaagtggtgtgaatgtgctgtctctagaattatcttgtcctgtctcatcaagaaaatcccctgcagatgtgaaaccctcaagcaattttctctatctgaagatcaggctgcattatttatttatagttccttcagcctccaaaagccctggctgaccctcagtctttgagaacagcacctctgtaaacagatgaaagggattccctgtctggaatgtcatggaaggttccatgaatctagcttccgctaataccaaccattctagaggataaagcccaccactgcaaaagtgtgatccagcctcacacactgccttgcaaatattcttcaggccaactgatgggtgaaggccaggtttgagaacagcacctttgtagcccatgaagtttcttgacacatttagcctcaaacacttgcagagcagatatagtcgatatatcctgggttcatgaatgacaaaacttttcttcatgctgaaaggccaatcataggaacctcaagtttggaggaagtcgcaaacgtaggagagtaggtgatcttgttatgcttaatatctagtgtgatgctggaggaaagacagccaaattggaaagttggggtgagataggatgtgtcttttccatatgtttaaaggatagtatgctgacaagatattattaaggctacaataaggcaattgaggaagctgtatgtcaataaggtcttgagatactcagagagattagacaaagcagagtaatattttcacctgcttaccctcctcttcccccaaaccataccaatgaacaacatgggccccagccctaaattcacaatctctgatgtaagagcctgactaagcatactggcattaaacataaggatgtttgtgtaggcaaaaacccccaaacaattattttagttatctcaccatgttttcatgtctgtttatgaagactcaggcttcctaggctctctgagggccagaggtctcagagctcaggaggtaactagcattggcccttcctttagtttctctttgatagcttattacttaaggaccccaggggaacagtttcccagaattctaccatgacaatttcacaatattgaaaatatattaaactgacattaacactgacatgcataattcctaccaaagcggggaggccgttttgtcatgcggcttaggtggaggagagatagtaagagctgttaggctctctgaagcctcttagataaaagaagtccttagctttgactataataccagctatgctcaagcctttttccccccactatattctttacaatttcacagttaatctctgcattatggttctctgtagccagaagacattgcagacagggaattgagaggatgcttgagttaatctgcagggtctaaggtggtaaaggcaattcagctaccctcatagcatccccgatgttccgaagaaaggaagcagagcatatgttttacatggggataaattctctttatagctaattaattacaaattgccccccagtgtggtgatgtgcacttggggatagattaactcaggggaggagtccagctgctaattcttttttttctccctccctgtccctccttgtgctcccctcctccttgctccctatttcttggaggctgtgtctcctatcgctctgtttgtacagctagcgctaatctaaaatcacagttattagatcacattaagctcctcaaagtgggtgaagcatctgtgagtgtctcattaagtcctggacacacatagtcttgccacccctctctaattaagagattcccactcttccagcactgctgactgcttcctaaagaaagtgtgcctgccctggaggggacggaagggggaaggagtgaggtaaagtaagggtgagtcttctccatagaccgtgaccttgcccagcagtgtggcctgctggaggagcagcagtagcacctgggagcttgttagaaatgcaaaatctgagccccatctcagacctattcaattgcattttgtagtttaataagacctccaggtgattcatgtacacggcaaagcatgagaagcactgaaccaggaaatggatagaggagtggatcccaggatgcaaactggcagaatcccagttgttaggagatcacgccacaggcagaattcatctcagcagaaaccgaagtcaccaatggcaagtgttcgtgtatttgtgacattccttgggaattgtgtttgtccttgcacttgcgattttgccttttaaaagagcattttggggccaggcgcggtggctcatgcctgtaatcccagcactttgggaggccccgaggcaggcagatggcttgaggccaggagtttgaaaccagcctgggcaacagggtgaaaccctgtttggtttcatctctactaaaaatacaaagattagctgggtatggtggcacatgcccatagtccagccactcgggaggctgaggcaccagaatcacttgaacccaggaggcggaggttgcagtgagctgagatggcaccactgcccaccagcctgagcacagagtgagattctgtcttttaaaaaagtattttgaaagagtaaaaggagaataataatgtcattggacacatttagaacctatgtatgccaagcattgggagtagaatgcaaggcaaacatggctcttaagaaattcacagggaaggaagattctgaaataatctctctgttcagggctctatggggattcttaaatattgggcttatatgtcttggaagaagagacattaaagtgagattttaagtaagaaaaagtataggcgtgggaagggtgtagcaggcagaagaagcagtgtggatagaggcccagggataggaagagccttgccctcagggctagttcagattggctgcaatgtggggcctgaccagagagagatggtgcttggctgcaagggtgggccagggtcatttcacgcagggggttgtaagcctggtcattaggagctttattctaaggacatcaggaagctgatgaatttttaacagagaattctgagcaggagatgtcaatgaatgtcctgattgtcatccaggtgccagctgcattgactcagcattggcccacgcacactgcaggctgagggtgtggtgtacacactctgctgcttccctggtgacagcattccaccgactctgcccttagatacagtgaccccagatgtcaattcagaaaccacacacccacgttacacagtctgtaagtgaccagccactcaggtgaaacaggagacttgagtgatggcagcaaaatgaattgcctccaaattcaactgaatatgaaaacatggatgggttctcatttcccttcaacaaggaagttccatgtctcaagcactcttttagttactagggatagatacaacagtgagcaaaacagaaaaaaaaaattctgtatttctggagcttacatttggggttagcggctgggtgacttgtatcgatttccatcattatgtccttaatttcacagacgctgaaactgctctggtttttggctatttagagattgcactctcttcctttgtggcttaagctggtgtcacctttacagtaagatatgttacctgaaagagcttttaagaaaattaaatctattttctcctgcccctgtggattagaggaaaacttcctattgcccagtagcattttttttatgctctcagtgaataatgatgataatggcagctgagatttgaatggtaacttgggtctaagtactgcatgtgatacatttagtcagtccccacaaacctgattagaaaggaattacctccagcattttacagaagaggaaatggaagcttagagcagtgggtaacttacccaggttgaaattggcagagctgaggtccaaatcagagaaattcagcatcgatggtgcaatagactctaggaagtggcctcatatatggtctagtcaatagaagaagccagaaaacgcttttcagagaatgagatctagtcttgtcaccttcttcacttaccaccttttcttggcttcccaaggctcaaagaataatatgtaggaactgctaaaagataaactggggcacattcaaattttaaggagtttatttgagcattcagcaattcatgaatcaggcaacatgagacttgggctgttcagagctccatgacaagggtgtgaggggaaaccttataaggtgtttacagaagcacaggaaagaaaatgtttgattggttaaaatggaagtttgtagttcgaggttaggcgttagtttcggattgttaagctcgagttttgcttttctaggctatgactctactctgagttgggttttggtttgcttaggtaggaacccaccacactggagctgactcagcctaatggtctcccagttaattattttaacactatggtggggttacaaggctctgtaccagttggcctccgtttctttgttcagccccagtcctgggtactccccaccccacaccgttctcctcactcccagccacacaggccttctttcagtccttaatatttcccctgtttctttctaccacacaggctttgcacattctcttctcaatgcctaggatatgtcttcttcacatattttctcaaacacaaatgcagatctcagtttcaaggtaatttgctcttggaagcagtccctaacttctctaactacatcaaatcccactcttcagttagttccacctttcaattgcaattaacaaaattgtaattttatatttagtagtgcagtggttttcaaagtgcgactgccacaccagtggcatcagtatcacctggcaacctgttagaagtagaaattttcccactccactctagacctactgaaccagaaactctggaggtgggtggggcccagcaatctgagttttaccaagttgtcctactgattttaatgcactgtgaactcgataaccaccatttcagtatacactttttttttttttttgagacagagtctcactgtgttgccctgtatccacacctttttataatatgcttttggaggttttcccatcaagaggtggaatatatttctctacttatttaaaatacctgactttggacttatgttgtctagtaaaaggcagcaaagttacattgtgccagttccaagcctagatgtcaagaggctctatgctcttccatttactctcatggaatgcccaggctaaagtgaagtggcacgatcatagctcactgtcacccccgggctaaattctcccacctcagacttccaagtagctgggactatgggtgtgcaccaccatgcctggctagtttttgtatttttttttttttttttttagaaatggggtcttgctatgtcgcccagactgttttcaaactcctagcctcaagcaattctcccaccttggcctcccaaagtggtgggattacaggtgtgagccactgagcccagtctagcgcatgcctttaatggatgccattcttccctcataggctgttggttctatcaggacagagactgagttgttgttgattctctcttgatacccttacttgctattcagtacatgttaggtatccaattaatagttgtttagtcaataaatgagtgagcacacttgacttttgtaatgtctttttaaagaggtattattttacagataaaaaacacctgaggctttgggagttctattgactgctaggtgtgagttatgttgggtcttgtgaatttacaagtttcttctttggagaaaatagcaaccgtagcagctctaggtgcaaaacatctttgatgaagagattccattggtatttcatggataggctgaggaaaggtacttagtagcagtcccctaccaacctgaaataaacctgttttgcttccttccttactcaagcatttctcaagtatactatagctgatcttggcattaccaaaatgaatactatcctcagaaagcttaaattatctgtatgtttacctatctgctgtgtgtatgtagatttcctatagatacacatttttctaaaaaatgctaggcaggcagtgacatatgcaagagaataataatcaaattagtaccaaatacttccagttgaaaaacatagattatgtatttacatgatggttttggacatggaaagtatgagagatatttctcacaaggctgcttatagcaagtaaaataccattagggtagtctctttttcattgaattattcatccagagtcattgagggcttccctagacaatgtttatgtattttgtgtggaaagtataatatccaagaaaaaccattttcatattttttaacacttttaaatggttcactagccgggtgcggtggctcatgtctgtaatcctagcactttaggaggctgaggtgggcagatcacctgaggtcaagagtttgagactagcctggtaaacgtggcaaaaccctatctctactaaagatacaaaaattagtcgggcatggtggcatgcacctgtaatcccaactactcaggaggctgaggcaggagaatcacttaaaccagggaggtggaggctgcagtgagccaagatcgtgccactgtacttggctctgtacaagatcagcctgggtgacagagcctgggtggctctgatcgcccaagctcagcctgggtgacagactgggattctgtctcaaaaaaaaaaaaaaaaaaaaggttcactgtaaaatgaaagttttgttgtacttgctttttaaaatcacatattccattctccctcacccttgctccaacttttaaaaattgactttgtttaaaaaacaaaaaacagctgtacttggcagctggtttggaaacagcattgaagaactgaggaatttgcacaattaacagctatacatagatactggttctaggatgaaaatgtttaacggtgtgccaccaactctgttccgtgtaatagactgattaaaatcttatttacatttcttccaagttcttacaaatcctatatttctccttaattttcatttggtgggttattagatttggttgaagggaaagcgaatgctgtttaagtgtttaacaggctgttttctctactcagctgatgactgttatatttcacatttactctgaatttgaaaactagctttgcaatctcagcagaacttgttactctcatctgaatgtgccttgcctccaccttaaaacaaacctgaatcttaagactgatggttcagattttcataacaatgattaaaataggattctgggtggagcacagtgcctcacgcctttaatcctggcactttgggaggccgaggggggcagactgcctgagctcaggaactagagaccagcctaggtaacatggttaaaccccatctctactaaaatacaaaagaaattagccgaatgtggcaatgtgcacctgtagtcccagctactcaggaggctgaggcaggagaattgcttgaacttgggaggcagaggttgcagtgagttgagatcgccactgcactccagcctgggcgacagagagagattccatctcttaaaaaaaaaaaaaggattctgcatgacaaattaattagcaatcatgtacctcccatgtgctaggcagagcccagtgttaggaaaggctaggcctcaggaaaggcatagtgtctgtcttcaaggtatggagtctgtctatgctagtcctcaggaaaggcatggtgtatctgtcttcaaaacactgaaactctgcatttcccaaaggaggatggctaaaggatgagattcacataatgacattgtgaatgcagtgtggtatcctgggtcggctcctgaaacagaaacaagacatgagtggaaaaactgtgaataaaaaatgtgaataaattctggggtttggttaatggtaatatgccattgttaatttcttagttttgacaaatgtaccattgttgtgtaagaggttaatatttggcaaaattgggtgaagggcatatgggagcttacattagattcataacttttagatttgtaacttttctataaacctaaacttccaaaataaaatgtttatttttaaataaaagcactaggattctagtaaagacttactggaaagctcctgggttatttatgggaaataattattttcaggaaagcaccccattcttgccctccctccctgcagccttagaggatgtgtgaagaattaactggtcactgggagaatgaagttatcttttgtggataagggctgtgcaaaatgaacatagccttgtgaagtgggaattagggccacatctggagaattggtacctgctcaccactttataattgtgtggcttcgggtcagttaatgtatctgagcctcaggttttttaatctgtacaatgaacgtattgttttgcttatgcagacaatgggactactctaatagcgaatttaaaataatgttgtaaaagtgctgtaatcactgtgctctaaaaatgtaagaaaggtacttaaaccttccagccatggccaacatgactaatgacagctgagtggtacttctaggtacttcccagacttgagccttcaacaacctgaactccattgctttattgaagatggagagacaaagctttcctatgaaaaaaatggccaaatgtgtgttttatcctcctctggtggatagtccaagcattgcagcctcttattggacttgagcattatctgcaagagcagttccagacagctcttatgtattgcagtcgctctgctccctgcattccaccttcagggcagctccatccgtttttctttcttatggtgcctcaaatggccttacaacaacagcgtactattaaatgtatcattttttgagaatgcgctaatgcttttccccttatacctctagggtttactttgtcattctgtccttttatggtttatttcaacatacttagcataaagcctagagtggtgggatgcaatatcttaccttagctgaattgtggcctggatcatcagtgtccttcgcaaagaagtatagctgtagattctccctggaggaaaaacccatttaatatttagtttcatctcctttcattttgttcttggtgtaccagaaaagcagcaatgctggctcaggaaagagggacttttcagcaattcatttacctccctagttttgaccttcctcagctggatgtaggaaaaaaagatgttctcatcctgacttcacccacaccacaaatgtacatttagtacctcatcctccggaccagatgttaggcactttaggttcaaagggttgctgcccacaagagttactaactgggaagactgaggcaatgcattaaaaaagctcacactctgcctcatgtaatcaatgccatctggtggtatttccgcttgttggtaataggtagtgataacaacaagaatgataacaacgacaaacattaagtcagctctgtgaaccagcctctaaccaggtgcattatatacgatatctcttttgatatgtccaacaatactagaaggtaatactctttaagatatttttgcaaatgaggacactggggcttgatgaagttaaataacttacccagatataaccattgtaagcagaggagtaaatattttgattacataaatatatcgctgagttctgtcattcagtcttttctcatgacttttcctcatttgtgtcacacatcactcatcagtcttggcatatcatttttcctctggagattctgaaattggcctcgcattgcttcttagccctgactctaagcagccatgatttcttgattagggttggcatagaagataaatcctattttccattcagcgaataaatgtttgttgaaagaaaaaaggcaaaaaattcctggctgaggtgtttaaggaaaagcttaacagaaggagtagaaatttgtctcagccttggaagaaaggtgtagggcctggtaagcaaagtttattatgatagtagcttgattattgagtgcttactttctgtcagcttttgactatagccactgtcaatccatttaaagccacagcatttctagatgatatgtcctattagtatgcccactttacagaagagaaacagaagcacagagagttaagtagcttgtgcaaaatcacatagtctgttcaaggcaaagccaggacccagagcctgcagtcttttttttttttttttttttttttgagacggagtttcgctcttgttgccctggctggagtgcaacggaacaatcttggctcactgcaacaacctctttctcccaggttctagtgattcttctgcctcagcctcctgagtagctgggactaggcgcccaccaccacacctggctaattttgtatttttagtagagatggggtttctccatgttagtcaggctggttttgaactcccgacctcaggtgatccgcccgcctcggcctcccaaagtgctgggattacaggtgtaagccactgcgccccacctgagcctgtagtcttaatacaccatactattttaagagagcagagatgtctgtttactgatgtattctaagggtctggaacatagtaggtgctttatatatagcgaatgaataaaaataccctctttctttggtaaaataaaagaggaaaggcattctagatggggaaaatagcaaaagcaatgatgaagagataccaatgatttgttagtgataaatggatttttatacagcaagaattgaacatacatttggcaaggcggattggagccagcctaaagagtttagactttttgtttagctctcattatcagaaatcgtcacttcctacctgtccaggtttgcataaaccatggatgctctgttttatggtcccatataatgaagattatgtgtaattacttcatagtggattgcactctagcaaaattaactgtccatatttcttctcatgagccctttgcgttaataaatgatgcatttgaggaggcaaaaatggttgggattttctgtgggggaattcctcatgaggagataggaggaatcatggaaaatacctggttctaacaagatcttgattattgacatctgtttctttggcttttcaaggtagtaattaccaaacagagtagtatagatcaccgtaatgacatatttggaattttctgagcaactcatgtttcatgtaaattgaggtatttcgatgtgtttcatcatattagcaccatagaatgccatatctagaactggggaaaggaaattattcataaaaaacaatcttcatggagaattcagctagagaaaaagacggaaatgaatcaaaattccccgcaatcgctcttttccacccaccattcacaatatgtgtttcttcttgagacctcaatatcctgaaagaaaatcctctgtctcagaaagtggaattaatccaggtaatattttgactggattttgactggtaatatcagctgttgctgataaagtcaagattaatgattccttggctaccagtgggctgagagtgtgaaagtcaaaacctgttagaaaccaggggaattgcccatgaaataagatggctttgtgaatgcgtaggtgactctgatttccagaggggattttgcagtaaatcaatccttctaagatatttagcttgtttaactcaatgacattttcattcataatgcttttatttctcatctcaagcaggagagacagtatcagttctgcacaaaactgagcttgaacttttacttgattgtattttcccatctataaactcttatcagggtgctaaaactgggaataaaacctagcagtttgaaaaaatataatcattttattaatgaaagagtctgtggcttgtggtagagtacacattggggcctcatttgaagaattaacaaggattaaggaagagctgcttttcatgagtgcttctctcaggaatatctgtacgtaaacatattagaaatgagtgctggtgagcactttttggacagcatttgatgtaagccctgggagaaagatgaaaaataacaacctgatggtatttagagtttattcatacatttttgtgtatattgtctcattgtaattctcataatagtttgtatcaagcagggtgttattatcatcattttacagatagggaaattgaggctcagatggattcatttactcaccttgggtcctgcagaggaaaagtgaaagcaagtgtttaaacgttgacactcagatctcttactccaaagaccattctctttattattaaactattgattagcagtgattcacaaaggtctgttttgtctcctacaaatgtgtcattgtgtatgcatgactgaacctgtcttcttaggaaatcacgatgtatcggtggttcctgatttcttttttagcacataacatacctttctgaccctgccacctaatgcaaagtgtactactattcactcattctgttcttgcattttgtagattccaaaagcattcattttcacacctactatgggagacggagttaggtaagggaacggacgagcgtagacttgaatagcagctctttttcttaccagcggggactttgcctctcagaaagctacgcaatctctttgagtctcagtttcctcactcataatatgaaactgagagtagtactgactgtatatttttgtaagaataatgtctgtcatcccctagcccattggaggtgtcaacacatgggggtgagttaaaaagagaagggtaagacagtctccatcatgaatacatacttagtccaaagggcgggggaagaagcaaaagtattgcaatcagtgctgtttcctcagttgaataattaatgtaataatactgtttacccaaaaaggataaaatgggataatgcatggagaacacttagaatcatgcctggcacatagtaagtgctcaataatttttagctctaatcatagtaattagtaagtgctccatcagaggcttgcactggtactatggttgctctgaggcaaaagcttcaatcattgggctaagtcagagaaggcatcacaaaaacagtgccatttgaatttagtcttgaggcatgtggaggagccttccatgctgtccagagttcttcaccctgatggctgatttcataaataagcttaagtgcaatgtgtaggaaaattggagtgaaagttggcaatggcgggagtgctggtatgtgttggagtaagggtggcagggactacaatgtcactgccaacaaatggcaaattttatggaaattaaaatatcctgcaaagtgcggattcaaggcaatgctgtcccctttgctacaggtccactgcattaatcacatcctttattacaagtgtcaacacatgattgggagcaaaattctttgaggcttaactgtaaaggaagaaagggataatggcacaaatgctgacctccattcaaatcttgccttaccactaactagctgcgtgatcttggagtaattgcattgcctttctgaggtttcattccccagatcttcaaaggaagtgacaattatataccttgaaatgttgttgtaagcatttgagataataggcatacagtgtgtggtgttttggtagattctcagaaaaataaaaatactatatataattataaatatgattctaatttattttataaattataatatatttacaattatagctaaataccaagcactgtgttaagagctttataggaactatctcctgtaatgatgacatgattaataatgacacatgatggtgatatgattgacagaaagatatcagcaggcccagatggaggatatagagttcttttaatgacaaggatgcagaaacatacggagattgtatagtacctagttttaaagcagcatgcacctagagagaggtgcagctttctgggtctcccagtgtttccctgggacacacagctggggataataccacctacctggagtaaggattctattgggtgcaagaagctccctttgctgtcacaagggtgatttaatcccttggcatttcttccttcacatctgactgttctgggaatctgttgcaacttagagttgcaaggaatgaatgcgaagacaccctaggacatttctgatagttgactgtgacactaggtgatgagcatgtcagttcctcaggatcattccttgggagaactggctttaggtctgtctaatgttccccactacagagcactcagtaacttacccaagatcacacagccagtacatggaaacattaggatctaaacatgatctaagtgttcctaatgaccatgccatatccagttaagaattgaattgtgcatacaatttacaaactagttaagagtagagggaggaaagccaaacatcaacttccaaagcaacagaagttagatattctataataaagttatcggttgcatgttgccggcagaagtaatgaccaaaggagttagagaagacagatgaccaagggctggaatagctgttgaggaggaagtacattcctggcatgcaaatgattcattgcaggagggcttaccacatctgatataccacgaggcttccttgctttccagctgaaatacaaccacaacttcaccctcactttcctttcccgttaagctgcccacctatcacactccaaaacaacatgtgggaaacataccttaaacagcttttaaacttttcttaattctccccccaccacctcttctggctccatagagaataacaattgctaagcttaaaacatgttacaaaaatgttaagaattcttttctcacgttgccaaagtgactactggcttagaagaaagttggaaataagtggtgaaaagcagcttagcagaggggaaatgcgtggtcatttcctgaatgtaaaaaacacctagggttgggataatgtgaaaaagagacagtgattagatcaggcttccaagagttttcgagaggagtgcaccattagaccttgctcagcgagccaccgtccaaggctccctgatcagtctatttggctaagagacaaatgtgccaacctccccagcctcactcaaggactgaggaatcaatatctgggggcatacttgcaaacaattcataaatcttatgtaaagggatttagacaagatttgctttgctagtgaagggagtgggtagaagaattatttaacctgcagctgggcaggttaactagagagaggaagctaaatgtatgctatggtcacctctgtagaggaagagagcacagaaaattttaccttttcctggattaccttcccttcttgtttgcctggtgtcctttttttgttttgtttgtttgaaatggagtttcactcttgttgcccaggctggagtgcaatggcgcaatcttggctcactgcaacctccacctcctgggttcaagaaattctcctgtgtcagcctcctgagtagctaggattataggtatgcaccactacacccggctaatgttctatttttagtagacatggggtttctccatgttggtcaggctggtctcgaactcttgagctcaggtgatccgcctgcctcggcctcccaaagtgctgggattacaggcatgagccaccgagcccagctgcctggtgtacttttaattattcttgaagatccaaataattgcttctcttggaagctacctttcacaggcagacttcatagcttccatatttgttcttgaatgaactccataggttacaaggatttcctcacaagtctgtttctcctgctagagtcactgagattgtgatactaaacagtgacttactcatctttgtattgctactctctagtagagtgagtttactggttaaagcattttcattaaatgtttgttaagtgaataaatgttgatatatatatatatacacacacacacacatacatatatacatatatatctttatatattctcaccttcccccatccattatttctttggctaaggccacctggattttctctgttttcatctccatatctatagactgcatagacctctcacacaaatttgcattgctagttgaggtgttctttgagcttctcagtggttatgacaaaaaggactttagcagtttgtgactgtgccctggaatccttcagcagactgaaataccttcagctgaaggagatggtgtttatgcagaagcccagcacctagcccatcaagcagtctgaggtttcagttggtgccagagataactccagtgagagaactcggtctaggtttttagaagttcttccccagctaaagatgacatcttaatatataaaggtttaataatcatggatggtcctttgtagacatctattgctgtggaaactctagttctctttaccttgagtagcttcttaaaaagaaaaataaagagaagaactagcagtgggaagggagaaggggtatcaggttgtataagcaaagtgatttctctggcttatgcttctataaatttgtttataaccacaaacctctggtaacagggcatttgcagaaggaaaatatttatagaagtctaccttgccaattacattgcaaaaaataaattgcctttagagtccttaaaaaaattcaaatatgttttccctctccactgccacccccacatcaataatttgcagctcgaggtctatgtctaaaggataagagtttccacaagttgattgtggatatctgaaatcaaatttaattacatgtgatggatcaacttcttgaactcccatatttctttcattgtcttcttcggattccatgcctcacctttgtggaaactgaactatagagaaatgataacatgactcagagccagccctgcaatcaagggggagtcatctaacccaaattggtgagttcaggtcagcagcatatagtgtcttggaaagagcatgggctttgcggtcagatagacctccttgaatttgaaacccagactgttattaattatattgggcagaattcttaaactctcactctcctcatcttttaaaatgaggtttgaaattcatcatggagctagcatgatgatttactagggaacatttctctgggtatcaaggtcctcaacactcagattgcacttgctctccaacagaatttcccagtaattccctatgctagttttcttttgctgcataacaaattactagggacttagctgcttaaaacaacacacattgattacctcaccatttctgtaggtcctaggtccaggcatgaattagttgggttctttgctttaaaactgcacaaagatgcaatcaagcacagggttgtgatctcatctgaggcttgggatcttgttccaagctcacacggttagcaggatttaattccctgaagttgtaagactgaggccctcagcttgtagaagctgctcagttccctgacatgtggcctttccataggtgtttcataatatagcagcttcttcaaagttagtggtaaaggcagtaaagaaatacatttacatttatatttactaatgtaatcacaggaataacatcctatcacctttgccccattgtattggttaaaagcaagtcacaggattcccacccatcctcaagggaggggaatcacatgaaagtgtgaatatcaagaggtgaagaggaccgtgtcaccctagggtctatctaccacactgtcaacgtgcaatacccctggcatgtgtcgcagagcgccctcttgtctgtgtgggttactaattgttacagtgaaattagattcctctttccaaagaagtcagagttgtgaaatgcttgggaaactatgagctgtttccccatcccttactggtgtagacaaaaataactgatacagggcttttatttcctgtgggttcacacttagtctcggaatgctttaaaagacaacacactagacagaagctaacatttggtcagtgtcagaaagtgttataacacctattcaccattcttgaactatattatatcccagtgggctagaagtatgggtttgtctagcaccattttaagcttagtagagagaactcatctcagccttgtccctgggtcccttgaagtacaagtgtccttagtaaggacaatgacaattcatgtggaattaattagtagaaattcccacatataaaatttgtccttcactctatttcttaacaggaaaaatcaaatcaaatacattaacaccaattagatgacaacataatcgaaaacaaatgtgtttaccaaaaaaaaaaaaaaaaaagtacagataggtaactagggaaattgttaacccaacaaagagagactacatgagtctgagtcccttgggaaggataaacatgtttgtaaataaatttatttctctgtcaatatttacttttctttgtgttcctctccatgtgctgagaatttccttctcaggccttcatgattctatgagtgaattactagaaatgctgttagtctcattatttttgtaaaagaacaccttgtgcctgttcttgggctcaatttaagttagagaaaaacaaaattcatgcacatgagagagttcttataagatggaagagacatactattgatctaagacttatttgttttaataggggtccttagtcatgaattatcagtaaaaagcattttatagtaagtgcaattttggcaagaccttgtttctctagttgcataaggaatcactacatgataagaaacaagaaaagtttactggcagaaatagagaaaagatatgtacatctattttatctacctaaacataagtagataaaaatatgtgtaaatagttccttatgtcaggaaactgtgtctgaatatctttctatccttaaaggcccggcacagtgctaagtacatagtacacagtaagcatatagtaaatgtttccatatttcagggacagagtttggacgctaaaatgccaatatttgtttggctatagtgatttaatccaggaaaatagaaattagtttccatgctgtctctggaacttccacaccattctcccagcattttcatctattcaccaaactagaagctctccaaaccccatgttttaaggtttttaaggaggatccattacaaaggcatgattaattaaatcattgtccactggtaattgactcaatctcctccatcttcatctccatctctggaagtctgggggtagggtttaaagttccaaccctctaatcacatggttggtttctttggcagtcagtccccatcctgaagctatctagggtccattaagagttaccttattaggataaactcagattatggttcaaaagggctacttatgaataacaaaagacactctcctccctgtcactcaggaaatttcaaaggattttgaagctcttgtgatagaaaccagggacaaagaccaaatatgtatttcttattatatcacaatatcacaggctgtcgctgtatccaaatttcccccttcctgtaaggaaattaaaataaggccaaccctcatccagtatgaccttgtcgtaacttgattatacctgcaaacatcctatttccaagtaaggtcacatttataggtactgggggctaggacttacacatgtctttttgaaagacacaattcaacccacaacagtaactaattgacttcctttctcctgagctaccctgtgattgaggcagagcaattttctctaaggacatagcactgcaaagatagagcctataatcaaacatcctagttgctctttaggagctcaacctaggtctagcctgctcaatttagtatagttcacttctacgaataatactgaacccaaagcaagactctgacgaggatcgagaaagcagtgacacacctaaccatgctgtaaggcagaatagaagagatataacagagatcaagtgtgtaatctagaaaagggacatattgattatgctgaggaggtaggcatgggaggcagtagccatttgagaggcagaagcagcaggagcaaatgcatagagacaagaaacttccatctattgagtgactggttccacttggctgaagtataaggtaagtttggagggacagggatgccagggtgtggaaacacaggtttttgcttatgagtcttcaatgtctgagaaaaaaaaaaaaggccgcatgggatgttcttgtctatttttgctgttaggtgataaataggcagatatatctaggtatgtgtgtgcgtgttgccaagggatctgtatttatacagatttagtgacaacatttattaacacaacggggtgataggctttggcatcaggatgttgtaatagttgtaatttggcttgtatcaacatccctatttttgcagatgagtaaactgtggctttgaacaataaggacctcacccagggtcgcccagcgctggtaaatgttgggtttaggaactgaacccaggtctagctggttccagagcacacattggtgctttccgtggcgtggcctgtaggtgacttctgagggaattcagctccttggtgctgagggcttagccatgattcctttcagagtgagttctccatgtcttctttggccaggttcctgtgctcagggggattttcaaagataatggtgtccactggagggaaatatatcttggagcaaagatgtgcaaggatggttccagattctccattcctatttatgaaaactggcagatttgctgactgtgaacatagtggccaaagggctgaatagatatgagcatttgagagtaaaatgtgttttgggaagctttaaattcttatttttgaaataagataataaatgtccaaatcaaatgggaaattagtgaccaggttaaaaaataaactgaggttttccaactccaagttcagtgtattttctattttgttaaaaaagtaaaagtaaattgcaaagaagatacttggagaggaggaacaaagtaagtaaggcaaggacatgatggatacagggggattaactggggagggaatgtctgtaaagtgtataaattttggggttggggggggtacagctaaaaggagctgtcctaaatcctggcaaaggccctccactttaataagcgttgtaactttctctttcattgttggaggtaacacgtatgaaaggaaagcagcaatcagaacaatgcagtttcccagagggctctttagcagaagtctcctgtggttccatgctgttgttaatgctccccttattttagtctcctggactccctaaatgctttggaccacttgagcaaggccacgttgctaattgtgcagaaccccttcagaggtggcaccgctgagcaagaccaggcaactcaggctctaatgggccttgattgtggtctctggagcaaaaaccacctcttgaaagctgctgtgagacagctattgggaggtttggtaggaagatttagtgctgctctttgaaggatcgatgtctaagctcttcaaaacctcctgacacctcagatggattctaggtggttccccagtgggcacaatctcattatcatccacatacatttatttatctcctaataggggcccatcactgtattatgagggccgcaaagcctagctatggggctaaaacaagcacacatgaagcaatgaatgagtattaactgctgagatgtatatttctgatggcctcttcaaggtgcagagaaagaagatctcctccaagagaattaaatggtcagaattggggaggtaaaaattagaatctgaagaaactaaacatgctttagagagacaggtggttggcatcagaatgaattcctggcaatagggagcaacctgcagacagggaataagaatgtacacagaatggcctgagtagaatagaaaatgtgtgtctcttttgattataacaaggaagaagtcaagtttgtttttagtttgtctgtaacacccactcattcttaccaatttgccttatttgcaaagagacagctgtgcccaggcctttagaaaggaacagtatctaccgtaatttattggtattttattttcattctacagattgagtattccttatctaaaatgcctgggaccagaagtgtttcagattttggatttttttgggtctggggatatttacatgtacataataaaatatcttggagatgggacccaagtctaaacatgaaattcattatgtgtcatatataccttatatacatagctggaaggtaattttatacaatattttaattaattctgaatacctgtcacatgaggtcaggtatgaaattttccacttgtggcatcatgtcagtgctcaaaaagttttgaattttgtagcactttggacttcagagtttcaaattaaggatgctcaacctgtatttatttttacggttaacttctataggcaagtgacactggtttcaatgaaaatgtatgtaaatgaaaagaagtgaagcaatttaaggaaaaagacgaaataataattcaggtagtatatagatggggcaaaaatatgtgatattgacgcaccattgaccaaagtttgggaaaaagaggagtcatagtaaaatgttgatccttgtgttgaagtttctgatcctccttgcactactcaccatagatactccagaaaagtggaagaatgagtcaataaataaatcattcatgacttttccaaaggaaataatccaactatctgctaataagtgtcaaaactagggtaatgacaatgataaaaaggaatcaatccaggtgacacttgagagtaagaaataacaaataacagatcagagttaggtcaatgtttcttaaactttaatatgcacacaaatcatctggggattttattaaaatgcagattctgattcactaggtctggggtggggcctgggattctgcatttctagcaagctcccagggaattccagtgctgctagtcagtgaaccacatgttgagttgtaaaagttctgggtggtatcagagaggggcagaatcacagtgaactgtaaagttttgtgctactttaaaattttgttgaaaatgcaattttaaataagaaattaaaaacaaacttctacccctaaacattctaactcggaggaagttcttttccctgtaaactttagtaatgtccttcaattctataatctcttgttttatttctgtaattcatttttagttacgttttgttcttgattctcataagcataaagtcccgattggctcataataaactctgagtagacgaggcctgtgaaatactctaaaatcatgatttcattaacacgggttgtttgcacttgaggatgaagttgcccaatgttacactgtaatgggcaaaactgctttgcaaactcaagttctctaattctggatgcttttgtgtgatgacttattgctattcccatgtctctataccaatgacaaaacctttcaaccctctgagtttttcccctagctcctgggactatgggtgggagagtctgagggtcatctattgatattgaatgtggcaggagtgagattcctactcctccccttcccttgcccttcttttccaagggcataagaaggaaagcatggagtgtcagccaggctgcatggagctgcctaccagccagaacctgctaattcttattttatggaagtacctgtcatgtttggccaaatctcctacagaaggataaaggaaccaacacagaattcagctcccacactcccctgcagttataaaacttacttagctttatttaatttttaattttttttttaagtttagaagcttcagttgagaactgcaaattaagttgcgttcaatagtcttttccagctcatatgctgctgctaggttgcaattattgctcgacacccttcctcagtgttttgacatcttcgccagcctgagaaactaaaacacaattatttattaattttaggtgagttttcttcaattttaataattcctatactttatttacttatttgtttgtttgtttgtttctttattttgagatggagtctcactctgtcaccaggttggagtgcagtggcgcgatcttggctcactgcaacctccgcctcccgggttcaagcgattctcctgcctcagcctcccgagtagctgggattacaggcgcccgccaccacacccaactaatttttgtatttttagtagagacggagtttcaccacgttggccaagatggtctccatctctggacctcgtgatcaaccctcctcggcctcccaaagtgctgggattacaggcatgagccaccgcgcccggccacttattttcttatttgcatgctttatacctgctattacttagttcctgtgatgtttcccagaaatatggaattagctgtgccagacactatggccagaagactcaacagtcacatagcgttatgatggttaaatgctaggattgaatgttaaataaattttaaagtaaattttaagtggctgcataataatttattgtgtattcactaataataaatcctaagaatctaatatcccaagataaatgagcccaagaatttattcagactatattctgtaatattctgtgtgaacaaagggaataattggatagtttgaggggtaccatgatttcttacatgttgtacaacttaaatattctaagtgtatcttagatcacatgctacaaatttctattatcactattaatagctatcagatattgaactctattaagcatcatgtactttagtcaatatttgaaaccactcattgaggtggatactattatctccactttttaggtgaggaacctaagagtcaaaaacagaggttaagagcaggtgtggtgccttgcccctataatcccagcacttttagaggctgaggcaggcagatcgcttgaggccaggagttcaagaccagcttgggcaacatagtgagacccttgtctctacaaaaaataaaaatacaaaattagctgagtgtggtagtgcacacctgtagtcccacctacttgggaggctgagacagaaggattgcttgagccaagggtttgaggctacagggagctatgatcatgccactacacgctagcctgggtgacagagtgaaaccctgtctctaaaaaaaaagaataaaaaatagaggttaaataactcatgggtaatgagtggccaagcttagattttaactttttaattctaccatccatgttctcaaccattacactacacccatttaatattatcagtagatttatctgtatctatcctgaaggtatttattttcaacctatatacttcctgcataatgtgatttataatcaatatttttattccacccctaatgggtataatgcactatgctcagttctgttgagaaatgcacagaagtaaaagccatggtgcttgtttaagagctttttacaatcttgttaggggtgtggtgtgtacatatatacaaagtttagtttagtagaaggcctcagcatctatacaagttagtaggataaaagctatcccatactcagaaaaaaatttcaaattagtatcatggttaagagcaacttgtctaacctgtggcccatagggcacatgtggcccaggatggctttgaatgtggcccaacacaaattcataaactccttaaaacatcgaggtttttgtattgttttgttttttgcccatcaactatcattactgttagtatattttatgtgtggcctaagataattcttcttccgatgtgacccagggaagccaaaagattggacacccctggaattttacaggaatgaggtgccattgtgagatagggtggcctgacatattctgctaggtcaataagtatctctgatgtggaaaataactaattgtgggttatatcataaactattctctttttaatttgaagacatgttcctttctttaggtatttctcaatttgttaaacaaggccatgtttgatatctgtattttaaaatactctactccccttttatccaagatttcactttcctcagtttcagttatctgaggtaattcctgtatgaaactattaaatggaacattccagaaataaacaacttataagttttaaattgcatctccttctgagtagcaggatgaaatcttgtgccatcctactctgtcctacccagggtatgaattactttttgtccagctggccagttattagattgtgttaacctttggggattcaccaagaaccaatgttatatatgatccaagagtccacttcagtcacacactcacacccagaatgccagaacttgcaagccactgtgtaaaatatagtctggaaattattttatggaacatagttatatggcattatatgaacagttcttcaagcatgtatacatataatgatagctatattattaaactgtgccaattgcctgccctaccctttccacattttaactctgattcctaaactgttagtaaattcagaattctgagtagtgttgtgcaatttcaaaggacctgccctttcatcatactgttctgtctctgattaaataccttctttgtgtagatccttatataacatagagacagatataatccttctaaatggtctcgtaattttgtataaacccgagcagataatagtattgggggatataggatttagagaaatttattctgataactatgagaagaaatttataggtcagtgtggcattatattaatcctttttcatcttatcacacatttggctcagaatataaaatgtgtacagacatgagatctgtacattaggtagttatttatttttctttgaataattcctttctaaaacaaaatgttggtcagcagaggtggtaaaaatgctagattgttggtcttgtttgctaggattcatgacctgtttcataaaggactttgctaggatttgtgacatgctccatgaaggacttaacttgatcagacacattaaacttcggaactgaaagaaatatctgagcttgttcaacccagaggttctcaaacttcagtgtacatcagagaccaactggagagtgtattataatatagtttgctgggtcccatcctaagagtttctgattcagtaggttggggtagggaataagaatgcatttttagcatgttgtcagatgatgctgatgttgctggtctcagagccctactttgaaaaccactggtctattgtaaggctttctttttacctatgagaaaactgaggacatgagggaggccattcatgtacatatattattcaaatcctgttcctttccatccaaaagccctcatgtggtatcctgttgaagtttgaataaaatcccaaatccttattatctagaagatcttgcatgcctgttctctgcccatccttccatatcagagtctccatagagccttacttactttcactgcagttattcaatggacacattcttatttcagcatgaaaaacaactaatatgggcacatggcacagaacaaaagtgaaggtttgacttacagagaatttcaattccatttttcaattcctgccattttcttgggggctccaaatacagctaatataagtcgcatgctgagtgacttgtcagtctatattcccatgtggtgggtccatcttgattcctctgttttatctatcagagagtttgatcctcattataataatagctattcataacatgtattcatcagccatgtactagctactgtgtcaaacagtactgagatttagatgctgacttctgaggctagactctttattcttagaaaataaacaacactgcccctctattatatactgaaataatagtgatgtttgtctaaacaaccctagctggtcaaacaatggcaaccccttcccctggctgctgttttactcaccatttaacaaaaaattaggtggtgcctttggaggaagagaagggagatttaggcggaaggatttttttttaaaaatttatttttgagacagagtctcgttctgtcacccaggctggagtgcagtggcaccatctcagctcactgcaacctttgcttcctgggttcaagtgatcctctcaccttagcatcccaagtaactggaactataggtgcatgccaccactccggactaatttttgtagttttagtagagacagggttttgccatgttgtacaggctgatctcaaacccctagcctcaagtgatccgcccacctcagcctcccaaagtgctgggattacaggcatgagccaccacacccagctgaggttgaagggattcttacaaagacatgtgaagagaataaattgaaaataaatatgattacattaaaactaagctcagtactttaagatgtcatgttctctgacttgataactgaagaatttgtgtgagtcatgagaagaaggtaatttgttgtactttatattttcagctatccttgagaatggtttctgcttcttacattctcaatgatagacaagtctgacacatggagtttactttaaacggttaggcaatcccatgggttgtggcccatagggtgataacaatagaatttccttttgtctgaccttaaaaaaggatatcagataaatactgcttccttggtgcagttaattttaggccaaaatacaattattggtcagatgcacaaattatctctttatttcttaaggattagaaaaaattttgaggaatcctactttcttcctaaagcagatctgaaatagaaataattttatacaagctaatttttccagggtttttgtttgtttcttcttaaaaaactattttaccagaaaatatgaatacgttctgaaactttaccataaaaaattctcatttcttcccttcttttccttttcttttctcttttcttttctttctttctttctttctttctttctttctttctttctttctttctttctctctctctttctttctttccttctttctctttctttctttctttctttctttctttctttctttctttctttctttctttctttctttcttttccttctttcttttttctacctcttcttattttctctcattcaagcattaatgacctatcaattctacagatagttaattcacacttacaatgtgcctgtcatatttattttaaatattgaaactcactagaaccaaagtccaaatatggatgctctgtcgtggtgagtccacttgttacaaggaccctggaaaatgaaatcaacttggatagaaaccaacatagacccaattttatatcattaaaccatcttctattctaaagaacaactgtatgtgtattacatataggcttctaatagaatttctgatggacatatcagcaaatttaattcggtattttaaaaaatacatcctaaacaaaaacagatttttctcaggagtgtgagaatgatacagcatcagataataaatttaatataaataatgatattaaagataaaggaacagaagcaaaatcatttcaaaaatgtagaaacatttaatatagtcagcatatttattaaaagtaatctgaacaagcttagattggagtaggacatttttacctcaaaaacaagaagctaccaagaaactacagcaaacatatatttacattagtaacaaagcaagaatgaatactatcattgtttctattgattattgaagtgaaaaaactagccaatggagtaagacaaaacaaaaaacaaaaaaacagaagcaaaaagattggagaggaatctacagtacttttatttgcagaaagtccataagggtttattggcagactattagaattaaaaataatttccacaagtttgttgggtacaaggtaaacatataaatctaattatcctctccctacaattataattaccaattaaaatgtagaactgaaaaaaaattcatatacaatagtgacaaaaatgtaaggaagctaagaataatcgaataaaagattcaagaccattaggggaaaaatgacaaaatattattgaagattataaagtcctgaataagtcatcaacattgaccatatttatgtatgggtagactcaataacatgaagatgccaattttttctaaattcttctataaatccacacatttccactcaaaactccaacagaactgttcatggaatttgacaagctaactctaaaactcatgtatgatcacggggccaaaaatagccaagacaactcttgggggtggggaaaaacccaagagaaaagacttgcccaactagacatcaaggcatgttttatccccaaattaattaagacagtgggacatcgacacaaaataggcacaccagcctgtgggacacaatagagctcagtaactgttccttacagtatggaaaattgatccttgaccaggtagacattgaaaatcattagttaataaacaaactagtcaacctatgatgctggaataatttcttatctatatgggaaaaaatgaaattagacttcattttatatcacccatgaaaataaattaaggatatataaaaatttaaatgtaaaatgcgaaactttaaaatttttataagaaaataatggtgattagctttacgacctatgtatgggaaagatttcttaaaagaagggaaaaaagcatagatcattaaaaaaatattgatatatttgattacaattatttttaaaacttatgttccagaaagatatgataaattaaaagacgagctacagacttggagaaaacattggcaatgcacccagcacacaaaggattggtattctaaattgtataatgaccccctacatgtgatcaagagaaagaaaaataacccaatgaaaaatgagcaaaggatatgaataagcaaatgacagatgccaaaaccaaaatggatagttaacatataacacataaaagcatgtatagccacactagaaccttgagaatacaaattcaaaaagcattgagatattacttcaaaccaccagagtagcaaaaatgtaccattctgacagtattaagtgttggcagggaggagaactaagagctctcatatcttaaagagtgggaatgtgaattgaggcagccactttgaaatacaatttagcattgaagctacacatgacatttggcctcacaattgcatatttatgtaaacacttaagggaaactctcaggcaatttacattgagctagttattagaatgtacactgcttgttatgtgaaaaaaaatctaaatcagaagagtgcatcaataaattgtggtatctctatataatataataacatccaatactggagcagaacaaatgagagctacatgcaacattagtgaacctcacagtcatactcttgagtgaaaaaagcaaattactgaatatgcaaactgatactatttagataaagcttgtaaacatttaaaataatccaaaatatttcatgtgtagtttcatatatattaataatataaaaacatgcatggacatgacgaatgtcccttttagaaagaagaaagtgggactgttacaagaatattgacctatgcctgtaatattttatttcttcaaaaagaatctgaaacaaatataccagaatgttaggaattaataaaaaccaggttacaggtatgtagatatttattatattattatttctacttgttcgaatgtttgaagtacttcaaaattaaataaagaaccagcctcactgagatgtgtgtgctgagtgctctactaggtttattcacaaagttcttacactccctgctctcaatgggactgatgaaaatgtatgactcaaccaaattatatatgaccgcatagcatgacattcagcctcattgagaaaatgtcaaaattgtgaatgttaaattctaaaatatcaaggctcaactgtagacatacaaaaccaactagggacataaagaataaaaatgaaaacaaaataaaagctgtttaataatagaattcagaacaatatataatctcttcttccctgctaaaatcaggccagagattggcatttgccttcctgaaggcaatagttagcaggaaaaaccacacaggttcatataatacaaaccaaaacaaaacaaccttctcacacgaagagaaaagaatactttgcaaaatggctgctgcatcttcccaaatacatatttcacctccccaaacagattttccatccttgaccttctcgttggaaacctctccttaagcagttacacacagctctgcaaatgttagagtgacatttggactgggcttgcgtactcagcttgcccgctcttctgggcttccccgggggtctgccaagctccagcacattggtattagccttgcaggcctcacctcccagagctagcaataacatttaccagctacagttttctccattttcaaatatttcctctggcccacatgccagtgatccagctcctccatagagtagaacctgaaaggagtggtttaaagaaaggagagccctcctgtaagaacttttaacatttacctttcattaaagattttacttgtggtttaatcgagctctcccactagaattctggtatgtttgggaaaaattaattactaaaatcttacatctctgggaggcggggtacatctttgatcattcttttgtcagtgaaaactctgaaaaacaacgcctctggttggaaaggaatcaaatctgagcttttgccgaaagctttttgcaatcccaagaaatctggattgaccaggaaattctaaatcataactgtagaaacagtttcacagccttgctatgcctaatatgtgacagggactgggtctaaggaccttcataaagtcaggtgcgttgtctctctcatttgttgtatccccagtgcctgaatgaatggatgaggaatgagttgaatagtctcccaaaagctaatgagtcatgagctaatattatccttatttcaccaatgagaaacctgagactcaactgagagatcaagtgacttgtccagtcacagagctaataagtggcaggcctcatatagaggctgagaacttcattgtgctggtgtaatctgtactagtagagatacatatgtgttcaaatgtcatgataagcactggcaaggagaggtaaacatgaataagaacacagttgagtttcaactcataaatgtaggaggaaacaggaaaagagaggatcaccagtagacaaacaccacattaataaatattgcaagcaagatcactgatggatgctaaaattagtggataaaagtttgaggagaataatatttgcataggctcaaagtattttctctaatacatgtatcaactacaaaggaaaatacaatcatttagaagtagagagacctggaacttggaagatcctgactttatcaaataagcaggaaattatcaccaggaacaaggcatgggaatatcatgaaccccttgatagaatgcactgaaaaggacacaatatcatttttatggtgttcttgccaaaaacatgtaacttctctccaatcctgaaaaaacactggacaaaaccaaaatgaggatctttgatacaatatctgactagttctctttaaaaagacatgaaagacaacaaaagactgaggaactattgtagactggaagggagcatggcaaaataatagctattgtgatgtaggatcctagaacagaaaggaagagaaaaacatattaatgggaaaatagtaaaatttgaataaggcctgaagtttaaaatattgaatcaatgtatatttgctatgattgataatcataccatggtaatgtaagaggttattagcattagggggagtaaggtgaggggtataagaaactcagtataatttttataacttttctataagtatgtaagtttgaaataaaaaagtttaaaacaattaaaaaatgagcagaaaatacatttgtccttccagtttgcttacagaattgagagagtcaaatatgtaaactaaactaaagtacacacaaaaaacagtcctgtaggcaccgccgataataaatgtatgtaccagatagaaggccatggaaaagggtggtcatcttacctgggaagagagcacaggtagcactcaggataggcttcatagagaagacgatgctcaaagatttcttatttatccaccatctgttttatagagcatctactatggaccaggcactcttctagaacatagctacatcatggtaaacaaaaaagaaaaggtatctgcattcttggagcttacagcctagaagaagtcagataacacatgagaaaaaaaaaaaaaaaaacaacaccaaacaaaattaattagatattttcggtgttgtcatgaaaaataaatgagctgatgtgatagaatatgctcagggagataggggaattggggaatacctttctgagaagatgatagttaagctatttgggctagggcctgaatgggaaagagccagccgtgcaaaatgaacaaggagcaggtaattccataccaaggaaacagggtggctgaatgcccaaatgcaagaacaaattagtatgtttgtgtttaaggaaacaaaagtaagccagcatgctgggctgtaatggacaaggaggcaatagtagatgatgagctgtaaagtaaggtcaccaggtggctctaagtccaaactggcacacttttgagtaaaaggtggtgctattaataattacaccaggacaacagaagtgaaatgagactgtctggccaaacctggacataagatcatcctttagcaaggaaagaaatcacgtaggacttggtgagccagccaaggagtatgaagttattcccagtgcattaggaagcatgggaagttataacaagggtaggaggtgattgttctggctgccatgtggagaacccactattgagagcaaagaatgaatgtaggggggatcattaggagatgatttcggaagtctagttagtagacagaggatgggggctttgactacaggagtagacttgggagaggagagaactggatgacagtagagtcaatgagccttgcgtgttctcagaagatagactgagaacattttagacaaaaggagcagcctgagcaaagtcacaggggcagggcacgttccaggagccaagagtgtattctatggccaaagtgaaaggaacagcaggggcaggccattggcctggagataagaccaggggctcagatcatatgcgatttagaattcaaggctaagtagtaagaactatggtgccattgaaagtgatatgattagattggttttagaaatatgagtctagtccaactataagagaaaaagataaaatgaacagaaaaatacagtgaaaacagagatagcttttgctagttagagaaataaacaagaagacattttgaggatggtacaataatgtgggagatatttttatttttactggaaattgtccacccattcatcagacacacacttgatcatctagtgttttgcaatataattagttgttgactcaaggactgctgaacagtgtcactgagtcataaagacggctccaagaggaaaactttgggcacaaattaatgctatgtaccctctactttctatcttctgctgcagcgctattcttggcccactcatttctaagttttagcaatatttctcaggctggtgtgcctcacatgcaattctggcaagctaaacatggtgacggagccagataacttgttccctgtagactcataaactcatcagctgtgggctggtaatataatttacaatatactttgccagccctataaaacagcttttttcttgcagagaaatggagccctgacaagaagtgtttatgacttaattttagctgtgttcttcgttgttgctgcagtagtagcctgcgtatgatgcatcctagtcatccgccaggcagttacaactttgttgttgttgtttttggcaagctaaggacaacattagactttgcttaatacctaccccacaatcctatttcaatggtggccatagcatgtacctccatgtttatgaataaatgaatcgagacacagttgttggatacctcacagccgtggcttataccttgatgaaactatatgataccatatccttctagataaagttcctgtaaaatgatattgttagaaggcttgagtggaaaaatctgaaatatgctgtttacagtcaaaatgattatcctcctgctgactagttgttctttattcttctccacagtgtactacaataactatttaccattcatatttcaggctaataaggttacttctattcagccattacataatgtgactgtagctaaaattaaagctccacaaggtaggaaatttgttttattcattgctagatcctcaaggtctggaacaatgcctggaacaatagtatgtactcagaaactacatgttgaataaataagctcaactattgacatattaaatctaccctaatgatttgggaactaatactacaaatagtgtagtcatcttccaagaagagcatattctcctgaggttggccagagggttgatgaattgatgtatcagccctgatacattatatagcatccaacagtcattccaataacatgctaagatctgcaaaactgtaactgcatatttgaattcaaatccagggacagttttttaacctaggtaactctagattctactgtacacaaagttagagttgtgagatttctctttattaattctcttttttctcttagccacatccactaaaaaaggtacttttatttcatgtcctgtatgagttgtatgtaacgtctggctctgtcaccattcctttgtgttctcattccatagctaactttccttaagaagtgttgtaatagcatatatttcagtgttcacaaaaaaacacaaaagcaatgttctgactaggtgactcaatagattttatgtgttttatatatacttatgtatatgtacacatatgtatttaatcatctgtttcacaacattgttgattttgtttttcctgattttggaagcaggattccaaataaggacagtaaaaagcaaactttttcatatctctgtaagaagggaaatcaaggctttaaaatattacctcagtttcctcaggtatgaaataaaaggtatgaatgcaggtaaatttcaactttctttctaactctaaatttctatgcaattcagagacagtaatatgacaacttctatggttctttttcgataaagtgacaagaaactgattttactttaatcagtttatcagacttcttaaattttctttgttggcttgacttttctaggaaattcatcctatatcttagacaacataattttggttcacgttgtatttgtgacccagtttgtccttgtaagttgtatgtatagaattgaggtttgttgaactggcacattgtgaaacaactgccaggaagaaagtatattttcttctgccaccctaaaggatttatctctctgatctggcctcagataatatggaagcacccacattctagtgagtacaactgtgtgtggagcagttcagttatctagcccttcaacatagtcatttggaaatcaaaagcgttaaccactagattagataagacaacaaaatcaagagttcagttgaccattaatcatttttccaaaatcagctcaatgacgttgtgtaataatatttagaataaagcaaaggtaataggtataaaaatccattcatttacagatctatacccacagtcaaacatccttcttgatggttcagagctaaagcctttattcaaattttactaaccagttattgtcaatgataatgagagagtaaatgtattctctggaatactgagaaaaagaatatggcagagtgaggcagcaagctttgagcaaaacaagcaagaatatctacagaacagtgctgttcaagatgaaaagcataactggaccatgatatcaggctcaatcactaaacatagcctgcccatgactgttatgagccattcttaccctcaaagaaatataaaagatttaactttggatttttgaatgcaatctctaccatgattgtgaaagtagatccattgtgtagggagtttgagaacagaagaaagcagaacgtcgcccttatttctctatttaatcaaagtagacttcataatgataaggaagactaacaaagaattgtaattaaccctttacaattatgttccactttacagtttgaattgcagagccctttcaaacatattttcttatgcagtttttaaatatggttcaagatttacgtaagggaaaagtaaggtcccacggttgcatgcccgtgagtagtggagctgggacctcctaacaccaaggctctttctactgaccagtgctacctgcaacatggaagtatcctctcatggaagcaatgggccacctctagacctcaaggaaattcaaacacatatgtacatgcatatatatacaacatgtactgagcatggtattatcaggcatggcttggatattttcacattcatacttcagtgttttcctttgtgctggatacattttccttgcaactctggatccatttccaatctttctccacccttcttcattcagttttgcaccttggaatgtgattctatgtggattgccctgacagctcccttgtcttctgtatttcagttgagtttgtcctgtgaaaaatactcatggaagatgaaaggaaaggatgagaatgagatctgggtatttaatttcctggctcttggaaaggcttgtctgttgacctcaaggtctccactcactttatctctttcccttcctctgcactctagcaattggccctcccctagacccattagggaaagtaaaagggtctgctcttaatagacctgaatactgcattacccctagagggcccactatctcttacctataccttttaaatcttacctttattaaactttcatcaaatggcacaattcaaatgggccatctgttttttaatggtttcctgactgattcggtattattattacacttgggaaactgagtcccaacaaggttttaccatgaaataacttgcagacctggaattccacccagatcttctaactccaagcttatatgcttacagagacagcacaccaagcaatgattctgaatgggaggctgacccatatgtgtaatcacagctctgcacaatagagctttcttgaattgactcagagcaattctcagaaacataccactgtcatttataatggtttattttgaaattttataacatgtttgcacaataaagcaatggcaaaagtatctggaagaaaattgaataagattacatctagtctttcactacaccacttggtcttccctgaatcaccggagttagtctaaaaagcaagtctgatcatgtcactttctatctaaaaatgctttctattgactaatatctaaacttcctaactgtgctttttagagtcatctatgtgttcccccatctcaaattttaccatttctttccatatgctctagttaaggggttctcaactgggggtgacttttccccctaaagggcatttggaaatgtctggagatgctttcggttgtcacgaccaaagggagtgccacagatatctagtgggtggaggccagggataccgctagatatcccacaatacacaggatagcctttgcaaccaagagttatctggtcagaatatcagcagtgtcgctcttgacaaactctaatatactccagccacaccaaattcctcctgaaccttgaattttctgcatggtattagattggtgcaaaagtaattgtggtttttgcaattaaaagcaatggcaaaaactgcaattacctttgcacccgcctaataactatcattcaccagattctgtgcttaataaatgatttcatttcatgcacttgtgaaagctgtgcttctacatatgctgtttcctcagccagagtgccttcccactcttctctttgctctttactcttatattcttgaaacatggtttacaggtctccttcttcttaattctcatctatacctttgtatagatgcctaagctgaattctcacattttctttattattcaagtataacagtttacctgtttgagtctacaacacccacttgctatattctgtactaatgacagagaacatgctatttgtgctttcccccaatttcagcacagtgtctgtcacatattagatattagtcattgaatgagagaacaaatattattgcaagcagttgatagagttctgaagaattgtgttatgtttaatttgtataaattaagtcatattttaaaattcagtggtaaaaattgctatttaagaaaagtctctataaactttttggtaaattgaaattctattagaaggtatacatttataaaccagagtttctctattccatttttttctcttttgaatattaaaaatatgaaagagtacatgcctgcttttcttaaagtgataaatatcaatccaaattgttgtcatccctttagagtgctctagattttggggaatgagaagccaatatgaccatatgtaatggcaggactccgttgagaatgtgaagttagttttcaaccttgtccacaagagggaggacatcaccccacatccattttgttgattccctggaaccgttgggtctgtttggagctggagatttatgttgctcctgctgttgcaaaatacagatttagaacctggcaggcattcttgcatagatttgcatgcagtttaagatcagcccagtttgggtggagggaaagcaatctgggcattttagaagctttgtcagaataaaacacacttaagcagtgtgtgatgccagttgctgcatgaatgagcaggagagtgtcttgaaggtacagaaagagaaaagggtgagggatgtgataatttggtggtaatttgcttacaaggttgaccaggagagtgtcttcttttcacaggagatggcttaagggctggtgggagtatagtgctaggaatgaacgtcagcttgatatgctaagagcaaaatgagagcagcaaagtccactttgtgaagttatggagctaattgctcataatactgtatcagtgccagtgggcctccagcattcactagcaatatcacatgaattgcatactctagtacttttgtttacttctttccttttactacctgccagtctggctttgtctttctagactctagaagatgtaaatggtatcacttccttgcaggtgtagccaagaagatcctggttatcattctcttcctacagtccattttccttatagtttttacttttctttttgattaggaccttatcacacctaaaacaacatatgcactggtaagattgaagactttgagctctaagttttagttattttctatctctttggatgttcagatatactaatttgattaaagaaaggaaagtgggaaaatggtagaaaggaagaacagctgcctgctaggggttttctctttcaagttaaacaaaaatgaacatgcaaaccaaataatcattatcccaaagtaagaaaaggggtacaacccaatgtcataagtctcaaaaattaggagcaagacagaattctgaagccaacccaggaggaatggtcaagcatgatgagcctgctagccccacctatgttcctaaagtacagtactatccacttggtaaaaatgctgagaattattactaatatccttatatatgaaaagaaacttagtacatattcttacctgttcccactgaaaactgaagagtagtggaaatggctataggagaaaaaaatatatgtaatagaaacagacaacgggactgagaatcaaaagaaaagtcaccaggagcacatggattcccctccattgccttgggatgttctctttaaccaggcagggtgacttctggaataggacacttaacaaagcttcaggaataagacacagtccagatagctaaatgaagcttacccatagccttgacacagctcttgatgtcttccctccatttcctgaacatattctgccatctctgaagctacagaaaaaaagtgtatagaactcaaaatattacacaattaaaccgtagctaattctaggtggcaagaagtcaacgaaactgtgtctgaacaattaggaactctggacagagatgcctgagtgtaagcaaggtaaaagggaatgacatggcaatacaaatgcaaagcaacagaacaataaagttaaaaaaaggaaaaaaagcttagaaaagtcaaataattcgatctagagaaaaagcaaaagaacagaaaatttcccgtgagctacattctatggctcaatttgcattattgaatgactcaagaaaaattgaattcatgtcacaagaactcaaagaaaaaaaaaaaacaaattatctgaaaggaaaagggagattgtagactaaaggcaaaaaaaaaaaaaaaaaaaaaaaaaaggaaagccaaaacaatgtgatcacataactaatttgaaataattagtaacaacagggggtggaaaagatatggctaaaaattgaaatattgccagagggaaagtgctgaagatatcgcagttaatgctgatgaaaaaaaccagagattaaattaatcacagagaaactgagatataaagagggcagatggtataattagatccctgaaagagaaaacctaagtacttcaacaaagaaattactcaaaggtatcaaactggaaagttttcttaatataaagaactgactctgaagtttgaaagagcatgttaagttgtaagaaaactacacagtatgttcaatgctaagatgtgcattgatcaagtcattggacttcaaggattaaaataatatccttaaggcatataagcaaaatttacagcacttatcacctatgaggtagattgctggcattatacaatctcattacacaaaacaatgtctataaaattgagcataaaatcaagtgggacaagaattatctgcaaccataatgtaactcaaatgtaaacagcaccagcagacattcacaaatacgaacaaactttggtaatataacactaaagagttcttttttaaaaagttgttaccatataataacaatataacacagatgagctctttttaaaaatgttgttaccatacaataacttaacagtacattttaaaataatttaaagagtgtaattggattgtttgtaattcaaaggataaatgcttgaggggatggataccccattctccatgatgtgcttatttcacattgcatgcctgtatcaaaatatctcatgtactccataaatatatacacctatattatttacataatcattaattatgtactcacaaaaataaaaaacaacctgggtaaactaacttatttttaacttgaatctatactccccccaaaaaataaaagacattacaataaaattcaagcatttaaaagaaaataaagttactcagaaatggaaacacttggtgagaacagtgacggcatttaaatatgcaagaaatacatggtacacattataaatatagaacaaagtatacatgtgtcagaggtcccccaaaccaccctcaatctgcatcactctctagaaggactcataggacccagaaatgagaatgtttatgagtatggtttattacagcaaaagttacagagtaaaatcagcaatggaaaaaggcgcatgggggcaaagtctggaggaaaccaggcacaggtttccaagagtcctctcccagttaaatcacaaaggatgttcctaatttctccagcagtgatgtgtggcaacacacatgaagtgttgtcaaccagggaagcaaccctggagtccagggtttttaccggaggtcagtcacataggcatacgatgcttacatgactgacttagttaccgaggctccagaccccagagggaaagcaagtgttcatcataaattatattcttagcatgaactatctagaccaactggtacagtctgactcaaggccctaggcttgcaaaaacactcttaccactcagaaattccatgagctcaatacacaggagctggtgaagggccagtcgtgcaaataggcctttcttgggagtgcacagtttgaacaactcagatcttttgagttaaccctttcttacacaatatgtgataaaaatagcaaaaaatcatagatgaaggagaaaatgtcaaagaataatgttctcatttttcataggaataaggcagttttactgggtaaatttgcaggagggagttcaaataataacaccagactgggcatggtggctcaaacccgtaatcacaacactttgggaggccgaggcgggtagatcacccgagaggtcaggagtttgagaccagcctgaccaacatgggaaaccccgtctctactaaaaatacaaaaattagccgggtgtggtggcatgtgcctgtagttccagctactcaggaggctgaggctcaagaattgcttgaacctgggagacgaaggttgcagtgagccaagattgcgccactgtactcccacctgggtgacagagcgacagagcaagactctgtttcaaaaaacaaaaaacagaaacaaataataacaccagttgtcttatgtgtttaataatatcttttgtaaattttagtgagttatcttggaaggtagtacctcataaaaagtagttgaaattcggagttttttcttttgctaactttgtgtaatattaaagtttagtttaattaaagtagtacatatagattttcctctaaagagtttgtctattctatttgtgtgtgtgtgtgtgtgtgtgtgtgtgtatataatatatatatgcttagaaaagtacctagaaatatgcctctctactgttaatgatggcatgatttgaaaagcttaatttttttctttatgtatgtctacatctcttatattttaaaatgatgaacatgtactatttaacaaaattaaatctctggctagatgcagtggctcacatctgtaatcccagcactttgggaggccaaggcaggagaatcacttgagtccaggtgttagagaccagccttggcaacatggcaaaaccctgtctttacaaaaacaaacaaacaaacaaacaaacaaaaaaaaaagtagccaggtgtggtggtgctcctgtagtcctagctacttgggaggctgaggtgagagaattatttgagcccaggaattcaaggttaagtgagctatgattgtgccactgcactccagcctgtgtaacagagcaagactctgtctcaaaaaaagaaaaaagttcttaatttgatatttgatttttctttgaaaagggaggaggataatgaaagaccgaggaaatcataactctctgagacaagtttaacacagactgggaagggtggcttttatttttaagggaatttaagcatcgtacagataaaagaaacatacataaaaaagtaaatactatgattttctttctccctggattgctcctttaacacaataattttacagaaacctttttccattgtaagtattattatattgctcaattttccagtgccaatcccttcctttatttggaggagcctctgaatgccagtggggagatagttttcctcttactggtcagaggatggaaatttagagagaagtcattgattattgagattgaaaagcaatcagacaataagtaaacaatcagacagtaaaagcaaaaattggtactaaaatgtgttttaaaatgacacaatgattaaataaaattaattatatcctctagaaatagaaatgggcttactatgacaaatacagatatataccatttgggactaagaaaaattttatgaagaaaggtatgtgaaatatttttaatagccaaaaatagaggaactctggaatgggtgggaaaggagtgagcttagcagaccttctctgtgaaacaatcgtttagctggtgaaaattattaaaacatacacacacaaaagaagctaagacacacacatttaaaaaattgtcataaggacacacagcaaatggaaaaacatttattcaagacatctattaaataccagttagaaaaatgagaggtgtgatatttaaactgtaaccagctgccatccgctagctcacccctgctccttgttttggaagccaaaaggacaagagctttcttacctgccagttatcagtctagggctacagttcaaccccagaagaggcaggctactggtgcctctcattttccccagattcatgttgcagaagcggtattatgggtaggcatagccaagaacattgggctcacttcttttatccagcccccgtttatagggtataagctctataccaattgtggcagaccaataataatgcgtgtccaattgtctcttcctcagcttgcttataaggcagaggttccatgctgggaagggcaagctgaaaaggccagagtccaccatctttcccaaattcccacttatacaatggtagtgtcactcgggtggaagtgggccgctatttgtgcaaccaactgggctgtaatggcacagaaattctgcccagggatagatgcagagtgtcacaataagagtttccactctgcctggagtcactgactatctggaacagaagttagagaagttcatggctaagggttttcttaaacaatggagatcttgatggcaagcagcttatagggagcaggcagctctatgataccagcagcaatgagcaaactggtaaagcagccagaagtcgagtagagagaatcagggaatgagaaagccctgaagagccctctggggatcacacttatccctgagggtatggaaagttgtacatatttgcaaggctacacaactcagaggtaattagagtaagacacagggcagatttgaaagcattctcaagccatacacagatgcctcatccaggaggaagagtcttattggttcagaaggcttaaacgtgatctctcaaccaacactggctgaacaataaggtactcttactcaggtgctattcctaggaaaacaaacttaaaaacaaaatcgttcattcttggtggtctggaagactgtatttattctgaaggctgaaacatctcaagggtgacaggaggataatttctaagctaacagtcctttgctgaacatgaggcaagatcataaacttcctcaaagcagtctccaagtcacacatatacaacagacaaagggcaaaaatctaactgaccaagggggcttaagtacagtatttgatcaataagttacttatattgatacactcacaggaaggcaagccaaaagataaaaacaggggaacctttctgaggggggagacgagagccgtctgccgaaaatatacaagtctcagaattatctctatcaaatcactaaataaatgaacatatgaacaaacaattagaaataaacctagaggaacagggttagtgtccagacttgttacaatgtattatctaaagtccagctttcaataaaaaattaggagaatgcaaataaacaggaaatgtgacccatacacagaaataaatgcaggcaatagaaactgcctttgagtgggctcatatgttggacttaatagacaaagaatacaagtaactattataaatatgttcaaataactaaaggaaattatgcttaaaaattaaaggagaatgagaacaatgattcatcaagtagataataaaataatgaaattttaatacatattgtatatgtctattcatctatcttccaatagaaattttagagttgaaaagtccaaaaacctaaatgaaaaattcactagacgagctcaatggtagattagagttggcagaagataaaataattgtattagtctgttctcatactaccgataaaggcatacccgagactgggtgattggtatgaaaaaagaggtttaatggactcacaattccatgtgactgggatgcctcacaatcatattggaaggtaaaaggcacctcttacatggtggcagacaagagagaaaatgagagccaggcaaaaggggtttcctcctataaaaccatcagattttgtgagacttattcactatgatgagtagagtatgggggaaactgcccccaggattcaattatctcccaccaggtccctcccacagatgcgggaattatgagagctacaactcaagatgagatttgggtagaaacacagctaacccatatcattccatccctgacccctcccaaatcttatgtcctcacatttcaaaaccagtcatgctttcccaacagtcccccaaagtcttaactcatttcagcattaactcaaaagtccacagtccaaagtctcatctgagacaaggcaagtctcttctgcctatgagcctgtaaaatcaaaagcaagttagttacttcctaaatatattcagggtacaggcattgcataaatatagccattccaaaggggagaaattggccaaaacaaaggggctacaggctccattcaagtcccaaatccagtaagtcggtcattaaaccttaaagttccaaaatgatctcctttgactccatatctcacatctgggtaatgctgatgcaagaggtgggttcccatggctttgggcagctccacccctgtgggtttgcagagtacaattcctctcctggcagctttcatgggctggttttgagtttgtatggcttttctaggtgcacagtgcaagctgtcagtggatttaccattctggggtctggaggacagtggccttcttctcacggctccactaggcagtgccccagtggggactctgtgtgggggctcacaccccacatttcccttcggcactgccctagcagaggctctccatgagggctctgcccctggagcccatctctgcctagacatccaggcatttccatacatcctctgaaatctaggtggaggctcccaaacctcagttcttgacttccgtgtacccacatgctcaatatcacatggaagctgccaaggcttggggcttgaaccatctgaagccacggcctgagctctaccttggccccttttagccatagcgtgagtggttgggacacagggcaccaagtccctaggctgcacacagcgaggggtttgggggtgtggctcagccacaaacaaaaccattgtttcctcctagcttctggggcacctgcagttggagaggctgccataaaggtctctgacataccctggaaatatttgcctcattgtcttggcgattaacatttggccccttattacttatgtaaatttatgcagctggcttgaatttctcctcagaaagtgggtttttcttttctatcacattgtcaggctgcaacttttttggacctttgtgttctattttccttttaaaactgaatgcttttaatgacaccgaagttacctcttgaatcctttgctgcttagaaatttcttccaccagttaccctaaatcatctccctcaagttcaaagttcaacaaatctctagggcatggaacaaaatgctgccagtctatttgctaaaacatagctagagtcatctttactccagttcccaaaaagttcttcattccatctgagaccatctcagcctgaatttcattgtcagcattttggtgaaagccattcaacaggtctctaggaagttccaaactttcccatgtttttctgtcttttcctgagccctccaaactgttccaacttctgcctgttacccagttccaaagttgcttccacattttcaggtatctttacagcagtgcctcactcccagtactaatttactgtattagtccattttcatgctgctgataaagatgtaccagagactggataatttataaagaaaaatatgtttcatggattcacagttccatgtggctggggacacctcacaatcacaatcatggcggaagtcaaaaggcctgtcttatatcatggtagacaagagagaaaatgagagctaagcgaaaggggtttttcgttataaaaccatcagatcttatgagacttattcactaccatgagagcagtatgggggaaactgcccccatgattcaattatttcccacagggtccctcccccaatatgtgggaattattggaactacaattcaagatgaggttggggcggggacacagccaaatcatatcaataatcaaacttgaaaatagaacaatagagattatgcaatctgaatagaagaaataaaaattttgtatatttataatatataactttaatgaatggcgtgtttgtatatgcgtgcacatacaaacacaagaacttccatcatgaagcattatggatgtgctttggtgcttggaagcatgggtgtgctccaggcatagctctatgacaatttggcaggactgttaagtatacagctgggagaatcagaccgcctgcatgcaactcccagttctgccatttattagccatgttacttgatatctagaaaatgagataataaagtcttcatggtgttcttgaagattaaatgacttcttaatgcatataaagtcctagaaagcaccaggcgaatagtaaatgctcaattttaggtatcattattgatcttctttagattctgcccttccaggagataaaagatttgttttgttttgcttcacatctggatcatgtgttaaatttagattgtttccaatctaagaagagatcttcataatatgtcttattgtaacggtgtttgcaactgtcacacttttatctgtaatcgctttatagtttgcaaattgtaatgtgcagctgttagcatgtcatgagttttacctgggagatggctgattttcaggactatcataagtgcatttatattacttttcatcttttgtgtggtatctgaacagagtagggatatgataacaacacagactattttgggacccttcaatgtggtctgcctgactcttgtttctccctgtttcacttctttctagatatgagggtacgggtgtttttctcttttgttcactgttacgtctatcacctagaatagtgcctggcaatcagtaagcacagaagaatatatcatggtatctcataatctaaaaccatttactttccagtagatgcccaagtcctttgattttattccggtctcaaactaccttacatgataaccattttaaaaattatatgtctgatgctgtattagcctgttttcacaccgctctaaagaaatacatgaggccgggcgcagtggctcacgcctgtaatcccagcactttgggaggccaaggagggcggatcaagaggtcatgagattgaggccatcctggctaacacgatgaaaccctatctctactaaaaatacaaaaaattagccgcacatggtggcaggtgcctgtagtcccagctacttgcaaggctgaagcaagagaatggcatgaacctgggaggcggagcttgcagtgagccgagatcgcgctacagcactccagcctggatgacagagtgagactccgtctcaaaaaaaagaaaagaaatacatgagactggtaatttataaaggaaagaagtttaattgactcacagttctgcatggcttgggaggcctcaggaaacttacaatctgatggaaagggaagctggcatctttttcacaaggcggcaggagagaaaagagcatgtgaagggaggaactgtcaaacacttacaaaaccatcagatagtgtgagaactcatgagaacagcatgggggaaaccacccccatgatccaattatctcccactaggcccctccttcgacacatagggattatgaaaattacaatttgagatgagatttgggtggggacacagagccaaaccacatcagatgtttctgttaaattgaatagtttgttataatctgagcatcctccttctttctttcctttatgtctatagagatactacctgatctacctgttcaatatgatgccattgcttctttcattacaaaccctacccatctaccaagaccaacacagactctatcccatctgccttaattgccttcatccttcagcttccctcctctgaatgttacttgctttgtatttatttcctgtgtcatttaaccacttgtatgttccagtacagttacttgtgcattctgtgtctccctttagaacagggaccttgtctgtttcacctttgtattctccatagtgcatgtaggtagcaaatatttgacaacagccaatatttaataaagacctactcagtgacagatactgaacccaatgactggtttgattcctaggaatgtgagtgatattctcttcctgtgttttctaaaattatttgcctagtgaatatttaaacaaattcacatgttgaacatcatagtgtttcaaaacagcccctggacttggtatcagatatattgagtcaaatccagagatgctgtgtgactttgggatgataacatacccctttaagagtcttggttttcccaaacaccacatgttctcactcataggtgggaactgaacaatgagaacacatggacacaggaaggggaacatcacacactggggcctgttgtggggtggcgggaggtgggagggatagcattaggagatatacctaatgttaaatgacgagtcaatgggtgcagcacaccaacatggcacatgtatacatatgtaactaacctgcacgttgtgcacatgtaccctaaaacttaaagtataataataataaaaaaagtcttggttttcttgtctgcaagtaggaataatagaatcacactatagtgttaatcgaggtaacaaattgtcggtaacctcagactgaggaaggtatcaaataaaagtgagttttcagccaggcgcagtgggctcacgtttgtaatcccagcactttgggaggccaaggtgggtggattgtttgaggtcaggagttcaagaccagcctgggcaacatggcaaaaacccatctctacaaaatatctaaaaatcagctgggcatggtggcatgcgcctgtaatcccagctgctcggtaggctgaggcaggagaattgcttgaaccagggaggcagaggctgcagtgagcgaagatcacactgctgcactccagcctaggcaacagagtgagactgtctcaaaaaaataaaaaataaaaataagtcagttttcctctttccctatttgaataaaagtaaaatgagtttttcaagggtgtcattagctttatgttattgttctaactctgcctctatcagatattctttgaatgggccaaactctcacaatggctggacactggggatgttatgatgccagaccatgctgctactttttccttcctttaaaagctctctggtaaatatcgatttgtctgctctggtggttataaactgctgctctcctcctattcttcatgaaatacagggattctaagttttgttttatgtacttgtgttttatctatcgcatacagaattgcaaacaatactatttgtgaggggcgttttgactttttcaaaatatcttcatatccattatttaatttggtacccttcacaagtctatgagcctggtagggcaggtacctgtgtcatcataatccccttacaaatgaggaaatagagcctcagaggttaagtggtctgcccagcgtcacacagattaaaaggtggtaacaacaagggttcatcaaacacaagtcactaggctacaaatctggcaccctctctactcgcttagcctgaaagcaaaggggtatttggcaactgtgacatccgtcatcctaacgatcttctccattcttctttggcagaggcatccatcctgagctatgatggtagcatgtacatgaagatcatcatgcccatggtcatgcatactgaggcagaggatgtgtccttccgcttcatgtcccagcgagcttatgggctgctggtggctacgacctccagggactctgccgacaccctgcgtctggagctggatggggggcgtgtcaagctcatggttaacttaggtatcgtatgaagtaccctctgccacttcgtttgggcttgtcttccctttcttttctgattttcattggtttgattgaattctttgtttgtttcttgaaagttagctgctcacctcttgtttaacagacccaggataaaacccaacagcagcgatcaccttctccttgtttctgcatgaggttttgatgtcaatttctggtttctgacagtggtgatttctttactagattatttgttttctaagtttcctttcttggttttttggaatcgtttagctttgtgtaaaacacgctactttggtccatcttttgatcaatcatattcccataagtccaactcctcagtcaccactcaaaacagtcacagctgaggtcagggacagggcaggaagtggaggcaaaatgttgatggtggggttgtaggaaattaaactttgtgggtagggtgagaagtacattgtttctagctccacagctactattcaaatggagaattctggtggccttgatgacactgatatctcctttgactttctcctagagggaggacaagtagattgttgttcccttggaaaataattccctaagttgagtctgtgacacgtggaaggaaaatgtgtctcctgatacgtatacccatttttcttcttgacattcttaaccatcactcagcatccccttgtgcaaagattgttaccttgtactatcactcactaataactctcttcttcttatataatacatatctattttacctcagagttgaaaaattatgacttcaaatttgtggctttattggaataggattttctctttcattgtaattacctataacagaatctttagaaattttcctttatatggcctcatattctcttctgctattgacctttactgaattctaattgatattctatagagattgggatcctcttggtttttggcaaggaaaaaacaaacaaacactccatttctgctgtttctaatcagcagaaagtcaatacccagcattgataagattagtgagacagctgggtccaaactttctaagctagtgaatgtatttgggtacgtagaatatgtttggatacagtgataccttataaagatttcagtgaaatggtttgtcagagccatggagaaaaaatgatgaacaaatgtaccagatgcaagatcatatgtaggcccacatgtcctggtgggaaggtggggtttttgaatccataccaatcttatctgctgtcaggtcaactggacacacttggaaaatgcctacatcataaacctaaaatctctgggacacaaaggactgttttgagcagtgacttctttagttatgtcttttttttttcttctagttttcagtgtttacagtaccgtgctctttttcttgtccaacttcatttgatttctgttgtcagtgtgtctcttggtttttcttttgtttgtgtattgtgtgtttggtcattttaggttatatttttttcttttgctggatctttttgtgtgcgtgtgttcctgagtttccaatcctccccgccatcaaccatggtaaatcaaaagatggtattcaacccttcaaaggcccaaagcctgcggcccgcatagcaaacagccttgagaacacagcgtattgagcagcctacagagactggcatacccctgaccctactaccttccatccctgcaccatcctacccaccttaaatcaatataagagtgtgttacctaaaaccaacagccagcagctgattatctcctcagaaaaaaacaacagaaaaaaaaaaaaaacagaaccaaatacaaccccataactagctcactgaaaaagatgatgaagacaatttttatctctggatctatttcaaagtcagagagagacaaacatatgagaatgattcagccccacgcgatcctgagggagtgtacacagtgtcattaaacagacatttttttccccattaggtgttgtttagtaaagattagagtgtcaactttgacaggtctcacatcttagaaggaaaaactggggtcagtgggggtacaaataaaagcgtataagaaataaggaaataagtgtacagattctcattctctctctcacacacacacacatacaccttgagttggtcatacatcccacatgcatttctagaagcattatttttgtattttaaactctagtcaaagtctgagagatgtgcttttccaatagactttgctttttttttttttttttcccctttggcttcttttgttgcaatttcaatctagctcctgctgcgttgaaccatctcaggcaaaggagaggtagcctctctgtagagagcactgtgcttgtccagaagccatagttaattttttttacaccaaaggataggttcatcataattactggtttgaatttatttaactttctttccaacctgacatggaaaactgaacttaaactctcatgcttgtgtaaatgcagctcttcatatccacgccttgtttaaaggttttccttccgttccctccccaaaatatacccctttgcaaatattttctttctctttgccgtgaatttgtgtttcatttttctcaattacagaagaaaatgtatccaagtagaatttgtcttcacatgcattccaccaaaattaatttcaaatgatcactttgctccctcactctattcaagttgtgtcttttttctagcccatgcactaacaatattttagtttatttcaaattgatcacacatatgcattcatgatataaaagcctagtatatatttctctgatgtaacatatcttccaaatgtcaaggagactagggttttccaatggctttatcttctgcaggcagccatatgtggtgctaacaggtatgagaaatatcctataactcagcacaacttttaaaaagttgagaggttgactattgatcaaccatattttgattctttagaattataagctataacattttattattacagcatatttaaagatttaaaagaccttatcttattttaatctcatgatctcatggatctcatgcgattaatgataatctcatgataattttgtgagataaatcaagcaagtgtttttatgcttacttttacagatgtgtagcacagagagaaatatattacttttcaaagcttacataaaaagttggagacagagctggaactagaacccatgtctctaaactgctagatcagcctgcgttatttgtttccttcacagatcagcactatgggtcaatgatgtgttagtcttaatggcttccaattgtttttatgatggtcacctttgaaacacacacagagagaatctccattttcctcagtgcccagtttgaattgagctgcactagggaaaagacagttgatatggacaaaacctttaaaagatccttagcagagtgccaggagcccttcttcaatggcagactctgagggagtggcatgtagtttggtaaattgcatttgaattctccagatgttctctctctggaaatgtggacttgctattactgtttaccaaacacattattgaagacacacagctcttagaaacatttacctcttccatgctcgacccaaagctcaacaacgagaaaaactttcttggccaggcaccttaatctaattacagacacttaggcctgtaatcccagctctttgggaggccgaggcagcccatcacgaggtcaggagaccagcctggccaacatggtgaaacctcatctctactaaaatacaaaaattacctgggcttggtggtgcgtgcctgtgatcccagctactcgagaggctgaggcaggagaatcgcttgaacacaggaggtggaggttgcagtgagccgagatctcaccattgcactcaaacctgggcaataaagtgagattctgtctcaaaaaaaaaaaaaaaaaaaaagaaagaaaagaaaaagaaagagaaagaaagaaaaaaactttctatcatttaccataatttaaaacaaaacaaaattaaaacaggcaacacacagatatgaacacatacacatcaaaagatatgccaagacttaggcagacttttttcaagcaaaaagtctggctgctaccaaacgtagatttaaaggaaattgccttcccaactcagttctttgactcatattttttatttaaaaaaccacatatataaatgtgtatgtgtgcgtgtgtctatatacacacgcacacacacacatatttatacatatatacatacacattcagtaacaagaacaccccctcagagcctatcaagaaggctctgggatagattttccttctcaaaccacttgttcttcaggtaaaataacaaagtaattcttcacatattgaggtaaagtaaacaaactgtctgccatcttgaaagcgccaagctcttacattggtttaaagaccgcatccactttacatgaaatcatttgagtgatccagaaagatgagcccaagccaccacctctcactaggccagcttcttgtctaataataaaatcctcagctatgcagaagccgaagacaaaacccacttgttgtttgcagtccttgggtttgttgctttaggctcactcttcctctcataagcgtgcccatacaccagtttcctctctctctttaatatgtcaggaagggacatttctccagctttgggtgatggtaggtgcagtcagtagctgaagccatcacctcttcctccctccctgccctccctccttccagtcctcaccaggggcatggcctcctctgtctggtaatcataccggttgctccagggctgtttgctcccacttttctgttgcggttgacgacacatgacaaacctaaccgcacgaaaccaaacccagatttttctcaagagatgttcttctcgggaacaaataagcattctgcctccttactcagaataactgggtgctataaatcgctcctctccagatttcacgtagcttcattctcccctttattcttgctcctttaaaatgattcactttggggaattcaaatggtggcatcatccttgacaagtcctctaaaaactactgggtcaaccttaagcagaagaagagtactttgtgactatattttcccctctatctttcttcctttaaaaaaaaaatcatttcgcttctaccttttagtatctaacggtaaacaaatccttattggaatttccaccatgataaaccaaccttaggctgaaccgggcagcttggtaacaactaacctgagacctttctctgaccttttctgcccagtcccctactatgcccactgattctactcaaggacttctatgttgtgtgtccatgactcccaagcagagattaatacaatgatagatatgctgatctctggcacagaataccttgtctgattactagctctggccagttggtcactcttttcttccctccctttcccatttaaaaaagtgaaacaaaaaccaaaaaattttctctcctcaagatgtggaatcacagagtgaaaaatactcaagatgtcaaaggtgccgagacctcctccacacgtgcctggcttgccttctccctgaatgctgtgggcacttgattcagtctgcgtattcaggcaggaagacagagatgggctgcgcgagggggttgatctgggagcctttgaatcactagcaatcagagaacccaattcattgtgataacatcatacaactcctttgaccctacacccgaccccacctctctaaaatctgggatgggtgtttgtgcggttagctgtttgcaagtggccattttatgacaggaaatgaccaggtggtgttaaccctttccttaccactaaggaagatggcaagtgtgcctatgcaaatttctatagcatttggggcccaacctaaggagagggtggagggagtttgattttagaaaaagagaaagggttaagtacgtcactgagcaacttcatgggcagattttttaaatgatacaatcagtcagactggtgatatgtctttggaatactaatacaaaaattgtgttaatgctactttaaaaacgaattttaagaaaataaattatagaggaaaatagaatataacctgcatttggtggggggaattattgcctatttttccaagtttgacaaaattaatatttcaaagtccaggtttgaaatactttatataaaagaatagctttttttgaaaaaaaaaaaatgtttggtgtctactgtggatatatatgtataccagtatatatctctatacatatgtgtatatatatgtgtgtgtgtgtatatatatatgtatccaactttactaaataatatactgtacatatacacccacccttaaacttgtacatactttatatatataaaatggccacatttcttacgtgtgtctgtccccggaagggtggactgattgtttttggatgtctgcagctgttaccttgaaggatgcaatttcatctttcatttatttttccccatctagactgtatcaggataaactgtaactccagtaagttttccctcaagtttcattttgttctttaaaaaaaaaaaacaaaactgactttattttgtttactgttttatgagctgttttttatttgaattattttttcttttaacaatggagtgggggggacctggggctaagaagatggggggctgggtgagggtgaagggctgagtgtggttttgggtgtggtttctgaagtgagggcaggtcctctcttctttccttgcatttgctctatatgaagaaaagaaggcaagggcacatgaataatgaaataatgaaaaatcaagttgaaatgatgatttattgtttttgggaggtaactctgagagtgaacaaaaagctttagggcaaccagcatgcacttctccactaccaaacagtttagaaaataaaagcactgttcttgacccacaggtggctgccaactctgacatttctttcccagtatttatctctgttgggaacttctagcaggtgggcagatcactgctattggtgataaggcaacactttaaccaaagacttgagacacactctgtctctgcaaaaggaagaactgcagtattattttcaccttatcccattcagataccctagttcttgaagaagggtcctaacaaggcacaggatgaaaactactcatgtatttcttcctcttccttagaagtaaacattagcttgagtcaacatgtagaaggggaatatgaagataaataggaagaataggcacaagagaaagaataggcctagatgatgaaaggaacaaaggaagaaatatgctttgagtactatagcatattatattaggcttattaatactaactactgtaacaagcaatcccaacattataatggctcaacaaaagaaggttttatttcttgttcagtcaaagtccaatgctaattggtcagttttcccagacagctctcttcaaagaggtaattcagggatctaggatccttccatgaggtgggtccaccacctcggagttctttacttctggctgtatccgtagggaagagagagagagagagagcttgggtggttgtgcagtaggttttattgccttgcctggaagtaacaaacatcgcttctatccatatttggtttgctagacatgactccatcctacatgcaaaggaagctgggaaatgtagtcggctagtgcacccaggagaagaaaaactggattagttgatatctagcacatgtaattctccatagtatctcatcatctttaaaattctttcctcactaggaaaaatccaacttttacatttggtttacttgttgattccatcctagtaagtcttttataggtgctagtttaaacttctttcttggtagaagatatattataggcatgacaaactaataaagcccaattctactttttggggggcaaatgttccatctaagttaacacaaaaagaagaaatttaaaatatcgatataagcaactgcttactaaatagagtgctttatccttgtcttggcatcacttacagttattttaagcaatggcctattttctgtgtttaaatatttctaattagccagaaatttgtcatgatatttagatcattaaaagcctaattgaaacatcctttctctccaaagcctggagttttctgttcctgtttttttggtttgtttgtttttttaagcagctttattgagatacaattttcataccactacatttacccatcataaacctacagtttaaggatgataattaaacttataaagttgtccaaatatcaccacaatcacattttagaacatttccatcatccccaagatttcttttctggtcatttgtagctaatccctgctcctacccatcgtcctaggtaactattggtgtgctttgttccaataaatatgccttttttggacattttatgtacatggaattagacaaattgttatatagtcattgtatcttgcttcttcaaaaaattttaatggcatttctatggaaatattttctctttccttttgcattggttttcagaaggaaataaggtggaaacccagcatgaaggtggaaagcctcgtatccgaagctacatctagcatcttctagcttcagagacttatttggagaacagggaactgaggcagttatttaatcaggatatcagaatttgcttttgctgttctatccacactttctcatgaagtcaatcccatatattccacatgatcagccacggaaagtcatcataagacaactcccaggattacctctgttgggaagatggtgacacagatgacagcaggttttcttaatctgataaaatattttctatttacaccccaccaaaaacagcattgagaggaaaatatgtcagcaaagttatattcccagctttgatcacaaagtatagaaagaatataactgatttcaattcaatacttacataaagaatcaagattagattttggaaattgtttttgagattttcacaataaacctttaatgtactaagaacatttattttgttggaaatttaatatcagagaaataatacagtgctcaatggttgaccagtgtttgactggaaaaaacaaatatacatgggtcttttaaactaatctaacacctttagagctaaacaatgtaaccacgtatctagggttatgtagagtcacaaagtaaatataatacattttttttctgaagctaattttaattgttaatatggagtaaaagtttaaattgaaaccaagttgatatattatgcagaagaatgcaaataagcataaatctttaagaaaaaaacataagaattcaaagacatttcatttttattgtgaatcttctctatttcatccctggtattattggcatttgagtggaaaagtttgagaagactatgcaattaaatttggagagaaaaagggcctacatgatccgaacttctaagcccctcttcttattgactccatgtcagatttcatagcttgacctgttacaggatctcacattgtctctgtaataggtgtgccggtccttactcttatctgattttcaactgtgagagtatttgcaccctgggtttgagggagaggaggttttccctgagccttacctcttgctgctatttcaatagaagtcatagggtaccttgcttaattttcaaaacagagcttcttttttttttcccccttgaagggaaatactgaattaaatttgaatcaaggtggattataagtttgtgaactttttcagtcattcttttttagaatgcctgtcctctgaaaagtcacttgggtaaaatactgaatgacatcagctatttttttttcctgttcatctgctataaaatgttgtttgttctgggaaatggctatttccaaggcattctgtgacactctttaatggagacaagagcatgaaaaagaaggatgatcttccagcatcgagagaaatcaatgggccatgagagagaagggtgatcttgaggggaaaaaaagcagttttcttctagccttcttccttttggcttcacttcctggcccttttgtcagagactatggcccagttccatgccaagtatttcctcccaagaagaaaagcaattttctaatcagctcttctttctgcctttcttaacttctcttttttaatactttgtctttcctcatggtatctatgatatattcattattattcattacaaatcctactactcctgctttccaaatcctccaagaataccacaccataaattgctctctagttactatcaataaacatatattacagagtgtgtaaatcaaggtctttggttgaatcaagtttgttgctgaatttgattcatctggcgggaatgtatttcttaatacacttaatacatatagttctagcttagaatttatttttaaattgcaaaagaacaacagagttggcagccatcatggcgaattgaactacagggtgacctggaacactactaaaggaaaacagaactggccggatgtggtagctcacacctgtaatgccagcactttgggaggccgaggtaggcagattacgaggtcaagggatcgagaccatcctggccaacatggtgaaaccccatttctactaaaaatacaaaaattagccgggtgtggtggtgtgcacctgtagtcccagctactcgggaggctgaggcaggagaatcgcttgaatccaggaggcggaggttgcagtgtgctgagattgtgccactgcactccagcctggcgactgagcgagactccatctcaaaaacaaaaacaaaaacaaaagcaaaaagaaccagggctgttttctggagaatttctggaggaaatgtcctgttcctatggctgtagttccataaggctggcagtaacctaagaggcacgcggttctgaaaacaggtatgaacttctcgttggtgtcatgagtgcgcaagtgaaagtatggaaaatgactttttgtctttgaccttgtctgattgtgcctttccctgtgatttcctagccactaatttattctatccctttcaagccatgtgcagtatgaatgaatatagagaactaataataattaaatatatggatagcttgaatgaatacagtaaacacatattaatgaatttcaactttttctttctttttctatttctctttcctctcaaacgctaattcttctgtgttgtggccatcttcattatctttctaaaatggagtgtatatgtggcatggaaattgtgagtttgtgtataagcctgattatttaggtatatgtaacagtgtctctctcactaattactttgaacctgaagacccactaatttctctgtgacaaggtttattttttcttcttagacacagaggagaaaggaagtagtgtgctgtacaaaaatatattgaccttaagacacttaagtgccacaatagagttatttgtgtcagagaatagctttgatgatcttgtgtattccctatataagctgatacctttgattcatcatagaggtgcacagtaatctcagagatgtatgaaaataacatcacaaggatatgatatctgcaaattttatctcccaagactactagtgtttgagtctttctcctcttggacttgcttggataatttgtttctttcttttttttttttttttttttttgccttttcccttagcttctctgccttaagtttctaagcagactccatttccagtgctttggaaaaattaacagcatgtgggtggttattgcttaatttaggcatagtttagtgagctgcagtttattatactggacttatggttttcttctctttcttttactctgtctttcctctccatggtacaagaatatgttatttcatctttacgaatcgtttatctgagaatctcagagccaaattgtttagctctttcctttaactcagaaactcttgcctcagaccaataaggagggctgacttcttcatcactaaaagtcattctcaaaggaaattgtagaaccctctttggtatccattttaaaagtcaagtaatcattactgtcagccatttacctggtgatgccacttattagaatcttagcagagatggaaaagcaagagcctatgtatcataatgtattctctgtcaaactataagcaagctataagcattgcacttcagagtttctatcttcataacgcatatttttgcttcttttggtatgttttatatttcttgtaacatatagaacacttcaagtgtaacaatatttatcgtatcaataacagccagattttagtatgatagtgggatgcttcctaaatatataatattaaacacttcttaataaatattaattcagattggtttattttaaaatagttaataagattatacatggaacaaaaggcaaaatagtaaaaattcttcccactcatcgtattcctcaaactccttttcccaaaggcaaccaaatttattagggatttttgtatcttctttcaggggtagcctatgagtatacaacatataattatatccacgttcttctccttttcttctttctgctcctccttctttttgacacaaataccaacaagcttttccacatcttatttttccactaaaaatgtcttagagactattccatgtaagaatatataggtttattttattccgtctaatagccacataacatttcattttaggggggtgctatattttattaaatcagcaccgtacatttaaatttttctcagctttttactactaaaaatgtaagaagtatatacttttgttcattagttaatgcatacatgtataagaagatctattggataaattcctaaaagtagaactgctgagtcaaaagataagtgcattataaatattgatatatattaccaaattgcactccaaagaggttttacaaagttatatttctaccagcaatatatgtgtttgcttctcctcactcttgtaacacacatcatattatcaaactgtattttcattctcttaagatagcttttcaaaatgttgctgtcacatatttatttcccatagatcttttcctcccatcctttaacatcttcaaatatacatagggatcattgtcattcatgactttggtgacaacttatatcagaaatcttttaatagcaatctgctgtagcaacatttcatatgttaatcttgttttgataaacagggatattgtagaaaagtagcaatatgttatagtaattttgtgtaatttatctcctacattattattgatctgtgttgggatctcagcacagacaggcatttagtgcaattacaaagagcaaggaggacactggagccaaatagcctgggttcaacacttgtctatgccacaaatgagctacatgtctttgacaagttgcttcaactcttagtttcctcaattgtaagtttcatatgaaatttagaaagaataaagggaatgggatctagcaccaaattaaaaagtaaacgtgatgtgaacttgaggcattaaattacaaataagtggtttccaaaagagagtatgctttgtctcatcaaaggaagaagcagaggaaacagcaaaagaggaggagaaaaagaacttgttcaaagcacaagccttcataagttatgtcttagtccatttggtgttgctatgatagaatacttggggctaggtaatttataaagataagaggattatttggctcttgattctggtggctgaaagtttcaagagcgggcagttgcatttggcgagggcttcatgctgcttccactcatggaggaagacagaaggggaggtagtatgtgcaaaaagatcacttggtgagagaggaagcaagagagagaaaccaaagaatatagactctttttaacaacccactctaaagggtactgatctattcccatgtacaaagagaagtcactaacccctgcctgagggcattaatctatttatgagggattcaccccgtgactcaaacgcctcccactgagcactgccaccacaaaaaaaaaggaagcaaatttcaacatgagttttggggggaacataccatatccaaaccatagcaagatatatggatataaacaaagttaatagagctgctgaattctaggaaggattgctagacaaaggaataaatttttaatatctgaacatcttaaaataggcaaatacccagccaatgtagaaattttatattgttaaatatcaggttaatagaggcagtatatagactcatataactgtttatcaatcacaatttgaactgctgtattatgttaaattagtgtacatggtttagatatataaagttagtgtacctagtttggaggtatgtatacacacacctgcacacacaaagagtgagagagagaaatatctaatgccagtacagcctaaaatttttacattgatatctgccactgtatgatttttatgacttgaagctaccttggatatagtatatgcttggtaaataattgctaagtaagtgaatggggtaatgaattgtatccattgcgctaccttaatttattatttatacaaaattgttaagaatcaacatgcaaggtacaagcctaaaaattgtaaagtacagtgttttgtcttgttgtcactcagaaaggaagaaaattaaccaaggagtgaatttgtcgtcttaacctaataatctaaaggaatatatattactttctctgtaaaataagagatttctgacaaataaatattttcatgaagtctgattgggccatattttggttgaaagtaaggaaaatttcatgaaggaagatgaacgtgtatctgtaaatattgcatgttgtcattcttccttgttcttcctcattcacttattccatggacatttactgagagtaagcagagttccaagagctgagtgtcattttaggaatttatactgcaaatttccaaggaaaatgtaggaggaattctcatagactgagtaatttctttatcccaccctactcttccctttcacattgcccacctccatttcttgtttttcttgaagaaattggacctcagatgtatgtatctctaaaatccagatgagtctcttatggattttgttcagggctaattcaacattcaattcaacataatgatgtcttttttcacaatgtgtgtgcatttctcatgatggggccctaaatgctggtttacttagggattttcctgatttccttttttgttttgatttgccctccttcatctgaccacttgcttggagcctcgcaagctgtgtttctgctcccctttaaaaggctgatgtttcagggactgtaattttagtaaaaatactatttctgttttccttctacctttccaagatttctttatgtactccaatccattttatgtgtctaattgctatagtcagatatacaaggtgacaaattctgtaagtacagttggtcctccataactgctggttctgcatctgcagattcaactaacaaaaaaattgaaaataattttaaaaaacaataaaaaaccaatataacaatagaaaataatacaaataaaaatacatataacagctatttgcatagcatgtacattgtgttaaatattataagtaatttagagattagagtataggaggatgtacatagtttatatgcacataatataagacaccattttatataaggaacttaagcatctacaaattttggtattcacaagggtcctggaactaatttctcatggacaccaaattaggaccgtattagtttcaggcacagtttatattttgaaaattaggaggtattatggtaaatttaaatggaaactgggcctgagaaatccctgagcagaacaaagccagttaggccgcataaatgaccttaaccttgctggatttgcaaataagagcaaaagttaatttgagctacagctcataaatacctatattcagagaaaacagaatgtaagctcaaccaatcagaagcagccaacaaatttataattatataactagggactttccaataggataggccaaataaggcaacagtgtaactgtaatccatcaaatattttctttgctttactcgcctatttatcctataaaagcctgctatttgcattccctcagtggagctcctgagccacttttgatttagagcttccctgtccaattcatgaatcactgtttgttaataaagtccttaaaatttttattgtgcctcagtttatcttttaaccgtttgacctctatgcggtgtaggatgtacagtgaccatttggtaagctaatattattaacctaaattctttattcttgtttggtaacaagataaatgtattaatggatgtatttccctttcattatgcctaatatatataaattatatgtataaagtacatatatacatatatatatatataaattgcagttgtttttatgcatatcataaaagataatataatttgaattctggagtttccagaataattagccacaaaatgaaagtctgtttactgattcaaagcatctcaggaaacacagtttccaattttgggaagaaaactttacagaccaggagatgttatttctaaaaaaaaaaaaaaaaaaaaatggagtaattttctggctgttctgttgacttactagaatcacatagctttttaactctgagtttatttgaagttagggaaataaaactaagaagactttatacatttccttctcaaaattaagctgtttcagaggaaatctgactatataatatctgttcagaaaatcattgtcatccccaagcctgtgccagccctctgtcagcagcactgtcctcaaagattcctcaagggaccctgtggaaaaatgaaaacaagagaggctatcaaggggtgcaagtaagaggtgcagtgttgagttataataatctaagtgtccttcctaaatggctgaaagtatattgcagtagaaaagtattaaaatgtgtatgtgtcccaaaaaagaggcaaaatgtaatggagatcatgtcctctaaagcaaaatatttggatggttatgaactcaggatcctccaataggcctgctggggcacatttcttttttaatatcaacatattacaaatggggaaaccaaggctcatggacactgagtgcttgacataaaatctcaaggtgatgaatggtaggcatgaacctttataaatttagttttataattcttcatcatatgagtactcttttgtcccctaaatcaagctgtctcttaatgatgacacaggactttgtttttaaaggattaatggggaaaaaagagggggatcactgcaaaggtaacgaattagaatatttttacctaaaccgatgaataggagtggaatgaaatttatttctgaaatccaggagatgacagagaaatgaaattggtgttatccacaagtgcgggcaggataaaatctaaagcaataaacagagggctgctcctctgttccagtataataaaaagtaatatttgaaacacaaaagcgagagagaggaagacctgcttatttcctgtgaggggttttcctgtgataggaggcacttttcttcctttcctccccagaatccgaggagaaggaactgccccactgaccagagtgacaatgcccataggactgaaggggtaagagcaacagaaacggaatgcttgaaaggagcagaaacagtgtatggcagcagcaaatgtgtgtcagatagaaagacaaagggaaagggacacaaagaagtattcacaatggagcaacacacatgtagtgtgttttataatgctggaaaaattctgtacctttcccatctcacagagaaaagagaacacaaaggaagatggataaaaaaaaaaaatgatgcagccactgggccggttatctctggctagagaaggattaccatttccttacaaaaagaaattgataattgaaattaaactcagattgcccaggtatacctgccggcagttggaatgtttaacttaactgctcggtttacttattgacaagcaaactcccttttactaatagaaccaatttacaaaactttccggtcatcataaatagaaaagccagatatggtaacaccgcgatgactagttaagtactcaggtacttatccatgactttgtttatccatcctcctacatatctgatagaaaacacaaggagtaggaatctcatggttaacatttcaaaggcatgaaaattgaatactaagtgaagatacaacttcattctttcccctcttcatatcttcctggaccctttttctcctttgtcacagcaaaataatataggctactaagtctatgcacaaggatatttacaataaacatttgacagtctttgctattgctatatgaagtgcatgcacttgacaggtggctactaattattatagtaaaaacaatagcattgagtgatttctgccattatgggataagaagtttgctggcattatcttatttaatcttcaccacaatcttataaggtaggtgtcattaccctcattttagaaatgagacttgttcatatggaggctgggtgtggtgtctcaggtctgtaatcccagcactttgggaggccgaggtgggtagatcacttgaggtcaggagttcgagaccatcctggccaacatggtgaaaccctgtctctgctaaaaatacaaaaattacccgggcatggctttggacacctgcaatcccagctacttgggaggctgaggcaggagaatcacttgaacctgggaggtggaggttacagtgagccgagatcgtgccactggactccagcctgggtaacagagcaagattctatctcaaaaaacaaaacaaacaaccaacaacaaaaacaaacaaaaaaaaaaaaaagaaaagaaagaaatgagacttagtcatatggaatgttttgcctagcttcagattcagtctactccattccaaagcctctgctcctcaccattgtacatattgcctctgccacttgtatgctgaagtgttaatgcctaaatgaatgaaatctatcactctagaacaagtgctgatggtcccatgaaagaggccacttctaatcactaatacctcctatctctgtaggtagtctttctgaagtcttgaccttccagagtcaagctccctcagctcagctctataggcatattagtgccccatgcttgccataaccagtctcgaaggcattgtctatttcagtgactgaaaggtacttggcatttagagatgcatagaagatgaattaggaattattattcaggaacagagacaactaagaagaggataacattagaatgccataattcaacttatgtttattactgatgaatcactctccacatgactgatgctttgttgaccttctcttggtaatgctggtactctctgtctcttatttccttccattgtactctagtcctctagtcttagccaacaggttgtggctgctgcaatccccgaggctcttctacgctacctctgtgtccatgctttgctgtgtgccctatagactgttcctctgtatctgcctttgcaacagctgtctgctcatccttcataacagctcaaggggttaccacctagatgaaaccttccttctactccaggcaggtctagctttttccacctttaagttctcctggcacttcgcacatctttcagaactcttatcacagttatatgctgtaaacaaagaatcatgggttttataaaattggaaaggagaactttatttctcataaagggttgcagcctgcaggctggccatcccagaggctgggaagcatagcctctggcaaaagctgagagcaagcacattgaggtgatcaggggtaaagggaacaggaatttatgctgagcagggtagctgaatatacatatttaatacactatagaaagagtcatgaatatttacggaggagaaccatgcaaatgtgcaattgagcttcatgcctcttcatgggttacacgttaaaaaaaaaatagctgtgttagcatgatctgagggtggagtttttggccctctgacatcaaaaagtaaaccagaggatatgaaaattgccagtgtatatcccccacaggtcagccaaaactggtccagagatggtggttggtttttaggaagggatgccttgtgaaactgattaactgtcacatcaatactgtaaagagggagagagagtctggttgtggcctcaggtgattggctaaagacaataaagaaatgggtcacctgcttcttttttttttttttttttttttccagagctggtttctgttgctccttaggaaagaatcctggttaaaggtgaataaggaaggggtatactgaggcatgaatatactaaggcatatctaccctccctgcccatcatggctggaaacttagtttttaaggtttctctgggtactccttggccaataggggattctgttcattcagtcaagggacttgagattttatttttagttatctattctttatttgtttccatgagtatcttcagaaccaacctctggactcctcatgatttggggaaatgcactattcatcattgtatcttcaccatctagcacggtgctaatcatatagaaggcattagtgaacacttattgaattaacaattgtaagtttaatgacttgaaactttgagccacaggagaaatctgtagataaacacagatttcttagtaagaggaaaattattccatccttacaaagacagaaatctcagcagatcagatgaaaataccatagattatcataatgagggcacttgcccaactcttgaagggaaatatgtttttagaaacccttattaaatactacaatatcagaaggctaaatttaaattaaaaaaatgtgattccaaaacaatctgagcacaacggggtgaccacagtcaacaatatttcattgtacatttagaaataactaaaaaaaatactaggattgtttgtaacacaaagaaatggtaaatgcttgaggtgaaggatactccatttaccctgatgtgattattacacatcatatgcctgtatcaaaatatttcatatactcaataaatatatacacctactatgtacccataaaaattaaaaatataaaagtaaaaatcggatccatcttttccctaaatagtggttgttcaaagagacatttaaggcacaagtgttgtttgtgcagtattgttttgcacatatcaaattctaggttttatgtcttacccaccctggatagaaatttatatccattccaggaggcggaggttgcagtgagccgagattgcaacactgcactccagcctgcgtgacagagcgagactctgcctcaaaaaaaaaaaaaaaaaaaaagaaaaagaaaaagaaaaatttgcacccattcctgtattctttttataggcttctgtaagcttcaaaaatgatccttaaagagattgaagatgatgactcagagcagaaaaataaaacaaaaacaacatgggtggcagagttgcgtgatagaaagaatggaaccttcaggtccagttaaacctgctctgctattaattagtttttggttttgaggtgatttttccaagccgtcattattagtaataagagctacaatatcattggatgaagaagaaaaatttctgaacagaagcatagctcccaaccatatgttttccataccagcatctatacaggcaccaaaaatcatggatgttcttatagccttgtgcctcacggcgtgaattgctcattgatcatttgaactcgtaacaatggaaacatcagttttaccaggcctcctgggcacttgtctgacctttctgatttgtcaaatggaattgcttcgtttgtaaaatgtttcataggagacaggacaacaatctctgtttgatgaaggtgaatgtacccaagataatttctagggttttaatggaagagttttgtgacagctggtttagcatctcatgtaaaataaattcaaggccttttgtctcactgaaagtaaggtcacattattaagagagaagatcctcctctaccaaagtcacagggattgactattcagttgaaccccagaggggctaatctgtccctgataaagttgagttggatgagtatcatgcattgcatgtgtttgcccatgatgagatatatgcagaagaaacaagaacaataatataggccaatatttaatgaggacttaccttgtaccagataatgttttcaattgtcacatgtattagatcctttaattctcacaaggatgatatggaggatacaggaccatttacattatttgtgtgatctagtgccaaataaaaatgtaagctccttgttctaaaggcagaatgaaagctttttcctttctttctcaattttttagttaacctgtcaaacatagggatactcagggagcaactgtagacccccacaggcactcacgaccccaccccacgattctttgtgtggaggcagaaggttgcagcagttgctagagggaggcagaaaagtgaatgaggaagaatctgcctgggtaggcaagaacattcaagccaaggctccaagtccctggctcatgttccattgtgccattgaacttgaaaaaacatgcacacgcataaattcacagataaaattcttaagcatttcaggacagtgactagaaagcattaagccccaaactcattgggttctaagtgactgcactggttgcatacctttgaatatggttctaaaagtaggtaataatattatctgaattttacagataaagaaactacaattaccagaaacaaagtttttgtgtttgtttgttttggtgatgtgtttgtctaccatataatcacgaaaacatactatgcctattatacaaaatttagcttgttctatattttggtatacttttaatactactgttttaaaattcttaatttctcctgcatgtcttccctcatggctaaagataaatttggtatcctatgaactatgttttccgtcaaggtttgcacaacggcataaaacaatccatcacatttttctggccaatagatacatgctttatttctgaatgtcaacgtttaagagactgaagtctgtgactactgttaattttgctagtaaaaataagttctccctgattttggttattatccattgaagatgttatcttcaatagttatccatgcctatgtcatgatatcttcacttcttcccaaatattatcttcctcagatattcaattgtgaatgaaaagtcaagctccttgtccatttttactgtacctcagccttcaaaggcctaaattaccatttcatttctgttgctgatcatcagcaactagaagacagaatttggatattctcacaccaatgtactattgctgcagaaatcctttgggctaactgagaggaccgaaaaaaaaaaaaaatacaaaagaacattccagaaataattacctattcaccatctttagtacaatgctgtacaaataattaatttttggttcgttattctctattcactttttcctaacatatggacgcatatatatgggtccagtgaatcccattcaaagagaatagatggtgggaaaactattggatgccatcagaatattttaaagaaaaaactgtcctttgaaacaaattctgcagaatattttgaacggaataagagaaaattggtttcaagttaatcagtgaaagtgaaacacttgctgaggccataataactgccattcctaagggctgacaggtcatgccattttccaatgtcttgctgaaaaaaataatttgtgtaggctaccactgagtagccatactggcttgccttgttcctgccttccttctgatttggggcactgcagtgggagctgacatgctgagctactcagctgtctcagcctcatggccaggcctcactcaaaacagtgtccgaggaaaatgacaacatccctttggggaactgagctagacctcatatagtatttgcattcatggaacagcgttttcttgtacttacagaacactttgttctatttaacagcatacatagttgtatctgattttattgccattgcctttgaaggcacacattcattgtgctatggtttggtaatgttcttctattcaaattgatttgtaacaaagaatgggtttacttggactctctgcatctagtgttggttcatgtcgcaattacctgcaggcagcaactgtttattgatgaggattttaccatagttttatgtgattacatgttagtttagctttcccttctaaatcaccacttagtttatagttcaatattatcgatccaagtgctaccagagagcaattctattgatggcatgttacgtgtttggaaggcagtctaactttcaacccacactctcttttggagagaatgttgcttcaactaacaatattgaggctcttgcttaaatattcatctcacacattagagtaattggcattaaataaacttcatatctgaatattttcattaagaactggagagttggtggtccactctaaagtgtccatatagaagttggctaactttttctgtagatggccagatagtaaatatttagatttaaaagccatatagccctgtcacaactactccattgtgctcttgtagcacaaaacagccatagacaatgtctaaacttattggtaaggctgagttccaatacaactttatttactaaaacaagtggtaggacagattttgcccaatggccatagtttgctaatccctgttctaggaccctaagagaggtacatttgtagaaattatgtttggaaagcagactagctacccagaattccaaacaataggcacatggaagtttggaaaactcttcatttaaagcattttttagttctagatgctggtaatgcaatgctgaacaagaccaacatggtttctctccttataagatttgcattaacatttgtgaatgcataaagacttaagtgagttcaagtaatgccaaatgcaataaataaaattaaacagagtaaagtaaatgcctggatgtgggaggaagtataactttagataaaactgccctggaagcttttctgagaaaatgatatttgaattttggacatttgatacttgaatgatgagaaggatctagtcttggaagggtttgggaaagagcattctgtgcagagacattgacaaaggtgaagggcttatggaagatacatacttggtgtgtttgaggaataggaagacaccagtacggttgagaagggaaagggactgttatctctatcttgaactgtccccattaaactgatctataatcagaattttaagtgagttaaattctctttctgatttacaatcatcctttcttttgttcttagtcacttgtggaggcaaattcgcaggttatctgcagcctttcatgtcaaaatgtaaatgtttataaattccaactcaccattattaaactggaagcaagccagtgtttcagttgagggacagttaaatcacactgtttgaaccatatttgaagaaatgatgacaccagtgtattagtggtaagacttgtggggttaaggatccataggtctagtcatttgagctatagagaggatttcaccatagtcaatggtcttcaattgctaaatcgggtaaaatagctcaactattagtttcactatggatgtctagaagcccaaaactcatcagttaattgaatactgtagactgggggaaaaaattattttatccaatcccaaaagaatcaactcaagtttattttacagaaaaatattgcatctagtcctatattgtaattttctgaaggtttttaaaataaaattattttaaatcctttgttgctaatggttgtaaaaacactaatccaaagagaattgccagtatctaaataaaacaccctgagttaatttgactcaaaaaatcaagtcctttgcctcagttaagtagaatgtgagaaaatggttctaacagaatcaagttcagctcagggaagttaattagagtgtcttgccttaaaagacaaggtagttttctaggcaatggtatttgataacaatgtttcacatgaatgcaacaaaattctgtgctctgttaagaattgccgaaagagaggaaaactctgtgagagagtaacctgttacagtttcagatagccagagggggaaatcagtctgaattcataaaatagtatatcatggattttttaaaaaataaaattgcttcgaaatacatacaataactcgcccaagatgtgtatgggtgcgtgtgtgtgttatctccatcccaataaatgctattgggaatatataaggctgacattatcattttagttgattaaaataaaatatctaagttactcgtagcatgcttaaaatatttttataagtaaggtaaataggcttgacaaactggtgatatcttaatttgcttctcatatccatttttatggatatgataaaggtacttgtcagcctagattttgttacaaattctcaatttatgtttgattctgaataaaattttattaaagatgtctaaatgcagcatctctgctaacataggatttccaaaattttaatttgtcaggaaaatgaagagtaagagattacattgtgtaacatagggcatttttttcctgcctcgtcttagcacaagatattacaggggtttttactctttttttaaattttaaatcaggattagtatactcatttttttcttggtgtttcctatttgtaactgatataatgccacaggcctgggagctttaaagaaaattatttaataataaaatagtatttaggagctcttttttttttcattttctgagaagatataatgcattcctttaagcattttgaatctcttctctagttggcagcagcaaatattgtaagggaatatttttgaaatatgaatcttaatcacatcttctgccatatccacaagagtttccattttatatgccacattcaacttcattcatctgacaacaatggaaaaatgttactttagacatcaatggaagttttactgagtatcatcaaatgcttagcaaatatttaaaatatttcacatattcttacgatcagaaattacacattgaagaatacttcttgatttgggaactttaataaaaagaagtgagaaatagatcttggtctgacatggaaggtggagcaagctgatgactttactaagtgacttgctacattcttatagaacaaggtagtgggagtatttttcactaaactatttatgggaccaaggtcacgtaacttactcttgtagcctaagctggtgataaggcttggacttttaatttccaaattatagcatgcaggtattagaaaactgatgacgcaagccacgattctcactgaaaaagaatagaacaatatcacacctgtaaccccagcactttgggaggtggatcacgaggtcaggagttcaagaccagcctggccaagatggtgaaaccccgtctctactaaaaatacaaaaattagccgggcgtggttgtaggcgcctgtaatcccagctacttgggatactgaggcagagaattgcttgaacccaggaggcggacgttgcagtgagccaagattgtgccactacactccagcctgggtgacagagggagactccatgtcaaaaaaaaaaaaaaaaaaaaaaaaaaacaacaacagaacaatagcactttcactcatttgcaattttagcagagttttcatgggtgaatatcaacatctgttgctccatttcctgaaaagtcctgtgggttggaatgccagtgctgtcccaattcactttgtcttttgctttagtaatagcaaaaatcaatgtaattaccatcactattcacagttttttttaataaatagtgggaccctcatttaagtcgataaaattgttctgtctcattctttgcctttgttcaggatcacatatgaaattcttttctgcaagatggttttctacctccattgaccttgaaatgaaaaattctttcaaaataaatattttacaaaattatttctaagtcgaaaaagacttagtgtcttggtgtacaagagtggggtaataccagcatgtttctcagtggggagtggggtaaaagaggaggacaaaaaggttaattaatgcataaaagtgcctagatcaaaggcaggcaccactgtaagcaaaagacatctccttgaatatttcctactaactttcaaaaacgaatggaactcagctgtggtttaaataataataatgcaagagacaaattcaagagctttgtctcttgaatcaaaaatggttgtcaagttttctggttgcatatacttaaacctgccaaaggtaatgatggctacttcaagaagtctgcctaagatgttgatacaatcaacgactctgtttagttgttcttgccaagaaagaaagaaataattccagattccaggtgttactacttagctggatgttttactttataaggaggcagcaattcatgagaaacagctgtaattacacagcattcaggtatttcataattaaactaacagctgattttaaggtggcacatggcatgagattttgcaactaggctaagtaagcatgaaagtgtagcttagttctcttgctgtcggctttggacaaatcctctctgtgccttggtgtacaagagtaggccaataccagcatgtttctcagtggggagtggggtaaaggaggaggacaagagggttaattaatgcataaaagtgcctagatcaaaggcaggcaccattgtaagcaaaagacatctccttgaatatttcctgctaactgtcaaaaacaaatggaactcagctgtggtttaaataataataatgccaaatactggaatcatagaaaactgagtattcttatcggtatccctgtgactcagtgattttggttccttagagaactcatcttgttatgtaggactgaagaggagcttggatgtcagttggataacattgatcctgttgaagctgtaccaggcactgtgtaaaatacaaaagttgtagagtcatctgcaggtctggtatacatggaatttacaatctaagtttcacgcataaaacatctttccggggaagacataagctattgcccttgaagatttgtaacctaggggttggagatagactccatgaggctgaggctcctctattccccatgcttcaggagagttgctcaagttagtcatggctgtgcctttgcttgtctctcccaagttctatttctattgcttggtaagtaaaacagcttattttcagggttctttaacaaattctgtaattagtactctaaagtgttcagtgatcctgactgtgttacttttcactattgcttaagatctcatgtcttttgagtgacctcttccttcaggaacccttagagccttggttttgtgagcccataaatgccaggaagcctccaagatttctagctttgtgaagtttacagaccattcatttccgcagtctcctgttgtcatctctaggggaattgcagtgtgtccatccacccttgaggcatggcaaggtgaacatcccttggactgaagactgaatgcttggttttgttcccatacttaatctgagagattcaaataattctttactttgctgctttcctaagactattttaataagaaaagcatcaaaagaacttggtcaagatggggaatcttgggtcaggaaaatttggagacttacttgaagagaatatttgaaaaagattcaaagattttgaactatcagggtagagggaaattgtttctggtggttaaaatggtaggaagtggctttcaaatctgaaaaaatctaaatgtttttaaggtgttccaggcactgtggttaacaatttatattccttttcttatttagtcctcccaacaaccctgccaaagaggtattattattcccctttgaagtgaggaatcttagtgcattcaaaaacattcatctactatttattgagcacccatatttctaagtgctgataatgtagttgtgaacaagacagcttatattttagaggagacaggtcattagcaactcaacaaataagtagcataattttcctaggaaaatatgttgtgcagaaggtaaggctaggttacaggtcatgccaattgaaggtgggaacacagtaggtgggtttgcaggacagaaagaatgtatgtatggctggtgagtgaacaagggaggggtggtggtgggaaaagatgcaaggatcaggcagggtcttgctggccaaggtaaggagtttgcatcttattctaggagcgacaggaagcttgaggaaacatttataaataaatgagtgatgtgattccgttatgtattgcaaagtttcctccggcagctgagaggttgaataatttgttcaaggtgaggtgggcacaaagaagaaagatggagggggataaatgactcacttggcacctgggtccctctgccttgaaatccctttcctgaatactggtctattttacttgactactagtattaagagattggaaagaaagaatgcaagtaatggtcagagaggcaaaccgacttaaaaagctgaagcaaaaagttgcattattttaggaaaatgaagcaggttcattcgtgctaactcctgggaagctggcctttgagtggctggcttgcgtggcccttgcagtgttacctggcaactaaggtaaccaggtgaggaggctcctttttaaacataccactgagaacaaagcttcgtttttggatactcaggtacaaggaggactgatatgtttgggtctcctgaactgtgttcctgaatttcctctgccttcttgctaataacctgaattgtgcagatactgctgcggctaccagcacacaccagtgttgaaagcagcaagctttggaaggttaaggagcaagttgtgcatgaaacacttgaccctgccctgctaaataaagaaccgacatacagcctacagtgggaagaaaagagagagaggatgctccttgagaatttttttttgtgttgcagactcttcccctccccttcctcctcccaacccacccccagtccatctgtgatgcctgaattctttacaggctgtcttgctaaagacatcctagccttaatcaccttctctgtattgtgtatcactcctgtatctatctacttatgtcagttgtttaccagttcccttcagctgtctgctttttatcatattattgatcagtcagtcttgggcgtcttaggttggaggggagagagagagaaccggcaaagggaagcaggagtagagaatagcggtggcggacaatcagttaagatggttccaaaaatagctcagctctgctgatgacagctctgcttgcagccaccccgtatgggatttacgcacttcactaagattctctgctgaaacggattcgaccagctgctcctgcagttggtggtggctggtggcggcggtggcagcagtgggctggttacatcttcagagaaggaattggaagcgataggtttggggcaaggcaggctcccacacagggacatgagatttattatcagaggctattaggactcaggttgtggggcatctgtgttctttgtacactatgctctgggcacttggcatccagtttctttttgtccctatctcttttgaatgagatgagggagtaagtgatgagaaattgttatatttctcacccactgtgtctattttgttgctattgctctagtttattatatacataggctttttttccctactgcactttctgttgggagactcagctatgtacaggtcccaactttataattctttggtcttatccaagactttcatttgtcaaagaaactctgcaaagtggctgggtctaaaaatgtaatataagtaagtacaacattgatagagggcccctgtccctcaaagactctaagtctatgctatgtagaaaatgcagtgtttcttatctagtaaggtgatcctctcttagaaaaagaaatgatcttgcacaggctctcaggcttttgtaatcaagactccttccagccacaacacctctaattacagggtttttggcatcctgattgtcccccaatgtactatgtgtaggggcactgtgggggtgccctataatttgtcaagcttattatcttgctctggcacacagaatacactgaatcaatttttaaggtctctttcaaaatgtgtctacgtcatctaaaacccataaatattaaaatcatatgcactagaaacagttaagatgtttaaattttccagaacacagagacttaggaaacaggcaagacacaacatgaaagcaaaaaaggaaagagaatgttacttattctattatctgccatgatggggaaaggggagacagaaaaacaactttctccttataaatcccagcttttgctgctgcctttactataaatattgttattcaaaaggttttcacctccttcttgggaggctattcagtgaagtataagatataaagagcaattttattgcctaaatgagaagctggccaaagtgtagtttcctcagctccatgctcagaacatctgattcagtaggttgagttgggactgatatacattttcataagcatgtgcagtaattctgatgtagctcgtctgtggaccacaactcaggaaccctagtcttttaaatgtatatttttttaataacatggtgctctaatttggagccctcagaaagaaaggaaaataaaacagcataacctgtgtcctccatgatagtttagtgggctctagtattagtttatttcatgacatgtaattgttattttcatttaatttgctgcacaattacttttatgtataatccatgttgagatgtgaataggacaatttactttatttaaatactttcagcattggcatacctgaggagataatagactatgagtagggaagacatgggctgatgttctacagtgttccagggtcagccattttcttgctgcaagccggagaagatccacacttccttctattctattgagccttagagtggccacaaggagtatcagttgctccctcctttgaaggctggagtctgtgaaggcagtgttcaagttcacttgttaacccacatcgccacctactgtccaccccccatccttaattaagaaacttttgcctgggagttgggcggagattagtgtgagaggctacagtatgaatgaaaagtgagattgtgaatgcacctctatcgagccctattcagaatgcttgatttgcaatagtttattaagaattacagcattactatccttaaatctaaagtctctctctctttcagtccagaagcaaattacttttgggttagaaatagcagccaagttcctgttaaaatgaaaacaaacctctctccaccttgtgtctaaggccctctttgttggctttaaaatgtttattgatttggggatttaatgttggatccaactgtgaatagtggccactttgggcctggtgagtgatcctggaatttgtcaaacaagtttatggaaggaaacctgaaaatgcttcaccctagtcctttgcctctttatttttgtgggttttttttttttctctttgagaatgttttctatttgagtggagaatgctctcatatggtacttttctctgatccttttggaaagagcaagtgtcctttgagaaatacttgttcttggttgttccctgctccccacccccatgcctgtccctgccacttctagagcaggtggaagtcgcctgtgggttcttctggtctcaggctttgactgttcccctccacaaatttgttcttaattcgattttgtattgaagcacatcagttatttgggcttccatctttagtgaaaagccacctttgcgtgttgttatgccacattacagtgttccagaaaacatattggtgtagatgcaaaatcttgccttcataatttttagccttatgttggattagagagcatattttcaagttgatctcttggaacctcagcatgaatctatattagaagcccagagaatgctaaacagagttttcactgagccatattagataacaaattattttacctataaatgagatattaattatatagattagatttttgttattagattatcagctatggagtgatcaccaaggaggataaaatagaaatagtataatcttctttgcccccctttaactctactatctgtggaatatactgaactttttacaaccaagtctttaatgctctttactttccctagcaaatgttcttccatttaaaaagtctttaaaatacttctttattttagcagtgcttcagaaaatctatcttagaccattctatgcttttaaatctatgataagattaattaagtaggctaacaacctcacttaaaaatattacctcgttcttgtaacattaatttctacagatttttttattgtgtagaagtagatacatagatattcctagtaactatagtataatataaaattaaaatcctatgtgttgaatcattatgttaataatagctgccatttctggagcactgtgtcttccaggcctctggtaaacactgttgcatacattatttgtcttagttctcaaaataatcttgagaggtttgtactattctttccatcttacagatgcagaagttgaggcacatgaagagaattcttaggatcctaaattttcataaatgccttcaggggaatttgacaatcaatctccattaggatcacattctagtagttttggccaaggagagtaaaggaaaagcttgtctttcttgcctagaagtttaaaggtcaaatcctctctctagccatattgcaattctggggacagttcctattgattgggcacttccatctaatatgctgttcaactgagattctttctggccaagagctgtgcaggggtaggtggcctcagagaaggagctgctggaagggagaaaaaggtggctttgtccaaaagagatgaagctcataggcatgctgtgcttcataccctctactagccttgctcatttaggttatttgctgaaaactatgcctgtctcagggagaatagtgggtgctggagatccgttggtgagtggatgctttctcttccctcatatagcttaattgttagtgctagagacagatactaaaataaatgtactggtgcaaagttaacaacttgacttcataagagccataaggggaaattttaaattgtgtgaaaatatatgactagaagagctgctctattctgggatggccatggagcatcacgaaaggctttgctgagcacatttgtgctggacttagaatgatggctaggagttactaggctaagaaagagggatgtgccaaagatctttaaggaacttaacatgaatgtggctgaggaaaagtgagggatgagcttagagagtgtggaaagggtcagataatggaggacacagtcagtcgtgataaggattttgcttttttatcttaaaagcaatggagctcatgtactttcctcttgatctgcccaagtacttcagtcttcttttccccttttatgcttttcatctgtccaagctcttcagctgagctttcctcactgatgacagcactatctggagtgaaggaggtgcagatcctgagatggactgcacaccccttggggctggatggacagactactcttcgagtgagataagggatgcaagtgtaaagggcgagtatgttgcctcactcaatcacatgttcaccaccctctctgccaacctttctgcctcctgctacaccctgcctaagccatgctgaccaaccttgtcactctggcctcactggagcaagaaagtcttagaatgctggagggttccacaagaataaaaagagcccaccacatctgcatgcataaacactacacagctagctcttgcttatttctgagtccagcaaatattatttgagtgtttttacacatcactgatccaataaggaaaacttgtataaagactaatgtttttatgcttcctttatagaacatgaacacatttgaggttttgttacttattctggagcattaatgcaagatccaagaatatcagctttaagatttgtttttctattctcagaataggtttgaaacagagagcaaaatacctacctgtatgccttctttagtgacagttgtttctaaaatatctgtctttcttctgagagaactatttgagtagtgagaattaagtaggaatggacataaagagattatcatgaagatggttttatgatcatcactgtcattgccattgtcaaagaggcatttattaaatgccagatttgattttagcattgttttaagttctgttacctgaagagaattcaaaatcacagtctttgtcctatgggaatttcaatctatcaggcagccttgatttagaaacatttgaagaggacataaaggtaacaagaatgaaaagagattggatcaatatataaaaactgaaagcatttatattacttagaagttaaaagtcaaaacaaatctagaatactgttgggatagtcagaataggttaggctgtgttgtggtaacaagccaaccccatacctcaggagctagcagaatggagtttatttctcacttcatacttcatgctcatcacaggttggcaagagtatgctttgtgtcatcattgttaagggacctagactgagggagcctttactatccagaatgttgctcgtcaccctggaagcaggaaggaaatcaggtgaattctgactggctttgaaaggtttctatccagaagtgacactttactttcacattcgctccattagcccaggcaagccacacggtaatgcatcactcgaagagaattagtaaaacagtaaagaaacacttctgatcaaatttagtaattattctagccacagtaatcagtcaatctaattagatgataatactattagtacttatcagcaacaaaacatgtgctaggtatcaaatgctttgttaagcaattcacacacattactacatttaatctttactgacttatgaggtgggttctatcattatctctattttccacatgatgaaattaaaactgggagtctttaagcaacatgcctcaggccacacagctggtattttgtagagctacaattaaaacccacttactcctaatttaagagtctgagtgttttttcaagattcctatcatgtcacagaagtccactgacttgttttgatcgagctgagaagaacagactagagtcacttctgacctggccacttagaattattaagaagtgtctctgctttgctagaaatctgtctttggctttgttggtatttagaaccagatggatgatgatgatgattattattattattgtaaaccgtcttccacttgttttctatttcctttctttaagggtgttagtgaataattctttctttcacccgggttcctggagctccttaagaattaacttcccaggctctttcatgtttttctggcaccatcttggatgatgagggcttagaacattttgtgactatgcccactgtctggaaaggcttgtaggtgaaggattctttaagaaaactcagatacttttctcaaattcacttatgatgatgttttcccaaatcattttttatcaattctatttttggtttctctcacttatgaattgtttctgtctccttcattttggaacatttttctagttcattgtttttttgttttttcactctccctccagtgtctagcaaaagcctaacacacattacttggatattcatatcttaaaaatgaaagaataaattagtaaagtggtggattcagaattctagttgtttttcagctcctctgccttgattacctctcaccaagattttaacgaagagtgctatgttaacaactgagccacttactttctccattattatataattttaataagtttggtagcatgttttctcacctgtaaaatgagaataatgatagcacccatctttcagggttagaatgaggatttgataatttcatgctgcaaagtacttacgatactgcctgacacacagaaagtactaccataacagcaacaacctctttatcctttgccttgggaatcaaatattttctacagatttcacttttcaggttttctttgtacactgaattgtacctaaaatttcttgtgcctcctataagagttcatcccgaggagattggttgcattattaccatatatttagatatttatttcctttaatctggtcatttattatcaggcaaaattcacccccaatatttcacataggttcttttctattttcccgaagtgttggcaggtctgagaaataaagggaaagagtacaaaagagagaaattttaaagctgggtgtccgggggagacatcacatatcggcaggttccgtgatgcccccaagccacaaaaccagcaagtttttattagtgatttccaaaaggggagggagtgtacgaatagggtgtgggtcacagagatcacatgcttcacaaggtaataagatatcacaaggtaaatggaggcagggcgagatcacaggaccacaggactggggcaaaattaaaattgctaatgaagtttcaggcacgcattgtcattgataacatcttatcaggagacagggtttgagagcagacaaccagtctgactaaaatttattaggtgggaatttcctcatcctaataagcctgggagcaccacaggagattggggcttatttcatcccacagctgtgaccataaaagacagccgcccccaaagtgaccatttcagaggcctaccctcagggatgcattctctttctcagggatgttgcttgctgagaaaaacaattcagagatacttctcccacttgcttttgaaagaagagaaatgtggctctgttttgcctggctcactggcagtcagagtttaaggttatctctcttgttccctgaacattgctgttatcctgttcttttttcaaggtgcccagatttcatattgttcaaacacacatgctctacaaacaatttgtgcagttagtgcaatcatcacagggtcctgaggcgacatacatcctcctcagcttatgaagatgatgggaataagagattaaagtaaagacaagcataggaaatcacaagggtattgattggggaagtgataagcgtccatgaaatcttcacaatttatgttcagagattgcagtaaagacaagtgtaagaaattataaaagtattaatttggggaactaataaatgtccatgaaatcttcacaatccacattcttctgccatggcttcagctggtccctccattcggggtccctgccttcctgcaacaatttatcatctgtttgggttattgtcccagggaatcatattttggtaagacacgtattctttttagcttaaatacttgttattataatacaataggcttaatgactttggctccatgtatagcaatgttttcatttgttgatttgttcttttattcaacacatatttattgagaaaaagaaaaataattacagagactcttagagctagaaagaatcttaaaatcttttaggcgaaattcaccctcacttgtacagacgtaatactaagcatgcaaaaagatcagtggcagaatttgcttcttcagtgtcaaagtagattcaatgagagcagcaaaggaaggaacatttcacttcttttcatcttttccttgggtaattccatttccctcaataaagaagggaggttcttccatgaaattaggagtttctgctcctgtaggtttgctttagtattagttgaaacattttgaatcaaatatgaagaacagtaattcatatataggctgaaggacctagattttaagttgttatggctggccccaagtctgcattgacataaggaatgtctagagtacattctcaggtctgcagccttgcattctgatgtcaagaagcttgaatggtgtcacagaaagggtgtctgaagacatggtgcatctgtttcctgtggcttccaagcaaattaccaccaacctggtggcttacaaaaatacaaactctcttgcagttctggagcctggaggtctaaaatcaaggcactggcaaagttttagtccctccagaggctctcacggtgactccattccttgtctcttccagtttcaggtggtgctcagcactctttggcttgttgctgcttcactccaaactctgcttccatcctcacatggtgtttgctgtgggtctctgcttctctctccgtctaacttataaggatacatgtgattgcatttagaacatgcgtggctaacccaggataagcaccttctctccagatgcttaatttaatcatgccttttgtcatataaggtaatagtcactcttttgccatatgagataacatttatccattctggagattcacaggttctggggattaagacagggactcatcttttccaggggctgccattcaactcactagacctgaatttaagttcttgttctttgactgcctttccatgattgggcaagttactgcatctctccaaaactagggtttctgctctgtaaaatgagaataataacgcctaatttacagggttataataagaaataaaagtggtaaatatatgtatttatatatatgtaaagttacctaacccagttcttagcataattagttgctgtagttccaggcattcaatagatagaacagattttaaactactttaaagactagtgtgaggctggcctatacttagttaagaatttgttaaagtttgatgatttggttgaaaaaatattctggagtgtgatggttaatccctctggagaaccctgactaatatactgagtaactacaaaatgattttatatttagttcaccattatacatagaatagccacaaaatggttttatattcagataaccattatttgttggccatgcctcatttaataatatttcctctgtctgctttccactgcttcataaccactagcacattttgaaacatattactatgtgatgtcaaattctttaaataataatgagttttagtttgagtaacaaaccagtgatgtctgtgatgtcacaggcctgaaaaaaaaactgttgcaatgatcttcattggctaaattaaaatataaagagtagtatagaatttatcatccacattttacagaattattgtttgagtcatttagggtttctattccagtctcttaattgaactgtactttctatatctgcaagtcaaaacactcatcaaaaaatatgacttcaaatatgatagccaacttttgtgttactacatagtgttaattttacagttttttatatgaaataactctctgagttaggagacaagtaaagaaatgttgccaacactcatagatatgaataacaacgtaatttaaggcatgttgcaaaacataaacttttaatatatccctctataaattcttacttttagtattcttaattctcagatattactccttttcatatgattgcatttatattcttgtttaattctctcttttttctacttatatgatttcctccccactgacttctgctcctccttcctgcttatagaaagaatgttgacctcaaatgtctattattttttcattcaatgaactacagtaaagttgatgtgtaggtgacaattagtgtaggcaaaaggtagagtaatgttgctttccaggtatcttccaactctaatattctgtggacttatatacttgagagtattcattctgcgtgtaagatctcacacttctatagctgatacattataatctgcctatgtctctttttatctgatctatagaaaaaatattattttcatatcttcatatgtttttgggttaccttaggctattaaaagaaaaataatgaagatgttaagatatttcaggacagtatgagtatgttggggtgtgtgtgtgtgtgtgtgtgtgtgtgtgtgtatgtgtgtgtataaaagattttactttttactcagccaacgctttagagatcttctgagtttccaagtaaatttatttgcttaagatgtgtctgtttgctttcatacagccattccacatcttccaagaaatgacttcaagaacatctgcttcagtactcataaacatcctatctgctcatcattttcattcttttacaacactcccactttcaaatcacatccaaaatggcaaaaagaacccaaagctaacatgattttagatgtcaattgtgtcctctctgtgaatgttttccatatttgaaatggctgtggaattatcttgcctctacccacagtaattgagaatgacaggaattggaaaagggtcatttcctctgtctcctgggattctgaaagctgtgttttcttttatacctgatcaggtctgccagttgcaaagctatacaatgtagtggagaactgcatacggttaattatgacaattacaatcagttctttacaatctctgctgctgttatgggatttaaataccataatgtatgtcaaaaggacaaaataatgttcctatgttttctgcttacagctgcttttatgattgggttttgctcataaacaggtggttataaagttgcaatccttccatgaattcctttatctttcctgtctcctaacctggcttccctggtgtgtcattgaacacaagtgttgagattcctagcatctctgaggtgatctcagatcctagacagtgtcccttgaatatgctgcaataaaaatgaaaccacttatggtcagcagaagtaggtagatgaatttagttaattctcaaagtctcccttgctacttcagacctctgtggtttgccttcccactgcgtcctgcaccttctctctattttctacctttgcttaatccctactttttcaattttatctcagtgaaacactgtgcctagtttcttctcaccattttggtctccagctcatagcatgttgtgaagactattgcatgcggacttgaatttatgtgctgttgatacttgggtacttgtctctgatgttacaagttaatccatacagtgcacatgtggtccctcactgttgctcaaggcagctggaaaataggtaaggtaatctttttctttcagcacaccttccgtctctgcagctcttacctctacctgaaaggtaggtataaagagaattatggccaatgaaactccatatgagagccctcccctcctccccagagtatatcttgcttaaacaacacatttacggttaatgaccatctggtaaaggtgacagcctttagtcctcctaattcttaactgtctgaaaaaatgtgcccaacctgccacggcttgtgactgaattataaaccatgaagcataataaagtcattaagtttcaacatgtcaaaatggactcaaattgcatcttgcccagaatttgatggcctttccccagcacttaagagagcagggctgtgtactgttcaaaaagcactttgtcatttctcgaagtactcttagctttgtgtggctgtctggacacaagcatcagcatctccaggagaaggaggaaatcgagtgaagtgagagcatggaggggccagtatgccacttcctagggaaaggcaaaggcatttcttctcaggaaaagagcagagaatgatgctgtacctcatttggttattgctcaccctcctgaatatatgattcattttacagtgggaaaattttggataaaagcttgtgctttacaattccgattacccttccccttttatcccccactatcaaaaataatcatattctataaacgtcagtggaaagtggtgagagtgcaactacgttttggagaaccaggtgtcagctctgtcagatttctatgaataggcacatctatatacactttttcaaagaaagaaaggtcactcgccaccctacttgtaaaactgtcagaggatttaggaaagaactaagttaggctgtcttttcacatgggaaaggaaatctggttctcaagatatttggggcattgcagtgaataagggatattaatagaattccacccccggcctctggctaagaacttatctgcctagaatctgaggaggaaaggaatctaagagttacccaaggctcagtctcactgcaataggaggggataacactgaacatggtggggcagatgtgggctttggtatctgttgctagtttatcctcccttcacccaccagcgcagtactgccatttcttctttcccctggaattctctatgtttagtgagcgagtttaagaatggaggatgctcagggatcttcttctcttatatagagactgggataatttgagtgttccatgttctgacacaggtggcatggatgaaggggtgtcactgaagaagctttggcaaaagctgatttacctttccaaaggctctgtgtcaggtgctggataaccgttaaaagaaaggaaagcaagccctctggcggctggcatgcagaaatgcacctgctaagccaatgagccattacaggccgtgccttcagattagagaaggacatgtcaaattagttggagagttttagaatactttatttattccagcttgtacatgaagttatcgatgcatctgctactccaagcatgttcagatgaaataatagaagaaagtctttaaggtattaaggttcatcttctgaaattgttcaacacttcttaaactgcagcaggcccagttgggcactgatagcaacttaagttgtcattactttgtgggattcagatctcgagaatatttatttagtgagagggagccagcaatttgtttctgtaggcaaaaggagattacagaagagagaccccctttgttgctgaattgagtagctgggaggagttgctggaagtgatgaatttaccccaagccatgaaggatgggtaagattagaacagataaaggaaatgaaagtgaacgtttgaaatataggggccacgggagcaggagtgggtttgtttttgaagtcagtagcaagcaagagttgagagtcagtggtaagtaattatgcacagagaaaacttggcaaatagataagaaaaaatcacattaatatttaaagtggtttaatatcaattgaatcacaaggacatcttaggtattcattatgaagctagagacagtatagcctctggacttaaggagtgggtctgtattcaaatcgtagttctgacacttctgagagtcctcaggcaagttagttagcttctctttgaccatttttcccaatctgttcacttgggatgagaagataatgtatctttagactcagatacacaaacattatctaaatccaggatgtagaagttgagtgcaaggaaagtctcagttgtccccaggctgcatatcattcaactggtgagtttccagctgctggtgtgcacaaacagaagctgaaggaccaatggcaggagaattacaaggcaagtttatgaatcagatggatatttggaccagatgacacccaggggccctccaacctagaggtctggtagttctaaaaattccatgatgtcccacaagagctaactgagatgtggggataataatgacataagtttacatcttacgctaaaaatgttgtttaaatttagttcaaaatgttctgttctatgtgaaaaaaatactatcattttatttaatgcaacctatcactgaaatgactatctcaagctgtttctctctatctcgtggagggaaggagtggaattgggggtagggtgcagggtggaaagaaaggagaggtaatactgttacccagagccaacatgttgctcttcaaaggggcttcagaaaatagaacaaagattccagcctgaatgagaaaggaggtggagagtttgaggaacacaaagctttaagtggaatttaccccatctaattatttgcgaaggaaagggtggaaagaaatgttgacagcaaagatttcatggagaacaggaacaataagaccctgtgccagagcactgtattctttgatgtaccacatatggagaagggatatagaacttgagttcagcaaggtttaaaaggcaaaatgtaatcacttccctttaattaactcaaacaatgcacggcaggttatgttaatgtgcctgtagctgagatagaggcagtaggctgccactaatacctgagagagagacagagagagagagaggaagagggagagaaagagaaagagaaagagagaggctcctgtaatgccagagcaggaagggcctagaaaccttatagactaattttacagatgcgagaacaagcctagcaaaattacagaactcacccaaggttatatggtctctcagtgacaaagtgaccataatacctcaggcctttaccaagttagtattctctctaagacactgcatgacggagtccatagtgatttcaagttagcccaggggttaaaactaaccatagtacatttgaatacggattaacatttggtgtgtcctttgaacaaaaggttaaatagaaaggtaaaatgtagaaaggtatctacacgtattcacttcagtcaagctttacttttaaagttgctttagaatattcttattaaaaccagtggtgattttcatgcagctgttttaattaaaatgttgtatgttttttataaacaaagtgatgaaaatttctggttatagccttgtagaagactgagcagggaaaccatcagaattgcaagtggagcaaaaatgttataatttagatcatgtgaccgaaataccaccaccgctgggtagaatctgcttaaactgcagctttggatttttcaggggtaaacaaacctcttatgaaaaagaaagccatgcattaaaattataaaggcacatgaaatattacaggaaagaatgagaggaagtaaagaaaactaacattcttctgttttactgctttcagggaagagttttatgaacagtttccaaaagtgttcttaagcggttgtaggttttattttgctttacaatttgacagtattttaagattctgtatttattctctttttgagctgaattatgcaggactaaacagatatcttttgtaaaaccttttatttccctgacagttaggagaaatatgaagtaggaaattctttggtaattgttggaggttggtatagtgcagtagataatgtccctttactgaatttattatcaaaatacacaagtcagagggaaggagatcaaaatatagcttctatttggtgatatactggtaaatgtttaattttcttccttttagaagagaggagactgatttatagtgttgacatatttttacggtataaatactccctccctggtgaaattcaagatgccaatgggatgtcactgaacttgaaattgggcagaggttcatatatttggctcttgcaagccagtgcaaacagtcttgggacagcactgcctgagtgcatcactcgtaaaggctgtgttagagagtgtggcctagatctcatagattagcagacttgttttaatacatcacttcagaatcagtcaaccttcaaccacaggtcttttcttctttggatgcctgtaccggtaaaactttcagcaagaaggagcaaagcaaaaagtgtgcttaccacaggcaggctggcagccaggagagttagtcgtctcccagactctaccaatctgatgaattcacaatctgaatcaagctggggaggccaggcatgtcactcagatggaaggaaacaacgaaagtgagaaataaatgttaactcttagcagcatcagaattcagaatgattcttagaaaaatgttacagggtttgtgtcaacaagaaggtcagaggcagaactgtattttaaatatccaacattttggcatatagctattctagcaaaagcatctttgaggctgtcatgtggcaagaattgtggttatcagaaaaaaaaataggagtttttaggttacacttaaaatataaagaccttaatagacctttattttatagaaagatatggaagaataaatttatattcagttccttcaaattaaattattttttcaactgggtgtaactgaaataaatagggcagccatagtaattttacttaagcaacttcattgcctcagagagcagatgatgaactattttagtgaatatatgaaatgatatctggcaagagaaaaatacttgatcatctcacttccttctagttgatgttcaagagtccctgcatccagatttacagctctttgcttacacatccatcattgttaatatgccaataccctgacgaagcaagcctggtattggctgcatgagtcagtttttcctggtagagagtggtttattattcttgttgctgctgttgtagtattaacatctgacaatttgataattaacaatgattataaattagcttattactataatgacatgagtctaagtggacatttgatatagcttatttttgagtgtaaaaattctggttctaagtcaggtgtctggaagtgttttgttattatcaccgtgctagaagataaaatctgagttctgaatcaacctactttcttattctgttgcctgtgacattgaatctcatgttcatatgttcatgtgttttatgttcatatgtttttacatttgcttccctttgttagaatttctggttaggtgtgacccaaaactcttaagtcaggtggaggagcattttaggactggctctgccatttaacttaaataataagttattaagttattataacttaaataataagttaatgaatctttccaaatctgagctttctcatatataaaataagaatgctaatgcatctacctcctaggcaccagtaaagattaagtggaatcatgtatatagtgtgtaacacattttgtgtgtgtgtggttagtttctttttttttttttgagtttgttttaatttttagctttctcaaataagagaacatgtgaagtttgtctttctgtgcctggcttatttcacttaacataatgacccccagttccatccatattgatgcaaatgacagaatctcattcatttttatggctgaatagtactccattgtatacatgtatcatacggttttttttactattatactttaagttttagggtacacatgcacaacgtgcaggtttgttacatatgtatacatgtgccatgttggtgtgctgcacccattaactcatcatttacatgaggtatatctcctaatgctatccctcacctcttcccctaccccacaacaggccccggtgtgtgatgttccccttcctctgtccaagagttctcattgttcaattcctacctatgagtgagaacatgcggtgtttggttttttgtccttgtgatagtttactgagaatgatatcatacattctttattcattcatctgttgatggacacatagtttgcaggggtacatgtgcaggtttgttgcatagctaaatatgtgttatgggagtttgttgtcagattatttcatcacccaggtattaagcctagtacccattagttatacagtaatttcttaatacatattataacatttgttaattgtataagttaaaaattttattactataatatttgttaattttataaattttgtatgataaaatacgtgtattacattcaatgcatggctacaattagtccacgtttaaggactgactcactttctagaatttggcaatactatgtctctcaaagttttcctaatgaaataagctatttatctttccaacccacagctcttcaggttcacatctatttctttgctttctcactgccctgacttctacccttccctttttgtctccctagtacccaaagtcctcttccccactgcacctgccattcttctccaggtgaaagtctgatttaggaaaagtgtatgagaaactctcataataaagagtgcatttgtattcttaaagcattacagcagagctaaagcctaagagtataatttcaatattcaggctgtgggtaagagaggtatttgctcagccgtagattccttttgatgcctctgaaatcactgtcatatctgtaactatctattgtacagtccatatggcaacctttaattatacctgttggaataatccacttagccaaagtcaagcatcctctgattacgtgttctcttgttatttcctagttgtcatatatccttggcagctgtcatcagccgaatttggtgtttctaatttttagtagctgtcatcctgtcccaagtttctgtaacacatgcttcggccttgccaaacatgatttgctttaacagttagtcataattttttgggccttaccttggcgggctagtggtcacattttactgtaggtgatctttacaagtgacttcagctccctcttctagctttacctttttttttaattgcacaaaattctatgtagcatgtcaatcgataggcaaaaaaagatctgttagcctccattacccaagagtgggccatatttcagtggtaggtaaatttggtccaatagttatgtttgaaatgccaacaatgaataaattaaattaaaatttattgagcacctacagtgttatagttatttgcttgctaatttgattttaagtgtgtgtataagtatatgcatgtgtgtgagtgtgtataatagaggctattcttttcaaggtcatacagctactaagtggaaaagctatgaattaaatgaaaagtttcctggctaagaagtccttgctttgtcctcaaaataggtttttgctaagcctacattagttagaatgggaaatatatatagagatatatgggctgggcacggtggctcacacctgtaatcccagcaatttgggaggccaaggtgggtggatcacgaggtcaagaaatcgagaccatccagggaatattgtcactgaggtggagtaaattaagcgtatataaaaatacaggttgagtaaggttatgatagctactgagtaaggttatgatagctggccaacatggtgaaaccccgtctctactaaaaatacaaaaattagctgagtgtggtggcacacacctgtagtcccagctactcgggaggctggggcaggagaatcacttgaacctgggaggccgaggttgcagtgatccgagatcacgctgctgcactccagcttggggacagagcgagactgcatctcaaaaaaaaaaaaacatacaaaaaaggtatatatgactatagccctttttcttcataaggtttatagtcttcaacgatagagtgacttttatgtttttctaccagaagattcgaagttttgtagagacaaatgtttatgacattattactttggtaaagttcagtaaagcaaacaaacaagatgaaaacctgcctgctgagggttggttaatctcttctgaaaaaggtacactttggtataatgattcataaaaagcatgtggacactttacagctttacatttagaataaaacctgtaatcccaatgcctgttctatgtgttatacctgtgttttcctgaattatatgtctgtgtacctcctctttatacagtgtttcatctaaaagggtggcatttactgctagaatttgagatcatgaaaaggaatgattttagcacaaaaaaaactaaacctgttttctatcaaattctaagaacccagaggcaatgaatgctactgtcaaaaataatttgaagaaagtgtatctgacagtatttttcaaatttagctacaattttggttttactttggggtattgctccagtggagattcgttcatgattgtataccttcctagaatatacagatttttcttattaggcattctaaggagagcttgttactgacattctgcagaactttacagtcatagtatttcatctgtaatattatcttatagaatataaagattttcctgtaaaaatggaagtgtccccaagcctgtgtttctagtcatgtttcaatcactaagtagctttctgacctggtcaagccactttaccatctttctgggtcttctttcctcattggtaccaagaaagggtcagagtatttgaaccttaatgtctcttcttagttccaccatgttgctatgcacaaccctcatccactgcttatgactgctgtgtaaaacactccaacctcagtatgcctacaggcattccacaggaggtctatgaagcttttcacagttgcaaagtcatttttcccctttggaaactggacttcaataccattttggttcaacatgtgttttcttacactgataacaagaatgggggctcctaaaagcatagatgttctttatgacatcaacctcgaaaatgtaaaggatatattcaaaatataactcctctaaagtaagtaaccatttatccaaaaatttagagggtatattcaaaatataactccccaaaaataagtaaccatttataaagtaactaatgtaaatacttctggattctaaaatgtatattgggttcttgggaacttgaaatagcaattattttataaatcctttgtaatagtcaatagcaaagtaagatcattgatgtgtgtttactccttgttgtctcttcttatacgtttttccagaggatgaagttcagtacagtaataaagtaaaattaaaaaaaagctaatgtatttgtagacttctaaagtcttcaaatatttattctgccctgttgagtgtcttatggataggtaatattatctttaaaggtgatgctcaactttcatgctgttttatttgtttttttcttgagacagagtctcagtcattctgttgcccaggccggagtgcaatggtgtgatcttggctttctgcaacctctgcctcccaggttcaagtgattctcctgccttggcctcccgagtagctgggattacaggcgtgtgtcacaatgccaagctaatttttgtatttttgtagaaacatggtttcaccatgttggccaggctggcctcaaactcctcacctcaagtaatctgcctgcctcagcctcccaaagtgctgggattacaggcacgagacaccacacctggcctgtgctgtactatttatttttttatcccatggttacatatgttatgcaatgaaaatgttttcatgctacacatcaagtataaaactcttcaggccagactcctatacagattaagatggcatatatgaattgttttttttttctttctcccaaaggcataggttaggcatatttactgtctttgccaggccttttctcactttttaagacatccgaatgtgtagatttccttccttttcaacatttacattggaagatgaacatatttagaatgagccaaaagaaaaaatgctgcataaagcagtgttgaaggaagttattctggcagtcttagggttgaaattcgcaatccattacaagcatggaagctgtagagccttggatgaggctctacaaggattgggatttgtagaaatttgatgcgtccaaactctgtaattaccttaaagaaatccaagctttctgcaattaaaaatgtgtaattaaaaagtcatccagtgtgtgtgtgtttgtgtgtgcgtgtaatttatatccataaatatgcatctactatgtgaaacatctcttaagggatatgaatgtatgctgaaataattcagctagtgtaaagagggaaggaaaaaataatttatattactgggggaaggcagtcagatgaatataaatggggaagcaccatccccagcagagataataggttgagaaggagctataaatagggaaaatctgggtgtgtatggaaaaagtgacttcaacatatgattaattagaggtggtggggaaaacaatcaaagaaatatcaatgtgtagtaagtaaaaaatgtggaagggtggtgggtagaggagcaaagtatagtggaggttactgaatgcacagaaaaataattaaactcttaggttatacccttatccaagattctgaattagtttcttctactcagcttttccggggatggttagggcttctacagataggaagtagaatgctgtgaaaagaaggtacacttacgaaggaaagtttctgaaaataaaccagaaaactaatttgctaggggagttccctagtggcagagagtttacaccatgtgttgccctttctctctgcacttccaggaattccatctgcagaaggtgagtgacaggccggtggtgctggtaaagtctgtgctgaggcagtaggagagctgatgtcaatgacaaggcaacccttgactgcagccctgacacctgtctggggaatttagactttagtgacaatccttgacctgccatgcaaatctggagctataccattgaattattgcccgtgattgggtgtggaaatggagagctttgtgggccaggaagcaggcagtttgtaatgtgtggatttttagcccggcaagctagatgttctaccttcactagagtaattttaattcattctcttctgaagaaagaggtaaagatgaaggttgtctagggaggaggaatctcaatatttttcttcattaggacagttataatgttgagaccaaaaagatgtaagtaaaggtaattaacaaagggcaatctacttcctttggagcttataaattcctcaactacttagaaatgctactctgtctcaccctgacatttgatctttgtacttcagataggatttgacgtacgtttaagttctcagtggactcaggtttccggaggacttttttgttaactgctgattgaacctttattctgctccacatgattcctttgccagcttgtttgaagtgtttgttcctggtggaaccacaacaaatatgtgagctcattttctttctattaggtaaggtctttagagtttgggatttcaagtattcagtgtttcatgccttcagtgttcttttagaaatctgtatgtattcctacatttttcacaggcagtaatccagagaatctgatatggtttggctgtatcccccacccaaatctcacctcaaattgtaatccctgttatccctatgtgtcaagggcaggaccaggtggaggtaattaaatcacaggggggcggtttcccccatgctgttctcatcatagtgagttctcacaaaatctgatggttttataagtgtctggcatttcccctgtttgcaatcactttattctgccaccccatgaataaggtgcctgcttctcttttgccttccaccatgattgtaagtttcctgaggcctccccagccttgaggaactatgagtcaattaaacctctctcctttgtaaattacccagtcttgggtactccttcatagcggtgtgagaatggaccaacactggatcaaatctggcttatgtaaatctggaataaagagtaataaaaccaaccagatgctaataatatgacgccacctcttttctcccatccaagatgtgattctctagattttccagtctgatgatgttgtggagctcgcagttgacctgtatcttcttgatataagttccatgtggttgagcttggcgtttataacagaacagcaaaaaatgggatccctttcatcagaattcccctctttgcccccacactttgtagcaattccctgtttgccactttcaactctttgttgatctaattattggtatgtctacccaagaaaatcttaagcttatttggggactgtggtcttgttatatatatcatctcccgagatactagaatagcttaagtacccaattattattcagtaagtgcctgtttactgttggactttcttgaaaattcatatagaataccttcattttcttcacactttggtctgtaaacagtgtggaagtagtgaagaagacacaaagtcactttagacatgtttattactctcacttttatcctctcccctccatcagtgaagactcctacttgccatctttcctctaaagatccttagtccctgagaagcaagagctactgaagattatatcctaataagtttctaaaactcaaaagttttggtaggaaagaacatgtaggcttaattcctttctctttgacagtttggcccaattggatgctcaggtgtaatatgctattattagccctgagatgaaaatttcagggccaaaattattagtaaaacacttaacatttattaaatttttacagagtatttaatgtgtaaatatttactgcactgggtaccttatatgcattgttacatttaattctcattataatgatttattagctattacataggtatttttactatcatccttatctatacggagagtgaggcttgatgggatcaagtaatttgccagtgtctactagctcttagatagtaaattcagcattcaagttcatgcttaaattctaccctctatgccctccatcttatataaaccttaactccaggaaaaacttacctgtcttgtactaactgtcatatatttggtaggagaggcaaggagacatttttctaatcacattctttcagtatgtgttgggataaatttcaggggttggaatttccatcaagtgcacatgtacacctcttagaattgtcactttaggttatgacaactaggatgcattttttaaataaaagaagtgtattttgtatatgtattatatactgtattcttacaataaagtgagctaaagaaaagaaaatgttattaagaaaatattaggaaatattaagaaaatgttattaagaaagagaaaatatatttactattattacctgaaagtggatcatcataaaggtcttcatcatcattgtcttcatgttgagcaggttgaggaggaggaagagagaagttagtcttgctgtctcaggcatggcagaggtggaagatatggaggaggtggaaggagaggcgaaggaggcagtatattcagtgtgagctttattgaaaaaaatacacatatgagtggacctacacagctcaaatgcatgttattcaggggtcgactgtaccttgataataacatcactgccattaccgtattctgagttggtggtataaatggcatttttctaggtgatcgttatatatgtgtatcatgtatattaccaggtatagtcctgtaatagttccacctttctgcataaaagtcttcacaaagctaaactgagagttatagtaactgtaattatggaaggtaatcacaacaggaaatatgttatatgaaatacaacttttacaagttgttttacagtttgtgttatatgaaataacaattataggctttgttattctgaacattaatttgcattagccaaacaggagattcattttaggaatatttgtatctgtctactctttctattatctatatataccaataaacattgacaaacatttaagcattagaatttttgtctcaattgaatgaagctttcaaagatgctttttcttttttcttggaatcctgttgaatttccttgaaaaataaataagagttcacaccttctcagagtttcctctgaggtgttttgatactgttaacatgagcatcaaagtaataccaactcttaaaacacacataattacttaactatcagtgtatttctaagaaccctgtcatatgcacccttcttattttatgctcatgttgtaaatagacatacatgatgctgtgctgtcatagagaaaccatccatgttcactgcttaaagaagtgagtgtgagtttgagtgtgagtctgtgatgtatgtttagtctgtaataacaattctattaattcaatactgttttaaacatgcactcacatcctgtcatcagtaaaaccaagtgtcagttatccacacaattaatcaagttctcactcaggctttctagtaattcaactagtttcccatttccttatttcttctaggtgacatagttgcttctccatctgtaaagccagtataggatattttaattatttagttagcaatgtttttattaggcactcttttaggcactgacgatattaaagtgaacaagacagataagtccctgtttccatgtgaactagagtttacattccagttgtactagtaaacaactaaaacctctacataaggcagtttaatattgaagaatgtcctgaggaatatgaatcagaacaatgtggtagtggtgtggtatacacatactatttacttagggagacctttctagttggtgacttgaacttacacatgaatgagaagtagctagtcacaagaatatctataacaagattgttataaatagcaaagatagatagatagatagatagataaatagatagatagatggaaaaagccctaaagtatgaatgagcttggcagatttgaaaaatagattgactagtagagagtggatatttgcgaagatttattactaatgatagatctttaaatatccacatagctttaagggagcagtaaatttagcttaaggttagtaaaatgttcagtaccagcaggatatccctataagattttttaggattacagaacttggataaatggtaaattggatcaacatcatgccaattaaatttgttgtatggtctgttttattaaatctctaattcgtatttatataatgtataattataacttgctgcttatacagaatggttacccgtttagtattttatctgttcaacaaccatttactaatgtcctatcatatgcaagatagagtactaggggctgagtatacaaaaataaataagaccactctgtcatgaaaacatgtacaaaaaagtagataacacaggatttaaatatatttagtgggaaatatgttttctcagtttaaacatataaaaattataaagtggaatttcagatgagagtggcattgatagatataagtaggcatagctgatgcagagaatgttaaaatataattttgcaggtctgaaaaaccatttgacatttccttgtaattctggattaatgcttatatgattatctctgccacagtggaaaagtttataaatttaaattaatggaaattgctgttgatgaaaccctctagaggataatacatttctgatatgcctatagggctccgtatttaagctaaactcctgcccaagatgcaggatgatgaagtcctttatttcggccatcagacctattaaaaccacgagtatccctgtgagtccacaagtcaggctacaatacaacatcctcaatctgacaagaaaatcaactgatttactgaatttatatgaaccaattcttatatgcatgacagccaaaaaagttccaaaaagaaaacaaattttgcattagtatgagattttgaggttaggagcctacgtttagaggtttatcagttcagcccccgtatggagctatccagggtgctgaacgtgctctgcaactcagtccccttagtctctgggcttgacctattttttccattgttgtttcttatcttcaccttttattccctacccatactgcctgctctgattgctctttgtatgatctcatcaatcatatgtgacagatttttgtcccgacccttgctatgccctacattctaacctagtacattcttcaacccatgtttagccaaatttcaattaaaatttatacctacagccttcccaacaagtgccttgactctcaattttgtttcttgaagcaatgagatcattgatttgatctctaattataaagtaattaaaaacaattttatttcagtccacaaatacataaatattctaaaaaggagcctttaattcatttaataatccataaaaataaactgaaaaatcaagcgtggacttctttgtcactttcctctttttcattgtgaccttctctctcctcccacttctccttcctcctcatcatcattataaattcaatgagtcagaatggtttaattgaaattcttcatttaaaaagtaggatcttggtaaaatgtaggttcaaagacaattttacaatagtttaaccttagtagatgaaaaatagtaaaagtataaacaactcctgtgaacatattgtctttgaaattggtaaaataaataaaattgagatcacttcttactgtacatctccagcttattttaggatgtatctcttcctttctgactggaagactcaaaatacatttagagagttggagctggtgttgacagtcaatgattagggcaaaagttttgcatgtacttcacctctgtatttctccctaatttcatccattgtaatttaagaagaaggacatgcctgaattgaaaagttcaacaagtgaacttttgaataaacagtgtagatttttatcttaggtccaccaatccctaaccatgtaatcttgggtaaatctttaactctatggatctatattttttaaatttgcaaattgagaataataaaacatcctcacactgaagattcctgccagaattatatgagataatgcatatccaaagtttagggcagaaactgaaacctagccaacattttaaaaatgtgaattattgtcattaacttatcctttcggtgcttcacctctccatacattttaagatactctggtcattatgagtacttgccacaagtatataggagataaaagatttattttcccacccattattaggttcatagctgaggtatcctgtaataagagacagattaacaggaaaaaaagcatacaaattaatataatttttatgtgacattggagcctttgaagggaagacccaaagaaacagggaatcctgtgtattttagactttggtttcataaagagtggacagtcttggggaagtatggctggacaaaagtgggcatggcctgatggtaataagctgggggaaacttagcaaggcctattgttcagattcttcctggtgtctctgtgtgttcagctgctttcctctagttctagagagaatacctctgaatgaaggtctttatgatttgctttagatgaaagtcagaggattattttatggtctgcttcaggggagaagagtgagagaaagtcaaagagatctttctgcttctgctgctttctcaaatgccaagttgctgtattttggggtagtatgtcctgaaccccatcaggtacttgacatttcatgaaggtaagctgatcaatctttcatccatggcactcattaatgtctcaatttgaaatgttgtgagctatgaaaaaaagacaaggaaggtagtgcttatctactcatgaacaaccattattaactcactattaatcattgattacaattgatctattggccatggtattgttgtgaactttgaaatatattgtattaacatttctatgaaaatggtggttgaaattctgcaggcagataatgcagtgttaacataataagtaaaataattaatgatagtgaagttgtaaaagtaagaaggttcaatgtgcttgaaagtcacagaattttgaaaaatgcaagagataaggaaaactgatgaacaaaatgtgacaacttgagactggctatgcatactgaaatgaaccagtgacttttaaactagaattcttagagtgtacagcctacagaaatgtaaatatggctaatacaggtaactttctaatttaaatacctatcaaagcttctgttggaagaaaactagatttatacattgtgacatgctcaaaatccttgtcttctccaacaccatctccagtaaaatactcctagcataaaatttattaaagtgaatatctctgaaattaggttcttttggaattaaacaaaagagaccatggttttccaggcattgttgtagatgtcactttataataagacagataaggcagtcagtatacagaggtttggttttatggccagaactaacatttattcaatcaatgagagagatcaattagagcagcattacttctacagtgggaaaatttcagagcccctgaaatagaacattattgttaaattatcaaatatgttacagttgttgctagtataatgaccctttctctttatcagaatcagggaagaaaaaagccaaatggtgactaatttatcaccaggttcataactaagttaccaaaagactgaaactaatcaggtctgattttcaaaataagcaataacatttaaagcatatttgaatatacagatgtttggatcactgatatcctaagaattctatagtctctgctgattttaaagtcgagattagattgttcttgtatacccagagaagcatagctctaaagggaaggtgttctggggaaagaaaagaaaaaaatgacgttttcatcatcacactgaaaaagtgccaacaaatcctaagtaattttgtgttgattatactaaattagaatagtgatggctataatcatttgatccctgaggcattaatgaaaaatcagcattattttgtgtggaatatgtattattatccttgagcttaggaatgattattagtaagtctgattaaatctggaagcagtgacacaagctatctttaacccaccaatgacagggctatattgtaaatttatgatgaatgaacacagtttagcatttttagcacttgttggggaaaataagaagtctgcattcattttcttgattagactgcaaagtagtacagagaagctcataaaaaattcttcataatgaaatagtgttcctactgatagattaacctatcatagcttccaaaattcacaggactggttatccttgtatgatcaaagatattattcagcaacattctggagatcatgaattcctagatacagaagtataaacaataaaaatactaccatgttgcatgcatgtattaccttcatctttttttttttttttttttttgagatggagtcttgctttgttgcccaggctggagtacagtggcacggtctcggctcgttgtaacctccgcctcccaggttcaagcgattctcctgcttcagcctcccaagcagctgagactacaggcacacaccaccatgcccggctaattttttgtatttttagtagagatggggtttcaccatgttggccaggatggtctcgatctcttgaccttgtgatccacctgcctcagcctctcaaagtcctgggattacaggcgtgggccaccgcacctggcagtattacccttatatttttaaatgctttcacatttactttatggtattcttatcatagtaacttaagtgagttagactttttaccacctgctctatcagtaagaaaactgtagcacaatccagtggaggtatttgctaaaatcacacaggttgtcagaaataccagtattggaaccccagggtcttggtttcaagtctaatatattttctgggcctcagtttagccattaattttataattacagacaatgtttttgctaacatcttgaattctttctttttaaaaagatgtctattctgtattcatagaaaatattagagattcttactgatcaaatggatcacagcaattgtttaattttaattttcagtgctaggtaatggagctcagaacacactgactcaaaatttggcatttgaggaatcagcagaaggaggccgtagaaacttgaaaggaatctacttgccccttcttccctgaagcagtcatgaaagctaactgaattttcccagaaaataggtcataagactattatatcagaggcgttcttcctgtacctggaggaaaagaatgtccttatctctgaaaacatagggacactgaaaagaatctgaacaagtaggccttgccgtgttacccccagtttattaacattagattgtactcttttgtcctccaattatacttccatgcacgactgtccactctttatcaaacctaagcataaaaatacccagatttccctgtgtcttcgggccttcatttctgaaggctcctgtgtataagttttatataaataaatatatgcttctttatgaatgaatataaattttacttaatataaatttatgtaaatttaatatttttataattataaaattacaaaaatgattgtaattttaaatcatatataaatttattataaatttatatataaattttaatataaaatatacttaattttacttaatataaatttacttaatataaattattaagtaaatttgttttctcttataaatctgtctttattacaggagccttatccaggaaccttgtgatgtatgagtaatctttctcccctgtataggcaaaattgtttctaaaatccccatataatttagggcaagttctgatccttgcatagtagcatctgacactcagtagtaacttgattaaatattagttccttttttcctaattcccaccccaaatgctgtgaccctctctgcactcaaaagacaaaatctttaaaattcttagttgatctgaaatttgtgttgatggcctacattattttattgttaaaactatgattacaggtgactagtcagtaacaaaacataaaaattgtgaaagtacagccaaaccctgttttaaatgctagatggagttagtgttttgtttccatcaaagccacaatatttctacttgaaacataggccagggcagtggctcacgtctgtaatctcagcactttgggaggccgaggtgggtggatcacctgaggtcaggagtttgagaccagcctgaccaacatggagaaaccccatctctactaaaaatacaaaaaattagccaggcatgttggtgcatgcctgtaatcccagctactcaggagcctaaggcaggagaatcacttgaacctgggaggaggaggttgtggtgagccgagattgcaccattgcactccagccagggcaaaaaaagcgaaactccatctcaaaaaaataaaataaaataaaataaaataaaaaagaaacatagctttgcaactgaatggcatcccattcacttagcatcataatggaattctgttgaatagcttaaatttagggcaatcagagccaaagactcagttacggagtaactgtaggtcccgcttggcatgtgacagattagattccttggagaagttaaatccagaaatgagtcattttaataaagcaaaacacataatataaagggtatggataagaagctatgaaaatgcctaggatagacaaaaagaaagatatcctgggatagggaaagggacatttgaacatcaaattaagcaaagccatgaagtttggaatttttcttggcattttcttcccgtaccctgcaaatattaaatcaattgtcaatcaattgtcaattttacctttaaccatttctcttcttcatgtctttctccacacgatcactgatctagggtgagctcttactatctttacttataataggctagtttattcgctatttctatttccaggcatatcactctcaaaaccatcatccagattatttaaaaccttaaatctaatcacatctcccacttgcttgaaaccattcaaagtcttctagttgcctacaagataagatctaaacttatgtttctctgtggtctggcttctccttacctgtgccacctcctctcatgatgagccattctgtgatggtgcttcagcctgtaaaattgtttgtggtttcaaaaatattgcacttcatttcatgcctccataccttttcctcttcttgtaatgccttttcatattcatctccaacagggtaagttctgcacataattcagtgtcccttttccagtttgatgttgcagctcttccttcatctcaaatatccactggattaggtacatctgtgtgtacttcatcttatccatcctgttaaagaaaaaattatagaaggacaattgttaaagcatggtagggaaagttttatttaggaccatcatgataaatatatgggccactgcaatggaattgtttgcagtgtaggagagagaatgggctcaactctgtatatagcatgaacaagtgagaatttttaaccaaggaacagagtagaggtcagcagacagacaatgactaagaggtaacatcaggagtaatgggaattctggctaaactgacctaacagaattcttgctgaagacaaaccaatgtgatcaggtatcacctgggagttggtggagaatgaagaacttaatcaggtatcaagagtaatcagatatctaaagtggggcagttcttactaaactgacttagcacacttcttgctaaaaccagattttacaaggaagtgcacagatgagcctaggagaaggtagaggggtctgactaaagttttgatcaagtaaaaaagtctttatcaatcttggtatttcccgttaagcacaatgcttggaacataatagttgctcaacaaatgttggctgatctgattataagaataacatggatagatcatcctttgtaatctataagttttttaaaagtttatttttaattattatgaatacattccagttgtacatatttatggggtatatgtgatattttgatacaaacctgccatgtgtaatgatcaaatcagggtaattggggtatccatcacctcaagcatttatcattttttttgtgttaggaacattatacttctgctcttttagttattttgaaatatacaaataaattattgttaactgttattaccctgtaggtgttactgaacgctagatcttattccttctatctaactgtgttttcgtgccttttaacaatccccctttttatgttcccctcccccactacccatcccagtctctggtagccatcattctactctccatctccatgagttcaatattatttttagctcccacatattattgagagtatgcaatatttgtatttctgtgcctggcttacttcttaacataatgtgcttcattccattatttcttaacataatatgctttaattccatctacgttgttccaaatgacaggatttcagtttcttagtagctgaataatatttcattttgtatatgtactttattttctttatccattcatctactgatggattcttgggttgatttcatatcttgtctattgtaaatagtgctgtaataaacatgggagtgcagatatctctttgatatactgatttcctttcttttggatatatacccagaagtggcattactagatcatatggtagttctatttttagttttctgaggaatactccgtgctgttctctatagtggctgtactaatttattcccaccagcacactagagttcctctttttccgtatcctcatcagcattcattattgcctgtcttttggataaaagccattttaactggggtgagatgacgtcttatcgtagttttgatttgcatttctctgatgacaatctacaagttaatatgtctgaaaatctctcagtcatcctatcatgtttctactcttcaatgggaaaaattaatttatcaagccagattgtcatcttttcttaaaaaattacatgatatgaaattcacagctttcctattcaagtgagtttttcttatgtccagctagaatcccctttgggttaatataagtctttagtgtacgaatttgaatctttgcctgaggtgctacactgttggttctcttaaaaatttgtggcattatttaattcagtaaaatttgtgtggattgatttgtatcctttgaatagttagtattatataaatatctcagtctataagactcatccaaaactttggaattggaagtccaatctcctctccattagaagtcttgtcttggacatccagtctctatttaatccaatgatatgctccctgatttatctactcagactttttattgttagttaggtttattctttattttaaactgagatccgtcatcacaaaagccattcccatttacctgttgtcctttggctgtattgccctggttatatattactgggttttgctaaatgtttcctatcttttctttcaagttaaatctttatgtctctgttagattatcacatataaatgtgtaaaaacatagatattcctgcaaagcttacaaggaaacaataaaacagaaaagacttgatctaactcctccccacctcaatccagagctattactttcactcttttagttgtttcttctgattttacttccatatttccaaacaatgtggttatggtgctatttttattttgatgtctttacattcaatacatcaatgttgattttaggttttattttataaatatcctcaattttatcttccaattcttttgttgaataaatctttgctaataaatatgtatatacatatatttattatatatgtatatatatttacatataaataaatatatatacatattttaatatatatattttattttctaagggctttatgttgtattatttcttattttgatagcattcagattgcagtttttaaaagatacaaatcatttcttttatcatattaatgatgaggcttttaaaatcagttttctattctctgcattgtatctcttttttattccattttctttctttcttttctcctatgtaccttagtctcttgtttcatatttctattagagcctatcctacattgtctagttaatcttggctgtttgttgtcacttaataataaaactctaacaaaccattagaaactgtataattatagcaattttcaaaattattattagtgggtgaaattcactaaatctaaataggtggggatctacccattttattaagagaccaccctccaaaatgtcagatcttttctctcaagtcatttttttttagtaattcagtttctgaagtcttagttttctctctgtgcgttttctgcatttaggtggatagcatcttcataacagaggagaaaagggagtctgttaggcagattggtctcaggggtcagtatataaatttacacataatcctactatttttcttataacttcgcactgctgtcacagcctgagcctcttcaagtcagattccaatgctcttcttaaacagattctctgagtgtgtttgctgatttttgctgcagtggagagggtatttctcagttgatgtgatccttatataggcttttagtcactccatctgttttcagccccactgctggctctgccttcagaaatatgtgatgcctccaagttctctaactttatagggttctacagcaaaatatccttgtttactactggcttctttctctgtaaaaacttagctttccacttttttctgtcctactgtcaattaccacacatctatacacttttcatcttccaaatcttgttgacatttctcctctgctattgtcttttcatccagtctcttttgctactgcgaactatacagcctttatttttttcacaaccattttagtaggattttgaaagaaaatacagatagaaagcttgtgtttagtccaccatacttagtgagaagttgccataacatttttgaagattgaatgtacagtatggaatatgttcattatctcagtaccatgtttgggctcataaaaataaaaatagcagacatgagtgtggcctttattcatttgttcaacaggcttttactgcttgcctatcatgggaatggcaagaaacatcatttcagttaactgaaaggacaaatacaatattcttagtgatctccttccttcagttccccacaggaaatttgaggttgataaaacagcagcaaaagcatatttttagaagataaagagatggttcgtatgatgtacagaagtctacttgctactcaaagtgtgatcagtggtctagcagcatgcatccctgggagcttattggaagtacagattcttagtctcctctctgacctactggaacacaatctacgttttaatgaggtccccagggtagtcttaaaattggtccaagggaaaggattttattagaaaaaaagtgaaccttcttttatcccacctagggttaatgcataggaattttatctgtagtcaagatcataggcaccatgtgaagtgattttcttttctttctttttttttttttttgagacaatgtctcactgtgacccaggctgaagtgcagtggcacgatctcagctcactgcaacctctgcctcccaggttcaagtggttctcctgcctcagcctcgtgagtagctgggattacaggaatgcaccaccatgtccggctaatttttgtatttttagtagagataggatatcaccatgttggccaggctggtcttgaactcttgacctcaagtgatccacttgccttggactcccgaagttctgggattacaggcgtgagccactgtgcctggcatgaagtgattttcaaacatagttgatcataagaaccttgaaggggattatttgtttaaatgtagattcttctttcttttacattgtcgtaagtaatgtaatcaatgtggaatagggctgtaaacctattttaagggcttctgagatgctaatcagtcagatttgggaactatcagggaaaattttcaacccttttcatcatgatgtctcagggaccaaatatcttccatttgctacccaccacttcctgcaactcctaccagccatcactacagatgtatcatatcagatcctattttcttcatctttgccttctcctcaaatcatgtatagtcttgagactcatctgttcagttggcagagtgtcttccttctcccaagacaacatcctcgttttcatttttcccattcactctgtgccactgcttacctccatgcccaaatctccagctctctctttgctggcaggtgtcatgttctgacactgatttggggtcaagtctggggttctgaatcaggagcctgtgtttgatggggagtagatgccagaaggcattgacaagtggcaccatgcaggcgaataatgcaagaagagtcaccttgtgggaaaattgatgcctgataatctgtcccaccagggtgtcaagtccgagagtgagaatccatcaattaaactgtgggacggactttagagaggacagacttgagcacaggggtgtggagaattggttatggaagaaattcccaagcgaaatgaatatagttggaggaaatgtgaagagggtggggagtttcctgggcctctgctggaagagcagaatgtaagagttgagaatgttaaaccagcttgcataacgttttgctgaacagtttaattcagaagccaattgagatatctgttattcctgacaaactttaaaaggttctagaactggcaaaacaactaggtctgagcaaagtgaaaagacatagtgtgaccagctgggacaggaacgctgcaaacttgctaattagtctggaggaagccaattgcccacatttttatgtactgctaattactaaagtagcagcttgctataaagacaaaaataacagcatgatagtttcttgaatataggataaagtggcctttgggatgtaggctccatcaactttaaaaatattctgtagtttttaaacttaaagcatacagtgccgtaataaaaatacactttggaagtcagttattcacttttttccataggctgttagatgagaaattatagaatatatggtaccctgttgggaatttatactaaaggattttgttttaaagataccaactctccatttgaataccatttctcagctcattttaaacatttacccaattaaaaaagctaaataagtgattttaaaatgtgttttattttaaatacacagtgtttttttctgaaaatgctttctcaacccagttatatctgtgaaaagagaatgtcctttaggaatttaccaacttttcacgcagttgtagcattcattgtgggtgttcagtaaatatttgcagaaagaatgagtgaatgagcaaaggaataaatacacaaaaccttgtgtgcatgagaacgataggatttcacacttctaaggaacaactgagaacaactactccccttgtattcttttgaggatgaggaaatttaggcagaggacaagtaactcctctggggcctcacagctggttaggggcaaaactgggtctgggccccatttcttatgtctatcagcccagcagtcttttcattttaagcttatttgtattccctttaagagaataatgagttatttctgcagggctaattctgacctgaatcatattaaatcagcaaagcctggttttcttacactttcaaatgcagaatgacaaaagtaaagcatcttttaaaacaaaacaaagccaaagcaattggagtatttggttttattgaggagtgatgttttcaaaggcagagaagggagaaaaatggaaactctgtgccatggacttaacttgaaagctaaatgtcagacttgatgtaaaggaggaaaaccagccctgaggacctataactgcataaaagaaaaaaagcagatttctattgattgcagcaaatcaatagaagttcatgtatttgcggatttatttattgcttgcattggtcactgaaacctctaattagattcatagtgtacttagtgtattgtaattatatgtggcagagcacgtttgatgaaggtggatataagtagatgaatatttagacccagcaataccactaatgactcacatgccaggtaacatttctttacttgtaggacttattaagaagtggctgtgaattgtcttcttaattaaaggtttggttacatgaccaaagagttgttaataatggtgcagtcacttatcaaatgtgtgatcccacctaacttatttataattctgaacctagtgtttctcatatgtacagataggttcctaatgacacttaccacatggggttgttgtgaggattaaataagagcatgcaagtaaggttttacatagtgcattccacataaaaagcactcaataaatgttagctattattactgttttcagtcactccaggcgagctatattgtaaaaaaccatacttccattgcttcttcactagagcctagcaaatcattgttttctactggtctactatttgtggatatttctaccccaagatcctttcccaagaggacaatgcaatatagttgaaagattcttcttcacttggtgttcagaatatttcattcaaattcaacattcacaagtgcaatttgtactcgatattgtagactttccagaaaggtgaggttcattcattcaattgcttcttggctgagcaaatttatattctcttaaatcttgataagtcagttaatcttctctaaaattgaggaagttatactcattccactggggtgctatgaggatcggatgaaggtatatagcaaaagtgcttatttgtaaacatcatgttgttgaatgaatattggttattgatattttctgaaggtccccattccatgcctttttcagggccccgtgtaaagccatcccttctctgaagctttccctgacttctctaccttccatctagatgtcaactctcctccttttcactctcactccatttcagttgatcttccttggaattcaaaatacatactgccttgtagagcagtgatttgtatttatttcattccttcttctacactttcagaaggaagtgtctacatctcattgacctcattgtcccacacagtgcataacacagtatcttgcctgtaataatgctcaacaaatatttgattaatgaatagacaggcttttatgaatccatgtgtaatgttaagttctatgaattatgtagaaatagtaaaagcaaataaagactcaattacaattttaactcttcaacaagatgatcaaatccttgaggattagaaattaattaaaaatgaactcatcctttattcattcatcccattatttaataaataaacataaatcgagcaccttccaggtgccagatactatgttggattcgaggaatttaatgcaattaaaataaatagtttcatcccatagaggttgcagtttgtaagtaataagaaataaggaaataattccaaacttgcttttgcaggatgaatatttagaactttctttattaaaagaggtcagtaaaacattcttaactgctttttctatccattattaattccaataatttggtcactgttcattagtgagattaaatttggctactgagagtaggtcatgcaaatcatctttctggttaaaaaaaggcctgtagctactgggtgaaatttgctttgaattatttttcataatcacaagtaattgggcatgtcgtactcagttataaataaatatacaaaagtacactgatctactttccttaataatgagtttgaaaaccatcgctatgttacttaaacttacttttcttcactatttaaaaagtccagagggcacaagtaaccttcagagaatctttccacattacaaggcaaaattatttaataaaatttctgaacatacattttaattgaaaagtcataagcaattctacactgatggggaaccagccaatgtgatgcaaaatgaatttctcagtaactgttttgtgtgtaggtaattttaagtgaaagaaattttttttctattgtacaaaccaagactaatttattcattgttgttccaaagcagcagaagccaccagaatgtcacattttatttttaattcacaaaattaaatatacttatggtgtacaatattgagttttgaaatatgtatacactagaatagtggactcaagctaacatatgtattacctcaaatactgatttttttgttgtgagaacaattaaactctctctttgcaattttcaagtataaaatacattgttattaactgtagtcattatattgtacaatggatttcttgaacttattgttccatctaactggaattttgtaccctttggtcaaacatctctctaatcccacccgcctacaccacctcagcacctggtaaccaccattctactctctcctgctatgagtttgttttttttttagatttcatatataagcgaggtcgtgcagtatttgtcttcctgagcatggcttattttacttaacataatatcctcaagatttgtccatgttgttacaaattaggagatttttatctttttaaaggctcaataatattggttgtgtacatataccatgttttctttttccatttccatttatgtgtcgatgaacacttaggttgattccgtatgtttagccaaggtgaataatgctgcagtgaatgttggactgcagatatctctttgtcattctgaattcttttcctttggatatataccctgtatcaggatcactggatcgtatggtaattctattttaattttttgaggaacttccatactatttttcataatggctacatgatatatccccaacagcagtataccagggttcccttttctctacatccttgctaatacttatcttttatctttatgataacaactaatctatagtaatagctaatctatagctaggtataaggtgatatttcgttgtggttttaatttgcatttccctgataattagtgatgttgaacattttttaatgtacttgttagccgtctgtatgtctccctgtaggaaatgtctatttagatcctttgcttattttttaattgggttatttgtttacttgctatgaagttgtttgaattctttatatattttagatattaaccccttatcatagaatgacgcattttaagacaaggaatgaatcttgtgaaagcttaattccctgtcctaattcctcaccctttacacctccttgcactagacacactcatttacaaactctatacttctactgtattcctatgactggagggtgtttatgagaaaagcaggtgagccttagagtaccagtatatcaatttttttccacagtaggttaagggattcatggagggaccccccctgccccccaaattgatttgccttttgcattagtcaaggttctggcaggaaaactggtgacactctcaaatgggggtaataatataagaattgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaaaaaaaaaaaaaaaagaattgacccatttacaatagtataggcagggtaagtctgttgtcagggaagccaataaaggatggagaagcacctttttacccattacctctcttaggcttgaagggggaaagggagtgaatatttattggaacaaagagccagagatgtggctgtaactgggagagggcctcccaataggatctgaaaagttcagtagtgaaatgcaagcactgcaacccgaggcctggcagggaggagaccaaagaaactgatatcccaatctcacttttcccactccctggctttctgccaatgactcccatttgatgcagtccagaaagatgggcttcctagagagcagagtagggtggaaaatggattcagagggccatgaagagtatcagagtatcaagaatacctgttacattataaggaatatatatgtatatatgtatttattcatatggtacatgtgcttacaagcaggaagctattgtgtatatataagtgttatgtatttacgcatatggtacatgtgcctacaagcagaaagctattaatcctttcaagaacctttacaggcattattcatttaatattgataaaaccatttcaaatgagctgataatggtttggctgtgtccccacccaaatcacatcttgaattatagttcccataatccccatgtatcatgggagggacccagtgagaagtaattaaatcacgggggcaattacccttatgctgttctcatgatagtgagtgagttctcacaagatttgatggtttcataaggggattttcccccttttgcttggcatttctccttcctgctgtcatgtgaagaaggatgtgtttgcttccccttccaccatgattgtaagtttcctgaggcctccccagtcatgtgaaactgtaagtcagttaaacctcttgctttataaattacccagtcctgggtatttcttcatgtcaggctgagaatggactaatacagtaaattggcaccaggtagtgggatactgctgtaaagatgcctgaaaatgtagaagcacctttggaactgggtaacatacagaggatggaacagtttggagggctcagaagaagagaggaagatggggaaagtttggaacttcctggatacttgttgaatggctttgaccaaaatgctgatactgacatggacaatgaagtccaaactgaggtggtctcagatggagatgaggaacttgttgggaactggagtaaaggtgactcttgctatgctctaaaaaagagactggtggcattttgcccctgctctagagatctgtggaactttgaacttgagagagatgatttagggtatctagtagaagaaatttctaagcagcaaagtgttcaagacgtgacttgggtgctgtaaaaagcattcaattttatatattcacaaagatagaatttggaattggaaattgtttaaatgagaagcagagcataaaagtttggaaaatttgtagcttgctgatgtgccagaaaagaaaaacccattttctgaagagaaattcaagccagctgcagaaatttgcataagtaatgaaccaaatgttaatcaccatgataatggggaaaatgtctccagggcatgtcagagaccacaacagtccctcccatcacaaacctggaggcctaggagggaaaaatggtttcctgggccaggtccagggctcccctgctgtgtgcaacttgagtcccagctgctccagccatggctaaaatgtgccaaggtacagctcaggatattgtttcaaaaggtgtaagcccccattcttggcagcttccacatagtgttgggcctgtgattgtatagaagacaagaattgagtttggtgaacttctgcctagatttcagaggatgtatggaaacacctggatgtccaggcagaagtctgctgcaggggcagagccctcatggagaagctctactagggcagtgcagaagggaaatgtggggttggagcccccacacggagtccctactggggtactgactagtagaactgtgagaagagggccactgtcctccagaacccagaatggtagatccactgacagcttgcattatgtggctggaaaagctgcagacactcaacagcagccatgaaagcagccaggaggggcactgtaccctacaaagccacaggggcagtgctgtccaagccatgggagcccacctcttgcatcagcatgccctggatgtgagacatgtagtctaaggagatagttttggaactttaaggtttaatgactgccctattggattacttgcatgaggcctgtagcctctttgttttggccaatttctcccatttggaatgggtatatttacccaatgcctatacccccattttatctaggaagtaactaacttcttttattttacagtctcataggtggaaaggacttgccttgtctcggatgagactttggacttggacttttgagttaatgctggaataagttaagaatttgggggactgttgaaagggcgtgatcatgttttgaattgtgagggcatgagatttgtgaggggccaggggcagaataatatggtttggctatgtttgcacctaaatctcatcttgaattttagttcccataatccccatgtgttatgggagggacccagtgggaggtacttgaatcatgggagtggttaccctcatgctgttctcatgatagtgagtgagttctcacaagagctgatgattttataaggaggttttcccccttttgctcagcacttctccctggtgccaccatgtgaagaaggacatgtttgcttccccttctgccatgattgtaagtttcctgaggcctttccagccctggtgaactggagtccatgaaagatctttcctttataaattacccagtctcaggtatttcttcatagcagtgtgagaataaactaatatataagccttattattctcatgtgatataacaaaatatattaatgtagatgtgtttacagacatcttctttattccagctcaacagcccaaattcttttcaccttctgtaaagaagagtgactggaagagagactaagttaattgagataattaataagtgagtgagagaataaatgaattatagaggaggaaccaaaagcacagagctggaagtggaacaggaggttctcagcaattttaaaagtgaaggcaccgtagcagtggaagtatataaagggagtaaagtcaggctgggaaaacagaaggcaaaaatagtgttcatctagactgtgtgtcagattacttctaatatccttcaaggtacttgagtgaggaataatttcctcttatgtttctattggtattgggttgtccttttggatgaggctcagctcagagactgaaccatgtgatgtctgtgtattttagggttgcactcactttgcattaattttaactgagagttaaaggggttaagtgccttgcctaagatcacatactcagaaaatgcagagagcttactccagcccaggtttgttcatttcagatacattagtctcaattcagctttggttgaagtcacctgtgatgaatttgttgcatgatatagttttctgggggaaagatttcttttaatacatggtaagtatatagtaccccttttatagttggatagattagttctttaaatttcttttgtaaagaggatagattagtaatggtcaagtgtcattgagtgattcagacgaatagttccatgattaaatcttgtttcctttactttttgtataatgctaatgtatcccttaaaataaaaactccatttagttttcttcagttcatttaatcatggcattgttactgtaagaaagttcttctcctaatggtttctaattgctcttaaaatcttgtttgaatcccagaacaaatctctgtgttatatgtcaccagtgacccacccttactttctctcatttactgcctttcataagcagaaagcatttattttttgggtatttttgcttattttttaaaaataaataacattgatttttaatcctgggatatggaagatagtttaaagaaaacagcagtgtcggtggatagcaattaccaccaacaaaatatcttctgggtatttgatctatgaactttgtttgcactcctgcccacatcagtttttgtaacccttccaacttcctcctaagggcaaactcactgacatttccacaactgttcacctttctgatcctgataggattactatatattttgtttaggtttctagatatgataagactatctacctatccaacttggatctgtggcactttattttcctattaattttaaattcaggatttaaaaaagatacttacatagtgataaaatgagttgactcacaccctgcattattctaaaccaaaattaagttatattaatacattctctttaatcaagggtaaattcacatgccccattgtggttagtgaagtggtgaagggaaagttgaagccaaacagcctatgtcttaattctaactcagccactaactagctgtgcaatcttggacaaggccctgaaactctctgggtctcagttttctcatttctactaaaaggacaataatagtacctattacctagagttaggaagatgaagttaacaaagtgatagtgtattaaagcgtacctgacacataggaaacattcagtatatattgtctgctattattaaagctcctacacttattaggtaggtgaacttaatcagattatttgactttaataaacagcaatgatcatatttataaagtagggattgtaaaatataatgcagtgagtttacaagtgtcataatgtgaaatatataaatataaattacatatataaaatatataaatataaattacatatgtaaaatatataaatatacattatataaattatgtatgtaaaatatataaatataaattacatatgtaaaaagtacatagccatgttttgactcataaagagcattcattaaatgtggttacaatttttagaagacattatcagtaatattatcagtaatagaataagacctacaaaaaagggtaggggagagagtttcatgttgtataaggggagtgttgatttaaaagccttagattaaaatctgcaaatgaaactaaattaaaggtgttttgaagtgattttaaccgccaaacaaattgcatttaatacataataattactttattctcccattaaaataattatttttaagtgaataacagcttctttgaccaccctacctgtagttgcagtaacagtctaccagttgtctttccaaatttgtatgatgtcatcagcagcttaatagagcattagatgagaatgtctgagcattactatgctgactttgtaaaattgtaatccaaaagcaaagaatcttgacagcttagacagttggtttgatcttattattaatgaacagaagatatatcttaggctattttaaaagtgaatttataataagatttctacttcctatgttagctagagtaaacactagctaataaaccaccctcctaaacctcagcaaactagcccaagaaaagagtttaattttggtattagtattgctcactcacataaagcccaagcaattaggagcagaggaagggatgtgagggtttgctctatagagtcatagaggatccaaggtgacagagcctctgtcatcttccacacaggccttccaagatggttctagccaaatccagctagccaacatctctggaaatgacaagcatcacttttggtcatatttcattggtcagaagttagtcagagggtacctagttgcaagggaagctgggaaatgtagtctggctggcattgctttgttgcactaactcagtcctgtggaaaaggagcacaaatatttggtggacagtaaatgatctgtgtcatatccttattactcagatccatagtaataatgtctgtttttatctccttttctaattcctagtaaagaagcaatcaaataaaaagaaataaaaacactgaacagtatgtgttcatttgtctcatccattattgtatatagtgcctgatacagagttcagtatatattcagtatatatagtacctgatacagagttcatgatattcaataaatatcatgagtgatcaaacacatattctctgccttcttctcttcctcccttccttttttctctttttcttgcttcttttatatctctttctttttttctgatcccaaacactttagagtctttaatttgagctagattctatgataagtgattgaagaatcaaagacatatttaaccttggggaaagtcataatgggaataaaggaaaaaacattaatataaagtattagtaaacatttctaaattactgatttcattaaaatatttaacagtcttatgaaagactaaagaatcattttgagttcatctactaggcatggacaagccacttcaggaagtttaatatccttctttgtgcctttgggtttaatctgtgctagtgataccccagccttgacagaattgctgccccaatggcccaggctgtgggattctgcacaggaaagaccacttcatggtgaaaattctctaaagttttgctgtgaatcataccataacctaagatctgtgttatggtaaactggatactgtagtggtggaggatgtctaacttcgttttgtgtttcacagagtttcaagagttttcctgtaagcctctttagtctttgtatatttaatgtgctccaatcctacttacatctcaactgtgttctttctgatggcgatggtgatgatagtgccaatcatttatttagcactaacaactgtgtgctcgacactgtaccaatattattagaactattatttcttttactcatcacatcagccctattagatatttagagatttggaaaattatgttcagatagatttggtaacttgtctaaggtcagacatgttaggaaaaggcagagctagaattcaaatacagttttgactgagctcaaagcttgtgtaatcaccacttaggctgatgatttgtttaggctattgagagagaaagattattttatctttctttttttttctggaaagagggatgtatacagatcttttagtagtaaaattttgccactacattcagtgacaaaaacaggagttacttttgcaccaacctgataactcttcaaaatgtttggtgaggctggactcaaacataagtgcatggatgcctgatttttttcccccagtattcaagaacctcagggttttcctgaatgtgctatagacattccagggacctcctaagttttgaacattgcattattatgaagattaggtccataagttttatcagattttctaaaatacgagtaaacattttttaaacccaaggtttgctgccaacttctctcctctacagatcctggaaagaagaaagaaatggcttctaacaaaaagaaggggaggatttccagctcatttctaattcaggctcattggagaaggaagtggcatgggtgacgataagcagcagtttttatgtctgaaggaaactgaaaacagcatctcactggggtggccaggagctcttctgctgaagtctctgtgtatccagaatgcctgggattggattcttgtcctgttgcctctgacttcctagaagtggcctctgggccgtctttatttattaaatcatctgggtatgatctggctctgatattttggcattcgggagtggcagaccaagctcaaattgcaatagtcctttaaaaagatgtttctaaaagccagatatgcactgacatttcagaaagaacatttgtgcctaatttccagctgccaagttatagttcatcattcagcttcatattggaggccttcaggctttgatttatttaggaaacattggtgaacaatgggatcatgatctgcaacatgacagatgtaggaagtccatgtcccctaaaggaggttttctggagactcctaacaattaagagaatctgttctgtttctaagttgacagcaaattattgaattctgagtatccagaatgagtttggggagtaagagttgtgaagggcagacattaactgcttatttaagacataatacctgtcctttggaaacttatggtttgttagggggtagtgtcctagaaacaatgtaagacaatttgttaccaaatgataaatagaactttaaaacaaaaattttcctactgtcagggaaactaagttttccttttctttgaaggcatggagaagtgccgagcagtgtgttacttttcctctattccctggttcgttcctcacccacgtcagtttttcttcatatttgtctttattggaacccacaaagtttattcaaagttattatcagtttcttcccttttgtgaagaaaattcaatttttatgaattagatttttaagatggcttgtaatgtacccatacagccaggtataagaaattacctggtagcttcactgatgcagatgacagatacctgtggggacttacagtctagttgggagagtaatcacacacatacacacacacacacacacacacaccccagatttggcatgagaagaacaacgctgaagtcgatatctgcctattttgtttataatggtgtgaccttgggcaagtcacttaatttttcaatgtattttctcatctataagatgggagatatcttatatcctaaggctattgattatgtcagatggaatctcatctgagaaaataccttagaaattgtacagtatgataaaaatattgacttttattttctaaatcatacatagcaagatgcaggactagtttaattgttgtcacttttagaatccgattttcacatcatcattccatttcttatgatatttaacatgacaagcaaaagaccttgttcaaaggggaagaacaaataagattaattctctgtaaatcctttaaaattttattatccatctcttcactggggaaatgtctagatacattttcctaagtggttccatctttctgtaaatggctattgacctgctgagtgcagttttgctttcagagaagcattgcacttggtgtgtgatttgagtttgggatcatgaccttatttcctttgcacttgattgctttacttcaccaactgcatccctgattttgatattatctgtggctagctcctttcatgattttgggaatggctacctctcagttttctgaatattttttagtacttgctgttacaatgtagacattgcaataatgttctaaaattatatgtacatttacttactcaacacaaatttaaagagtacctgataagagctggtactctgagtactgagcactgagtacctggtagaatcattaatacagaagacaaagctctggcctcaaggattctgcagtacagcagcagggaggtaaaacacacataccacatttgtttactgcaagtgtgggaggtagataggtgtcccctaaaaacatgtgttcccagaacctgtgacgtgaccttacttggaaaaagggtctttgcagatgtttaagttaataatcttgtgatgagatcatcctggattgtacaggtgggccctaaatccagtgaaaactatctttgtaagagacagatgaggagaagacgtagagacttgtgaaacagaaggccatgtgaagacagaggcagagattggagggatataaccagaaagaatgcccataggcagcagaaattggaagaggtaagaattggattgttgcctaaagccttcagaaggagtgtgaccctgtcagcatttggatctccgactctggcctttaaaactgagagagaaaaaaatttctgttgttttaagccagtgagtttgtggtaattttttaatggcagccatgagaaacgaatacaacaaggaacaggataatctacaaaatacatgaattatacaagagcatcagaagtttgtggaaatttagtataaaaaacacctcttattgaaagtgtgattgttactatacagtcagtccagaagcactgaattatgaaaatatcattgcctggtatgtgtcagttatgtttataataatataaataatctaagcacacattgtgtcctgtaattttaattttactctaacatcccatgcaaaggtttaactgtaggtggccatttcatgaaacaaatgccaatttctcatggaccaatgttctcccagcagaggaaatatatcttcctgcccacactgggctacaacatcactaaaattacaagcagaaaggaggtctgcatttctatagcctcttcttttcttatctagtagtaaatggttataaacttgacattttccagttacaaacataagtaataatattgtaataacaaaagggaaggtccaatcctatagatcccactgatggtgatagagtaaatcaaggaatttggaagaagtggtatctagtttcacaagttgaaaaaccagaattatcttcaggcattcataatttcagtgtcatgggttaaggtgtttgggggcaaaatgagtttctggctgtgggatggatttgagtggtgttagcaatcattcaataacagaagccactgaagcagccttcgtctccctaatcaaaatgctgccatcataccattttgctcccaaaatatgctaaaagtaaggcaccaacggtaataagtagtataggtaatttttaagtaccataaaagtttacaatattaacagttacatttgttaattttgtctggcttagttggtggtgacttcagatggtaactgggtggaataagacttctaagcccacataagacaggatggtgtgatctttctgggagggtgccacgtctgtccaatattgatacaatagtgcaccagtggcagcttcttggttgggccaagtaagccttctcaatgtatttactccttcagtatttataacaatcaggaagctgtaattattgtccatattttactaatgaagtaactaaaacttagagaagataagcaatttgtctgaggtcatgctctagtagtgagcagagccagaatctgaactctggcatgatgactatagcgtctgtgtttttatgcattactgataggtatgggtggtatactggagacttagtgagtatttaggtgtgagtaacgtctacagtgacgtcagggagctcactgtacatccatgacatgagaaataaaattcccacgcttccctgtcttgaagctgaggcaatatattacatgggttaactgacaattcagacagagtgagagattcattatattcaccacaaatgaacacagatggacactcttcaaataaagcttcctattgaattttaatagtgctcttctgcagaacacatttgaaaaatggatcatagcatattcatattttcctttagcttgccaaatgtgagatgattaagaaacctgcttaaactttaaatattcttaccatacacatgcatttttcaaatgtatgcgtctgcaataaatatttgttaaatgaatatgaatgtatatacacaaacatacatgaagcaataggcgcacacacatttaatttgataaatatttgttgagtatctactgaatataaacttgggctgaagagttatggaaatacaaagacagaattcttttctgttcccaagaagctttataaggggaagtgagacatgctcagtcttgttctggtggcagctctcaaagtgtggtctctggctcggcagtgttggcatcacttggggacttgttagaaatggaaatgcttgtgccccaccatacacctgctaaatgagaaactgtggctgggggtctagcaatttatggttgtaaaagtcctccagggaactctgatgcacgttaaaatttcagaaccactgggcacaggaacgctttaatgtgctaaaggatgctaaatattactttcacgtggagacatctgagaaggcttgaagaaagagattgtatttgagcagagtcttggagaacaggtagattttggctgatagaaacagagaagggaaataaagtcaaagagaagagaggaagtcaacttagctcgtttgagttggcagataggctgcccatggatgaaaacccagattaaaatcaggcagtggaaatccctgagcaacacgcttgtgagtttagacattgttctgaaagacattggcagtcattgaaggtttctgagtggggaagaagtgtgatcaaaactaccttccttttttttttttcttacccagtgaatgtaattcagcacttgtactgagttcatattaacagaacttgatggttgtaaatcagtcttttcttcctcattaaaatcacttcaccattaagaattatctataggttatggctggaatcatgttatctctgctctttcttgactattctgacacagcaggcaacttaatttcaacaactcggtaatgcccccatcttctgtgtgtgtgtgtgtgtgtgtgtgtgtgtgtgtgtgtggtgtttgctaagaaggagtcacacggctgcttttgaattcagctgggctttaggaagctgcataaaaacaaagaaaaaatgttgctgcttgctagtgcattctttgttatgtagcaatcagaaggatgactgtgctctgaagtggtgcaggtggcctcttctgatactaattccagcgtctcaactagttcagcatcaaaagggagttctctggaagggaaataattctgtccctacccctgattgctcctatttgcccagcattgtgggcacctgcttggccacccaccttccttttctttgccatccacttgcgtcatctttctcttcccctgggtcagcctgtatatttcaatctatccacaccctgcgcaagctcattcattcatgggctttctctctgcaattttcattgtgcctccctttgttggcataattgattccctgctttgcaagagcaggtggatgagttggtttattcctttaaaaaattcctcctcttttctctttcattgctctgatctttagtcaatctttggttcagccagcttgttctccttctattgactaatctctctctgtatctttcataatggtggtgggagagtccatgccgaatctcctgttggttgaagaaggtgaaagtcaattggtaaagtcactgtgatttataatgttcaaactggggagggattgagtcgtgaagaccagaagtactgataatcatttagcttatttgctggaaggctccactagaccctaatgaaacaatctcatttatcttccccacatcctaatggaattgcagaattaatagtaaaaccattaagccttcttgagcatgtctcatctaacactccaggatctttgttacacatttttatttttctcaattttggattttttgagggtgcgaatttacttagctgagaaatttagaagtcctttattcagtctagtataaagtgtccagataaaaacataccttagagatattgtgggtgcagttccagaccaccacaataaagcagataccacaataaagcaagcatataaattgtttggtttcccagtgcatataaaagttatttttactctatagtctattaagtatgcaatagaatgatgtctaaaataaaatgtacataccctaattataagtattgtgttgctaaaaattgctgatgataatctgagcatacagtgggtcataatcttcttacttgtgaagggtcttgccttgatattgacggctgctcactgatcagggtagtggttgctgaaggaggttagggtggctgtagcaatttcctaaaataagacaacaatgaagtttgctttatcaattaactcttgcttttatgaaagatatctttgtagcatacgatgctgtttgatagcattttacccacagtagaacttctttcaaaattagaatgaattcactcaaaacttgcaggtgctttatcaactgaatttatggaatattctaaatcctttgtagtcatttcaacaatgttcacagcatctttaccaggagaaaattccattttaagaaactactttctttgctcatctatagaagcaactcttaaaatccattccagttttatcatgagatggcagcaattcagtcacagcttcagtttctacctctagttctagttctcttgctacttccaccacatctgcatctactttctccactgatgttttgaacccttcagccatccatgaagattggaatcttttccaaactcctgttaatgttgatatttcaaacttctcccatgaatcacgaatgttctttatggcatttacaatgttaaatcattttcaaaaaattttccatttgctttatccatatctatcagaggaatcaccatgtcagttctagccttacaaagtgtattttttaaataataagacttgaaagttgaaattattccttgattcatgggctagagaatggatgttacgttagcagacatgaaagccacattaatcttcttgtactcccatcaaagttctggagtgactaggtgcattgtcaatgaatagtaacattttgaaaaaaaaaaaaatcttttttttttccttagcagtagttctcaatagtaggcttaaagtattcagtaaaccattttgtaaatagatgtactgtcatccaggctttgttgttccatttacagagcacaggcagagtagattttgctaaattctggggccctaggattttttgaatggtatataagcattggcttcaacttaaagtcaccagctgccttagcccccaacaatatagtcagcccgccctttgaagtcaggtattgatgtctcctctgtagctataaaggtcctaggtggcatctttttcctatataaagctgtttcatctacagtaaaaatctcttgcttggtgtagtcaccttcatcaattatcttagctggatgtaacggataacttgctgcagcgtctacataagcacttgccgctttaccttgtgcttttatgttatagagatgatttctctccttaaacctcatgaaccaatatcttctagctttaaacttttttctgcatcttcctcacctctcttagccttcatagaattggaaatagtttgggccttgctctgggttaggctttggcttaagggaatgttgtggctggtttgatcttcaatccagaccactacaactttctccatataagcaataagcttgtttaactttcttatcatctgtgtgttcactggagtagcacttttaatttccttcaagaacttttcctttgcattcacaactaggttaactgtttggcacaagaagcctagatctcagcctatctcagttttcaacatgcctcactgagcttaatcatttctagcttttgatttgaagttagagatatgagactcttcctttcatttgaatacttaggcctttgtgggagtattaattggcctaatttctatattattgtgtctcagggaatagggaggcccaaggagaggaagaaaaatgtgagaatggccagtaagttgagcggtcagaagacacacaacatttattaagttggccatcttatatggacatgatttgtgttgccttcaaagaattacaataatgacatcaaagatcactcatcaaagatcaccatctcagatataataataatgaaaaagttttacgtgttgagagaattaccaaaatgtgatgtagtgacatgaatcaggcacatgcagttagaaaaatggtgtggattgacttgctcaaccaacggttgccccaaaccatcaatttgtttttaaaaatgcaattgttgtaaaatgcaaaaaagtgaagcacaaaaaaactaggtatgcttgtgataggtttctctcctattctttgaagaggcttttaaatagagttgattgcatggcattgcctagtaaaatcattttaaactaatatgaaattatataagctctgaacagggcatttgatgtccactagggaaagtaaaacatattttttatttcagcataagaagcttatctcttccatcttgtaaaataatataataataatagaattagttaaacatggtgattactattacgtattttatgattccaataattcaagcacagacactatcttgaatgcgtcctagtatattcagctccacaatgatgcctagggtttcatgttgaaggctgtgaagttaacaaaggaaaatggagatctgattactagcttccagagattggttgagaattgagggagaagagagatcaacattatatatttcacatggcagagggtaataggagcttttatagagaggcaaaatgcattggtagaaagagaagagagagcctaattccacttgctaaaaatctatggaagccacctaaaggaagaatgaaaaattgaatgtttatcaataagttggaaagaggagaggaacattatgggcagagcaaacagcatagaaatagaataatacatggagtatttgttagcattcagagggaatggagatgacgggaaatggtagaacatagttagaaaagtaaattgggcagaattggtgacaggggattcaatttggtaagcagtgggtaaccattcatggctttgagcagagtttggcaaactatgatttgtggaccaaatccatcccattgtctgatcttgtaaagaaagttttatttaaatacagtcatactcattcacttatgtattgtctgtggctgctttcatgctacaatggcagcattgaatagtggtgacagagactgcctacaagctgaaaatatttgatatatgactttttacagaaattttaccgatgtcaggattcactttaataaagtgtttcataaagtgtttgtttgtgccgtgatgggccatccaagattgtaatgggcgatcattggaaacaaagatgcttatagagcagcatcttgcatgtcacaaatatttgaatgaatgaaaaaatgcatatttctgttaagacatcacagtaacagtaggagatattgctttttttttctttctttttttttgacaagaccaatgtgaaaataatcagagagtggttctctggaccacatcctgttcttcaggggagagacattgaaaaacatcaggaaaagcttatccctagaattgattcagaggacaaagctacagttatgagaaaggccactttggagaaatgttggataagatgtccagtgaggcacagaatggggtgacactgggagtgacaggatcttgatggactctggccatggcacttctcaaacgtttttggcagtcctatttctattttcacagactcctccacctccactctgtcctggccagcacccagttctcaagcattacacatttatcccaagtaatgcgtagggagcttcctttcttgcacctataaattattcactagtttcagattggggtgaaaagaggaaaacataattaatccagaattatttcacatgtataaattccttgcttggttttgtttcatcatcagggcttccttggccttccatggatggcatataccttattaatttatgcttagcaatcttttgaaaataatttttacatgggtaactcactgaaacatcatggcatttatctcacatcatgtagttttgtcagttttgatgttagagaacgtattctgccttacttttatgtagcaatgtgaccaggaaatctcatgtaaaatctatgcctccctaatatgcaaaaatactgaaaatgagcacctcttctcccttccttcttttttaataaatctagtaataatagctggaataatcacaggatttctaaatggagtcagcatggcaaaggaaaatgttggtgatatatttattaagtccatagaagttaaacttccggagagctcccaagctaattggtaccccttgttcaggactggggactattaactgagagaattcattgggtgttttaatatctagccttttaaaatctattttaaacaaggactttgaaggatgactgaaatgtggttaaatttccacagagaacttacaactccagcaatgggaactccccaggtacagtgatgatacgaattgtgttggatttcttgaatttcatcttcaaagcacaagaatgagaaaagaaaggagacaggaaccatttacattaagcagagatgcataagtttcttaagtggtgctttccagagcacagctgggtttcgtgtgtgtgtgtgtgtgtgtgtgtgtgtgtgtgtgtgtgtgtgtgtgtctgatatatcaagctgtcggttatattccatagattcatagtattttcctcctctctatattccatctctactttttgtttataacaagttatttactttgcccatctatcttttaagcaaattatcttgattggaaataactggaatgcttgataattatataagaaacttaaatacttggcctattcatttatcctagagttttagggaacatcttggtctagcataggcattctcaaccatcatattgaaaaaaattgtggagcattatagcacaaatgattttacaaaataaaatgattgttaaaaattagaataggttcatagtagcctcacgctctgggttccatcatgcttcttgggagagagagaaagagcagactggctggtcagaaccctggctttgactgaagaacacattctgcctgtaagcataatttctcagctctgagccagagaaaagcagtgggactcttttctctaggaaatacagtctgcatagatagaatgaagcagaattggagacacataggaaaacaattatccctttgtattagtttatctaatcctctgctttgggaaaacaggaagagagaaaaagaagagggaggagagggagggagctaaaaacaaaggaaaacacttcacaagggtttgccctcccccaaaaattcaagacatgaaatagaatctatcacatatgattgggagccttgtgttctggttttctccaatcctaagcccaagaatttgttcctcctgatgctgtagatagtttcacctgagaagattttactcacctctgcgtcccattatgagatgggaaacctggcttctgccacgtgggcacagagtagatacccactagattttgttgttttgtgtgtatggttgccagggatgatcagtgccccaatattcttgccccatcaatattcttcttagtgagatttgcaaccttttaagcattgggaacttaagggttattatgaatacctgtcattttaagctaatatacattctttacagaataaatgcaaaatgttcacattcatgagaaaaaggaagaaacttttagctgacacataccattttgcatgttatataaatgtattctgctcagtacaaacatttttgtgaacttaaaaaaaatctcttaaatgtttctataaaagtactacttcttgaagtttatatttgaatgaaaatacctcaaattcttttctaccctgacttagaactatataactttaactctctttttcatttttaaagatgtgatattcctctgatgagataacgtggagctttcctctaaaattttcttgtgttcagaccttttttttctcttccttctggtcttcaaaaagctataggaatctgacctaggaacactgtttcctcaataattggcattttctattttcactttggttttccccaacttaattgatgagatatataatctttctccatccaaagaaactacaatgactgacactaacatttttgaacccatctatgcccatttccatttttagttctacaaatgttctgacaccattttttaaaaaatcacaacaccccaaacagtgggttctatttttttttctattgttatagatgagtaaactgacacctaaagagggcccttagcttgtggctggcatctcaggaccaaaatgcctgcgtttgaagcccctgggaatttggcctttggagcctttagcagcttctaagcctagtgagtttgtggcttcaggtcctgtttaggtcctgtttctcatttgtggagaggttggtcttgttttgaaggcagcaacctccttcattttttttcttttttttttttcactatctatcattactacgtttggtgccaagttggggcctcaaattttgaacttaaaacatgacatgcctggaaatccttttctctctcttcttctgaagggtgtccataaagtctgggatgcagacaaatatatgtaatgtcattaaaatttttacaaatctgtaaaaaataaaatagtattatcaatgttttcataccttacagatgcccttcactttaaataaagatttcctgagaactaaaaataaaaataccatgtcctcaagtttggattagtccagggagtagggagaagggctgagaaagagaagggtaaaattatctattcttgacatcactgtaataaattgattgaactgtactgcatattgaatgcttgctcttactagggtctcttcataaatcatctcattattcctcaaaataagtcagcctgctaggtttgatgagcccatttgacagatacacaagtccaaggacatcaaatgactcgcccaacatcactagggcatgtgggctgaatgaggatgttcagtctggtcacatcaaaagccctagctcttttccctataagctagaaataatattccatcccttttctcacctacctcccagcaaaaacaaatgacataaaaatatttttttctatctgcttctgctcatgatacctttaaaatgccttattcatcaattcattccccatctcaggctcaggtaacccttgatgggggatttgtatctaattttctctgtatttcttgaaccatttttttttccatgtgtccatctctatggatccaacctcatgatttcctggaccatttaaattgtcttttattctttcttttttctctatcacatatcttggctctaactcacctgctttccctttgtatttctcttttaatattttacatgtatgtattaccccaactagacagtgttttcaagggagaacttaggaatttttcatttctttccaccatgacatcagacatctttctgatgtcatagcttatgaaataaaagtctataagtatgtgacctgggtaaaacataatcattttgagacttaatgatatgatctctatcaaagttattgtcaactgcagttcattctgctgttatttttatatttgatgataattcagaatttcatgtccccttctataatacctcacatgccaaacaaattaattgtgttaatgacaggtaaggaagctcctggtcactttccttccttgcttcagacccagcttcaaggtgggccagatggggcacaggctgcctcctctgtctgggttcgagttacttgtaaccatgtctgactgtcctggggtgcctcttagctccagttaatttctgaatcctcagcaagttttaaaagtctgagcaagaatttcctttcttactctgttgcttcatctttttcctttcttctctcaaatattcaggatggaggagaaacggcaggctgagccagcaatccatcttacttgaaacctatttgaaggttgtcgggtatgcaagggggctggaaatagggactgagagtttgattccagcatgaaggccaggcatcagtaccgatctaccttgtagtgtggtaaatagactttggcatcagctaaattatttctgtgagactgaagtattttgatcgaaatagacaagtgagcaaagggatttgcaaaagaattctgttttctggcacaggcatctcaatgaggccttgtgcagaatctcacatccgagcgccccctgatggcaacatatagacacgcctcactttctgtggccaaattactccatgaaaggaatagtttctatatttgactttaagaccttatttctaatttatgttttaacctgggatgtgtttggtcaccacttatgtatttgtttttcatatttgtttgatttcaaattatctgtgataacagtattagattataaagtgcattttatgaagctattttaaaataaggtattttcaaatgtcatttaatgttttcttggaaagattcaaagtagtagagtgcttgaggagaaataaaagcagaggaggaataaaaggagatgaaggaggaggaaggggaggaggagaagttataaataaagattagcccctaattctaaaacattttttcttgatctaaatatatgaacaacgaagtccaaattatttaatgtttcccattgactataggatgaaatttaatactttagcctgatgtacaaggctcttaaagatctatccttgtctaactgagtccagagccaaccctacagctgcccaccttgaattttatgctctggaaatactaaatgattacaattacctaaatataacatagttatattcaggaaatacatatattaaatattatatatatatgtataatatgtaactatgttgctcatggatctgtgactgtgcacaccatagttccctctgtctggaacatatgtactgcctcttatcctcctgcaaatctcatccttttcaaggtaattctttcatttcagataaaatgttattctctctgtgaagcttggccgtgatttccctcaactcctgctctccacaagtttccactttgtactgagctcttacattgccttggtcattccctttctcttctccctacctatgttctgaggaaataaacaatgaagtttcatcttctttttttttttttttttctgagacagagtcttgatctttcacccaggttggattgcagtggtgtgattatagctcactgcagccttgatgtcctgggctcaagagatcctcccgcctcagtctcctgagtagttgggactataggctcatgccaccacagctggttattttctttgtagagatagggtttcgccacattgcccaggctggtctcaaactcttgggctcaagggatctgcctgcctcagtctcccaaagtgcttggattacaggtgtgagccactgcgtctgactgaagtttcatctttctagtccagcttagcacaatacttggtgcaggtgcgtaagacatatgtgttaaattgcatacttcccatttcctgaatggaggtgaaataaaggaaacaaaagttaaatacatttttcaggagatacagaaatttgtaactcgctgaaaaagtagctttttattaggactttgccttttaaatcattacacactttagtctttcctcttaaactaaattactatttattattgactttacagaagaagaaactcgtgtcatacttatatgactttttggaccctggtgacatgtgactaataggtaaaaagaacatacaatgctgggagcaatttgtccagtggcccaattttatatgatgcctcaaatgaagtgctgtttatgcaatgaagtgcgtttcttgctttgttagtagtcattgagcctctgcacacgtaaatgtgtagggaatgaccattgagagacaaagtgtttgtgatgttacccatttatagggtatatcaatagttcacatttacggcacactcctttgaggccaggcactttacacacactgtcacaccttatcctcaccatcacagtatgacattaggacaattatgtctatttgcagatgaaactgtgactcatagagatcaggcgatatgtcaagattattcagatagtaaaaggcaggcttgggttcaaaatcaggcagtctggtttacagagcctggccattttttagggcagttgttctcaaccaggggcaatttttcttcttgggatatttggtaatatcagaagacatcattttgattgtcacaactgggagagagggtgttgctggcatctagtggtagagtccaaggatgctgctaaatatctcagagtacacaagacagtcaccacaactgagaattgtccagcccaacatgtcaataatgccgaggttgaaaagacctgttttatgataataagccaggtagaattcatgacaattgagtttatacaccaaccagtccttagcctttgctgttttccgcctgttgcatttctttaagtgtcatttattttcatggctttgactattaactctatagagatgatttccaaaaatcaaatacagatgatttctagagagaacctcaacctctccctcgaattctagcttcttattttcaactctcaggaggccatttttatttgaatgatttgctgaccgttccagtaaattcaaagtaactgttgctcctaatttctccctctgtggctttgtcctttttatcctagatactgttattcttttcgttagccaggaatgaaactctgatttatttcctcttctcttttccatagttctcctgacttcctcgtctccaatcagttactgaatatgaatgacctttccctacacggcttttcatagtatattcctattttcccttccacaatgctgacctaggtctttttcacctaccatgtggtattactgtaatcatgttccagctaatcttctgactccattattttcctctttcaacatgatcctgcacaaccacccagttaatctcctgaactaactctttggccatgtatccttttgtagtgcctttctgccattgagttcagtgtggattgcatcttgtgtttaatattcttcaggatttggcctgcaccctgtcatcttcagttgagccaactccttgcattctctgaagtgtactgtgcctatttctgcctcctttcctttgcccagcctgtgttctacagaggatcaccctagctactccacacctacacaaaaatatcatattcttaagacctgatcttgaccatttaccttcactttagttcttcctgtttactgcgccattcaccctggtcctaagtcatatgttctttctttgtatttttatttgaatattttataggaacatactttgtcatcccaactggacagttagtttttgcaaaggataactaatacattttcattttctttctcagcacctgatatcataacttttttgaataaaagtctaactgtttgatcttggtaaatgtaatcattttgagagtttatcatgtataaaatgataaaagttgtaatgttgctgttctacaaagcctattaatattttaccaatttgcaaaggagaactaatacatttttcattttctttcccagcacctaatgtcatagcttttttgaataaaagtctaactgtttgatcttggtaaggtaaaatgtaatcattttgatggtttataatgtataaaatgataaaaaatgttatgttactcttctacaaagcatattaatattttcccaatttgaaagataatccataatctgtcgagtttctagagaatacatgaaaatactaaaactaaagtggatagagtttatgtgagtattatattcagaatcagtattaggggattaccaaaatcgttacttaaaccaagataaacaaaattaaagaacatacgatttggtggaatagaaaattgtaagtttaagggcagtggctaaaactggaataatttatgttctataaggggaatggctaaataaaattaaaaacacatttttaatgttattgatagaaaattaacccataaaaattggtgcattggtcattatttagactaatctgttaaagttgattatcgcacaatcatattttctcttagataaaagatttatgatacttagtaaaaatggagcagagatttcaccattatattatataattataatttcagtgaatcaactgcaaattcatcaaaggctatttacattctgcttcacttaaattttccagttttattttccagaatttttctttacactgtgccctgcactccaactagactgaatgaactaccactactttcttcccatgatttcccatatctacttcctctgttatttcttctacccagactgcccttcccaatagttttctctgtgtctacacaccttcctgacaccactcaaatatcatctccaccaccaacttgccttgatccctagaaataatcagacccttttctgaacacccttaaccatttattactattttgtggcacttatttcactcccacatccaatctgtgtgaatgggcatgacataacttttctaccaaacaatatttctttggggaaagaattgtctccagttatctttttttccctgatcctaggcaagcaaggccattgcaattgccgcacaaagggtggaaattgagctggtttcaaagaccagattcggaaacttgaattcattttctctgtttggtttcttctttcatacttgcttttcccacttggctggagctggggcctaggtagattcaggcttacatatagccatatgaacagaagggaaagaaaaggttttttttttctgccaaaacttttctattttagaaaaatagggaagggctttgttaactgtgacttggggcatgtgctcatttctggagcaataactgcagccaacagaatatggtaaaataattcgctcaatctgggctgagatacactccttaaagtcaaggactcctgtctgttaccgaagtagggaaaacagtgctgggcagacaaagaaactaccccataaaagtagaagatatctttcagagtctcaacacatataattattggcagtttctttaattatttttttctatttatttactattgaaattggattgcatattaaattttggatttagttttcttacttatcattatagtcagctttgttgcatggtcttatacattcttcttaacatgtgtggtgctcttcataaacatatgaggtgctttggaatagtatctcctgaacacgtcaagatatcaccaggaaacaaatttgactttaggtcacatggccacttttctgtctccatcacaccggttttctagctggtcagagtggggatagagtctaaaggggaaattaagtatcatgtgagctttgaattatgtaatgttaacaaatgtttaacattactattttctagagtggatttttgtaggaacactttccaacttgtatgcatgtttcccattccacatagagttcaaaatgtgactacttacagactgctttccagttagtatatttaagataaagaagcctacattacacaccttaagaatgtaggccatgtctacataataagaagaacatattttttaacttttaagtccaggggcataagtgtaagtttgttatgtaggtaaacttgtgtcatgggggtttgttgtaccgattattttatcacccagatattaagcctaatacccattaattattttttctgattctcttcctcctcccaccctccaccctctgaaaggacccagtgtgtgttcttcccctctatgtgtccatgcgttctcatcatttaactcccacttataagagagaacatgtggtatttggttttctgttcctgcattagtttgctaaggataatggcctccagctccacccatgtccctgcaaaagacaagatcttgttctttttttatggctgcatagtattccatggtgtatatgtaccacattttccttatccattctatcattgatggacatttaggttgattccatgtctttgttattgtgaacagtgctgcagtgaacgtaagtgtgcatctgtcttttgataagaaataacatcatacatgcaaacagctgctagcatgtctttgttaacactttttgtggcttaacatctttactaatatttatgattaaattcaatcctcttatttatttcccattatagaaacaagtagtgtagagttgtacgagactcctgaatttatttagtccaatgtttcaagcttttcagaggtttattttacaaacccatagtagtcagtcatgatactttggtttaaatacatctgatcctatcttcatcttgctatggggaactttctgtctcaccagtcagctttttccattgttaggtatttctgattgttggaacttcctcctcccaccagtctttttcagaatctactgtcaaatctgttctcatagcaattataatttttctttcagaattataattttaaaaatttgcacatttctgagaggtcttcaaaaagttcctggaaaatgtgcattatgaaaaaaactgggcatcacttaaaaaaatttcaccaagataaacttgtactaacttcttgtaacatgtctgaacaggatctagtttgagacactaagaaggataagacattggtttgaatagaggccctatcagagcaacatgaattctattaaaattgcagcaagaacaaacatcaaatttatggtgaggcttgggtagaagaatggtgagatcattgattctttatgaaaagaatggggacaatgccccaaagaaattagcagtttataagtagaaaactcattttaaggaggaacaagaagatcttaaagatgaagcctactatggcagaccatccacatccacttgtgaagaaaacattcatcttgttcatttcctaattgaaaagcctaggttattaacagcggaaacagtagctaacaccacagacatctcaactggttcagcctacacaattcttactgaaaaatttaagttgagcacactttctagttgatgggtgccaaaaccgtcgtacctagatcagctgcagacaaaagcagaactttcaatgaaaattttaaacaagcgggatcaaaatcctaaaacatttcttagaagagttgtgacaggagatgaaacatggctttaccagcatgtaccatcctgaagacaaagtacaatcaaagcaatggctaccaagagcaggaagtggtccaatcaaagcaaaagcagactggtcaagagcaaaggtcattgcaacagttttttgggctgctcaaggcattttgcttgttgactttctgaacgtccaaataagaatagcatctgctaatttagtacagtgttttgagaaagccaaatttttagcagaaaaatgcccaagaaagcttcaatagcaagatctttttcattatgacaatgttccttcttgttcttctcatcaaacaagggcaattatgtgagagttttggtggcaaattattaagcattcaccttgccatcctgatttgacttcttctgacttcttattgtttccttgtcttaaaaaaatctttaaagggaatccatttttttcaattaataatgtagaagagattacattgatatggttaaattcccaggaccctcaattctttagggatagactaaatggctggtatcatctctgacaaaagtgtcttgcacttgatggaacttatgttgagaacaaagtgtgtatttttaatttttatctacttgcccatgaagttcatggagtgcttttagatctgtctttttctctgtctgtttatctatctatttatctgtcaatctgtctacacacccatgcatctactatccacctacctaccaatcatttattcatataaatttgtttaaacacctggaaaaatgattatatctccctcttgccttctctttacgtattgctaactatactcagatatttgagtcattcttagtatgatagttttcttactgttgtccattcctgtcttattttttaatgttctggttcttttagaaatatgttatccaaagtaaacccactgttcttgctgtaggagagagttcactgggcctttccatgctgtggtgtggacttttacttccattgtagatatagcagaaagagctcagtgaccgagagcctgactgcttggatttatactctgcctccacctctcactggcaatgtagctttgggcaagtcacatatcctctgtatataatttttctcatttgtggggtgcagatataagtggtggctatcttggagggttgcaaagaagagcacttccttggccaatagtgtgccctctgtcatgaatatttccctgctatcattgtaacttaacttttgttgctattttaacaaccaaatcatgactatttgttatcacttctgggcctttaaagttgctgcttttcccacctagagcattttcccccaagatagtcacagggctggcaacctctaatcttttagcagcttgaatgtcattcctcaaaaaagcctccctgactgctggttctgcccttgccctggtcactctctagccctgggctttatttcattttctttatggatcctatcaccatctgaaattcttcactaatttgcttgattattagctttctccctctgctgaaatgtaacacatgtgagaccagagcctccttagtctcatttaccaatgttaacagcaaccagaatcgtgcctagcatatagcaagtgcaccagaaactttgttgaaaaaatgttttgggtccatgaaaacttccaaacatgtttcagatgttcagatgactttttctttttaacttgctctcctccaccccatatcaatgcaatggatatttgaaaactaaatccagaacctgaatttatcctcaataaatttgacttttcatattccattcagagttctggtattcctatattgttttcaatttaatgctagactttatattaattaagataattttatggtaacaataacattatgcatgcattgagtgtttgctacatatgaagcacttataaatttttacatataatctcatttaatttttaaaacaaccctatgaaatacataacatttttattcccatttttataaatgagaaagctgaggtacaatgagggctggtaattgggcaaagtcccacagctagtaagttatagagttgggatttgaacccaggccttcagatatcatcaactgaataattcatcagtgtcatgaggaattttctgaactttgtatgacttgaaactttgtgatgttttgtctgtatctatatacaagtcatgataagatgcctcataataataccaagcctctgtgatattccagtactttttattctggttactactgaaccaagaattattatattttagtcatattgtcaatgagttcactacccacagagctgaggacataaggctgctgtggaaaagggagtaaacacttattaaaagccaggataggcaatgtggcattcctgtaaagcactaattagtattttcagcagaaatatgttttaccaaacctattttgctgtcatttgaaagcatgttattttctgcatgttcacatttcaccttgcttcccagagtgtttacagcaacttgccacagtaacacatactaaaataatggtatgatacacaagtaagaataaaaaatgtgatctagagaaaaataagagttaaacacaagaccctagggtggaggatggtctgagagagagataaatatttaggccttaaggaaccacacacagttcccctggttgagccacaaattggtatgtttttttccttatgtacaggttttttttttattatactttaagttttagggtacatgtgcacaacgtgcaggtttgttacatatgtatacatgtgccatgttggtgtgctgcacccattaactcgtcatttagcattaggtatatctcctaatgctatccctccccctgccccccatcccacaacagtccccggtgtgtgatgttccccttcctgtgtccatgtgttctcattgttcaattcccacctatgagtgagaacatgtggtgtttggttttttgttcttgcgatagtttgctgagaatgatggtttccagcttcatccatgtccctacaaaggacatgaactcatctctattcttttattagccaccaggaagctttaaaaaaaatacccagaacaaattggtatttttttttaaagcttcctggtggctaacaaaagaatagagaagcaatcagttcttactgtcagttagaaaaagctatcccagttattcaagagaaacacagtatagcttgagactatatgtctccataggcctttttgtaagaagtattcagtgatataatttcccctatagcagacctacaatgaactgcttagtttcatgtcactgctgctcatattgtcctttgctaaaagctgagaatatgacactaaaacgagattcaaggaaagaaaatctgtaaaggatggaaaacgcagatagtatgttcaaaaggttagatagaacttggaggatcatttattcttcttacatcctccataaatacatagcttacctgggattttgaataaatgtgggcagcagaccattcaaagtaagattatctggaaagtgcttggagtttctgagtggtttgctgttggatccatttgttttagaaaatgaatgagaatacatggaggattatagccttttctggaaattaaggacctaaccaagttttttgttttttgaattaaagggccctgtccatatctatatataagtgagaaactgactttattggatgtctctagtgtttattcattccttgttccttcgtttattccttcaacaaatatttattcagcccctactatgccctagatacctaagctatagcagtgaaaaagacaggtatgatctctccttcaatagagtatacattttaagaggcaaggcaaacactaaacaagatactaattatacagttacaatcttgataagatctactaaagacaagtacaggtcggaaagtaagcacaaaaatgagaaactcaattccatttttacagcttccttacattatagatgatgttacctctaagatttttttcttttttcttttcctttcttttctttctttctttctttctttctttcttttttttttttttttttttttttgagacagagtcttgctgtgttgctaggctggagtgtagtggcgcaatctcagtccactgcaacctccacctcccgggtttaagcgattctcctgcctcagcctcctgagtagctgagactacaggtgtgcaccaccatgcccagctaatttttgtatttttagtagagatggggtttcaccacgttggccaggatggtctcgatctcttgactttgtgatctgcctgcctcggcctcccaaagtgctgggattatagatgtgagccaccgcggccggccacctctaagatattaacagccttctaatcactaaatccaatgtcctcttctaatctttagaaatgttcatattcgttggcatgggaatataaccatgaggtttaaagtttctgcttgtgcctttgtttgtagcagataaaatcttttgtttaaaagaaataaagcctacttgaagtccataaagagaaaacagatgaaatctggactgctttgtttggagatgcctcatgggaaggtgggagctctggctttccccacacttggtaatctcaggatcgtcttttcttgatccccatggtgctagtttggaagccactattctagaattctcattattatcagctatttatgtattggctccctggcagccctaaagactctgcctggactgacacatcccagtcctattcccagttctgtgccggagtctctgaacacttcttgaactgatctgagccaagaaagaaacttggacatctttggatttgtgaaatccaaactggaccctcttcatttgctgtgatttcccacccatgattacagttcacactctacttactaccaggtctccaaccaacacctcatttattagtccatctcctgtgtgtgcatggattggtgagggaaattagaaggaaaggaagatgattgcatccatcaattgaatcaatgtattctgggctccaaatatgtgctaagcattgtccaaggaagctgagggtataactatgaacaaaagaaacaaaaatacctgcactcttggaacatacattctaatggaggatatagacagtaaatacatcagaaattaaaattgtataacaggtggtgataagttcgttggggagaaaataaccaaagaaaaaggatagggtatgtcagggtgaggaggaccaaggtttactactttaacgaatgatgtaaaagattgcctgagtgagaaggtggcatttgaggaaagatgggtaggaatgagtgatacaggtgtctgcaggaaaagcattgcaaacagaggaagcagaaagtataatggagcttagttaggagcctggtatgtttgagaaacaacaaagaggtcgtgtggctaaagcaaagtaagagatgagactagaaaagtggcagaggagcagatcctgaattgtcctgtaggccattttgaggactttgggttctactctcaggaataactgggaagaagagtgacacgatctgtcttcagttttgaaaagatcaccctggctactgtgtggaaaatggaatgaagggggcaacgggaggtgcaggaacatcatttgggagtggttgacacaaaacaagcaagcaataaggggaaggaggggggataatttgttcaagtaagcctctttctctgttccatttgattggaacaaatggtacaacttagcagaatgtccagtaatagaggagaaagcaaataaaaattcaaagatattgagatagtacctgagtggtaatttaattaatggaaaaggaaatctcagaaagagatgtttttgcctaagggctagttgtgaaagatgaccctgaggctcaataaattgccttccattgtcagtggtatgtgcgtgtgtagataattaaagaggtgagaataaaaatagagggaaaagtcaaggattgagttttcaattttagagtttctatatatggagtactgtgtggtttataaaacactggtatttaatatattttattactatataaatgaatgaactacgtttcccaaacatctttctacgtgtgaagcaaaaaaaaaaaaaaaaaaaaaaaaaaaccacacagaaaaaaaacaagcaagcaaacaaaaacagagggaacaagagtttagagaagtcaaagaaatagtattcaattttctgtttagtaccatttattcagtgttcagtgtcaatgaggttatgagaaatattctagatactggagatacaaatataaatgaaacacagttcttgcccttaagaagcccacagtcaaatggaaaatatatagaaataaatagcactgtaatgtgataggcagacaggattgcttaattctcactgaaagattcagatcagagttaccctctgtgcagcttcttgatggatgatggggagggccagcatctggggttggagaaaagaaaggtgggtctcagggaagaaattccatgtgccaagatacagaggggtaaaattatgtggccttttcagtatatgaaagcagtgattcacagaacttagatgatacaccttgacaagatactcaagactcccaagacaagacactcaagagagtgtcttgaaaatagagtctttaaggagtaattcaattaaaattatggcattagtgcagactgtaattcaatacgactggtgtctttgtaagaagagaatgtccctataagaagatactcaagaattccaagataagacactcttgtgtcttgggagaaattctcatcttgggagtcttgagtgtcttgtccaggtgtatcatctagtacagaaaatagctcaaaaattgtgatagccttgagaatatattttacattacttactgtcgaaactgggactgtttttatcacaaaaaggggcactattaataattacactggaatgggtataaattaaagcagtctggggaaacccaaacatatggtcaacctaatgatacctgttttcctgcataaaggggttataattgtactaatttatggtgcaaactgggtgctaaagctagtgatgagtttctctgctagaaaaatgttccaaagaaataaaccaagacagttaatgcagagttttggtagaagggataactacttttagatggtaggtcacagaagcttgtccgaggtgaggactttgggctgagtcctgaatacaaacagccagctatgggaagctccatggcaggagtgctccagggagagggaatcccaaaagccctttgtgggagtccttctgttagagaagacctgtttggatggagaatacaaaaccaggggggcttgggagatgaggtccgagacataaggagaggctagttcatgttcagccatgtacatgtggtggggaatttgagttttattctaattggtggaagcacagcaggtgatagagcatacctcacgtactagtttacaagggctgccttcacaaagtaccctggactgggtgacttaaacaatagaaatttatttcctcgcagttctgcagggtggacctcccaaatcaaggtcctggctgagttggtgccttttgagggctgtgagagaaggatctgttccagaactttcttcttggcttttagatggctgtcttctccctgtttctttacattgtcttcctgctgaacatgtctgtgtccaagtttcctcttcttataaggacgccagtcatattggactagggtccgccctcatgccataattttaattgaattacttcttaaagaccctatcttcaaatatggtaagcctctgtggtattggggtttagatttcaacatacgagtgtttggagggacagaattcagcccacaacacctcattaagcctggaagagaccgtaagaatattcgattaactggataagaagcacttaaacccaatttctaagaaaagagggataaaaaggtatactgtttccaggtatagtatgaaggtcatgatataaaacagaaagaagctttttagaagggaacaaaaaacactggggcttacttcaggagggatggtagaaggagaaagaggagcagaaaaaataactattggatactagggttattaccttggtgattaactgatctgtgcaacaaatcctatgataggagttcacctatacaacagacctgcacatgtacccttaaaccgaaaattaaagttaaaaaaaggaaagaagccttatacagaggactatatatagccttatataaaggactatattaagaattcttgtgagaagtcattatttaggtgtcaggcatctatagccatttaaacagagtctgtgtgtaacagtcttgagctgctgatgaaagaaggtgtagaagagtgttggtgccaagatctggagtggagtggtaggatcctgacctggagcacccaggaatgactgtcctttgtgcacaggtgatagacaaaactgggggaatgaggagttgaacatggaggtatatgaggaaggctcatccgctcttcagaaatccagaaacctaagtgtgaaaacacagatttgagggcctccacctgacttggtgggatgctcttcataggagatattctcctaatgtacattacaaagtcaatctaggagtaatgtaaaagtgatagttatcttaaacaacctgaatattttctagatatgtgattttgcaaaaataaaaaaaataaaaaaataaaaaaatgaaaaaaaaaaaaaaaggccaggcatggtagctcacgcctgtaatcccagcactttgggaggccaaggcaggcagatcacctgaggtggagagttcaagacaagcctgacaaacatggagaaacctcgtctctactaaaaatacaaaattagccgggcgtggtggcgcatgcccgtaatcccagctattcaggaggctgaggcgggagaatcgcttgaacctgggaggcagaggttgcagtaggccgagatcacgccattgcactccagcgtgggcaacaagagcgaaactccatctcaaaaaaaaaaaaaaaaaaaaaagagagagagagagaaaagaaatatctgtgttaggaaaaaagctaggaaaagctaaattctggtcatttcataataaaacgaataatgaaacaaacagaaaaatattttatgtggaagaacagaacagagaccttgggcagaagtaaccatgacacgttggggtttgtataagtaataaacgctgagatatatgccttaaactttagactgtctgagatcagtttaaggcaaagatagaatattatgactaaagagcgtaaaatgaactgctgagcatgcaagtaccataaaaaggcccttccttcagaattgagctgatccatattttttctcttgatttcattttctacttaggaactcagttcttgacaggccacatatacaatgaatgtcccaaagattgcaatactgtatttttactgtatattttttatgtgtaggtacacaaatatttactattgtgtaacagttgcctgcagtattcagtacaatcacaagctgcacaggtttgtagcctaggagcataccatatagttcaggtgtgtagaggttacaccatccaggtttgtgtaagtatgctctataatgttcacacaaagatgaaatcacccaatgatgcatttcttagaatatttcctcatcgttacgtgaagcatgactatgtaagcattgagaatatgaatacacatgatttccaccaagagaaagcatgtgatcccaaatataattggtaaactagtattaaaattttttatatgtctttctcaatatctgttatatgagacacacttgtttcacatagaacagatgaactatttgttttccatcactagaatatttttcttctaaaacttttgacctatttgggattgaaataaatgacttctaaatttccatccattgctaatatctgtaattctgtgtattacagataattggctaattacctgagtatggtgttgcttttttcaatttataacagtttagaccttttaggatacagttgttgaaatatggcaccaaaacactaagcatcttatattgatcgtgtgtcaatttacctaaccttggcaattattttcaatatctattttccaaggaaagaaatgagtagttattatcaaattacacaagtggagaagaattggagtttaggtaaatattttgttctaaaatatcaaatggtcatttaagctgaattgggataaaacaacccctatgaattttgctggatggacaccataaatgacagcaaccctgttcttctgttttcatcatagtcaaaaaatgctttagagtttactacttctacatatctcatttagttttcataatggagattttctaatgcatgttttatagatgagcaaacaaattgaagatgttaagtgacttgttcaaagtcatatatgtgaacacatattgaacataacttatttggccttattactataatggtcattagaatatctttaaaaatataattttttaatcaattgacattacacaatttttatttgaagctttcaaaattaacagtaataatgttattttattaagcacttattatatttcagtcacagtgctaagcacgtcacagtcatcatctaatttactcaatctgaaggtatgccattctctgaaaatggcaatatacgcttacaattatttgtagcatagcattctacactaaaaagatgaaataaagaagttgaaattttctttatcaattaggatagctaatgatcttctgtggcaacaatcagcatgtcttacagcttaaaacaacaacgtttacttctcatccaccttacatcctatctttggtgtacctggagctctgtctcatgtcgtccccactcagagactcacgctgatggagcagccacaatctagagcctggcctgccacagtggtagaggaaaagacagactggtgaactgtgcagtgatccctaacacttctgcccagaggtgatgccagtcaccttgatcgaagcaagtcaatggctacatcaaatatcaaaaaagtgggaagtgaaatcttaaaacaccccggaaaatactggaaatttttattttagttttacttgaaaaaagtataaattttgattttctgtattaaatcacttattcaaacaatgatttattcaacagaaagcattgaacactgtatttcttttctgacaaccacttctccaattctctgacaccaactgggtgcccaacaattttattcaattctgatactacctggagttagcacagatcccccaggttaaggactcagtctcacaagacttctgctactctagacaccagacactgtacatggagtgctcgggctacccacagttttgtgcagctgaccacaaattgggggttctcatgaccccctccacccctcagtttccataattcagtagagccactcacagaaccacgacatgttctttatttgcaattattggtttattataaaggattcaacttaggaacagccaaattgaagagatgtattggacaaaacatgaggaagaggacccagagcatagatgccctctcctggcacactgccctgccagcatgatgatatgttcaccaatctggaagatcctcaaaccccatcttttagagttttgtgtccaggattcattaaggtagacatgattgattatacattgcccattggtgattgaactcaatctccagcccttctctccaacccagatgtcagggacggggaccttcagttctgttcctctaatccagtagtttttaatgtaatcagtcctcatcctaaagcaaaaagctacccttttctcccccatgagttatttcattagggatcttaaatagaagactattccttcagaagattttaggagctttgtgccaggaagctgggagaaagatttttttgttgttgttacactacacacagccatatgctgagcttggtgcaaggcacgggggatacagtggttaatggagcagacacagtccttgtcctcatgaaacttcaagttaggcaaactcattgaaatgaagatcagtctagagaagttagtaaaactgaaacaaagataaataaaacatgaacttgattcacagaaacacttacctccatatatgaataacatcaattagtaaactgggaggaggaaggaggtgctgggtgtggaatggacgggaaaaatggagaagtcaacactgaatttctaatcacctaaatcactttaagtctcatctttttgacatggtgatggtcaaagattggcacattattcttatcaaagcacaggatagggtgctaggtggaggaaccaggaaagattagtcagagaagatgccttgaaattctatgttagattgtcatctaggttatacagctcatggacaaaaatacatgcataaaatgatgcccacatggattaatggatacatgaaattttaaattcctagacaaacatataaatcaatgaattattaagtttatactagttgtatatgggactatttgatattgcttactttgttctttgaattttgcatttaggagatttgtagtatgagtttcttgcagaaatcttaacatttccttaaaaaaccacttccctaaaataatccttgaggaaacatatttgtcagaaatgttcacatcatattccttttgttctggtttatctcatcctccttgacttctccacatctctaagtaggaagttatttattgctgctgaagttgtaaccctggtgatttcgctatcaacttacaaatcacttcctttccatatgactacagcatgtaagaatgctgaggttttcttttctccaaataaggcagaatgcttcaagaatattttatcgtcctatatggatattctatacctttagagtgaacactttcctctattaaaacattaacagtcataatgagattcagtccaactggaccgagcttgtgaataaaacaagatgctccagtctgtggttcaaacattttgaacttcccagaatataattaggtatagaatatagttcttatctttctttgagaactttttgaattattgttatagtttctaaaatatcttttctattttgagggtaaggtcacaaaacagaaaaaaatgtgtatcagagtatgttgaatatggctgtttgtcagatcaagtttacgctgtgtatgggccttcgtccaatttagatgcagatggtataagggactttgaatatgctatattattattcagctgacttctccagtaaataatagtgttcttcaggaacagaaaaccaaacgccacatgttctcactcataaatgggagctgaacaatgagaacacatggacacagggaggggaacatcacatacactggggcctgtaggtggaggggagcagggggagggagagcatcaggataaatagctaatgcatgtggggcttaatacctaggtgatgggttgataggtgcagcacatcaccatggcacatgtttacctatgtaacaaacctgcatgtcctgtacatgtatcccagaccccaaaataaaattaaaaaaataataatagtgttctttagcgtctttcatgtgaatggaagttttgcagacattgtcacagcagcattttttcccgtgggtttccactaagtggtgccttcgccttgggggaaaggtgtctcagtcttattccagtctgcttcatttactgttgatgtgatgattgctgcctatgtagtatgtgactttctagggacaggcggtcaggtttttctggacccctctttctctgaggatctcttcaaaggaatagcctttggccttgagtgctgcctcgagcccacaagcaccttctcatggttgagcacaccctattgcttgactcagtgaaatacattgaatatcctgccaacactttttgttgtacatctctttgccctcaggctagctacagaaagaaaaagagagagagaatacatttttacatttcctgttcttcatgttgaatgaggcagtttatcttctgaacagctgctttgaaggtttgagtatgttcgatgcactaaacataacagcatagaaatgaaaaaaggaggttggcaaactaccttcttatcttcttttaaggcttttgaaggatttaagttgtttcaccttttagtggcatcacagagaggttgagatttcacttagagagaatggctttgatgtgctattttgtatattagtgaacaggttcacaaagatgccattctctaatcaatgctcctgctcccacaagacagaagagaattgaggaattaaggaaatgccaagaggtagaacatccagtatctttggtggagatcttgctttgctatgtttccttccttcaagttatttgatctgtgcgtgtgcctgagcatttattgtacaacagatactgtgctaaggcttttataagctttgtattgcttaatgttcatggcagccttgggaagaaggtactgttagagtaggaatgctactataatcttccaactgggttgacattaattccttaacctgctctttttgacttttcttcttcaacccattgataatctaattgtcctatatttctgtaaggttattctaaggtattttttgagattccttattaagaccattaatacggctgggcatggtggctcatgcctataatcccagcactttgggaggctgaggcgggtggatcacctgaggccaggagttcgagaccagcctgaccaatatggtgaaacaccatctctaccaaatacaaaaaattagcagggcgtggtggcacacgcctataatcccagctacttgggaggctgaggcaggagaatcacttgaaccctggaggtggaggttgcagtgagccgagatcgtgccattgcactccagcctgggcactctgtctcaaaaaacaaacaaacaaaaaaactttaatacgtgtgagtatagtagtgaacaattattatgggcttagtaagtgccaggttttatcttaagtagtttatgtgcaaacccgataacacccaaacaaccatgtaaaatagatatcataagccctattgtattttaaatgaagaagagatgataagagacatccctaagctcccactgacataaaatacagacaccaggatttgaactgggcccatcttactacagagcctcaggatttaacccccactcttccagttttcttcatggcctattgtcagagtagaaacattatttctattctgaacatgggctgtgctcaataaattattgcttcatctccttgatgataacaaaccattgcctttcttaaaagtcttttctaaaaaattttagcctagtaatttcaaaaaaaagtaaagcagtaaaatacgtcatcctgtaaagtctaaagatttgaaatttaaaagttttcaggctagagaacagaacttgatgtaatttctagaagtgaaataactcttgttaaaatcagatgctgctggtacgcaatccaaaagggattgtttagaccctagaagcttcaaataaattgagtctcagaaataggggggaattgagtcacacagttctgattgtttttgtcaacctactgaagaggaacaggagcacccttccgaaagagttcagagctgagtgtgagtattcacaagcaagaacctctggcacatcttcatctttataattccaatagcaatggcaaacaagaagactcaatgtttaacttcagatttcattagacggagagccgtgtttacaatcagctgactcatttgagcgttctgacaagctctcaatcctatctggatctgttaggttgtcttttaaaagaggaaatatttcaacagagataatattcctataagctgtgaaagtctgtctagaaatcaattgttaagcaacctatagagtttagagcagaaaaagctacaaaatgaagtaaatttttatagtggtttctagtgagaaacaatgtatgccctaggtgcagtgggccatggagaacatttattacattcttcttgtatgaacactgatatacgaagaaaataaaagctcagcttttgccttataacactacacttgccatggtacacttcaaaattcacacatgcatagggagattatttacacatgtgcaaaactaggaaaataaaataatgtgaaaacatactagttaaatgtgattgtgcagctcttttacttctattctggattggtgtttttgccaaaccctccctatgtcaacacaggtgacccctctgaaaggaacgtgccaattatagttgacaaaggggcttggtgcactgaatcttgagaaatgatcttgaatgacctccaggatttaaatatagttattgaaaggggccgaaccaatgagatgattcacagcttccgcatggagccatctctatatgctaagtacgaggccagtcctcataaaaacccgccaaggagggcagtagcaccattgttaccagcacagactcctccctttcctagctgtgtgaccttaaggagaaatatacactccagaaatctgctgcttcttctctgaaaagggcacaacaatagtcgcccattgtagagaggattaatgggataattatattatgtaaaactcactgaagtattttgtttacatagggactattcaataaacataaaaattataattattacagttgttataattccccttttacagctgaggaaactcccaagaccacagaataagtggaaaagttgaaattggaacctacctctttttgactccaaatgaagtgttctttttaataggtacagtagttcccacctattcatgagagataccttccaagacccccagtggaagcctgaaaccacagccagcaccaaaccctatatacactgtgtttttcctacatatacctatgataaagtttaatttataaattaggcagagtaagagttcaacaacagtaattaaaaaaatagaacaactgtaaaaataatcctgtaatgaaagttatgtgaatgtggtctttctctcttatatatttctggaatattccatttaatatttttggactgaaactgtggaaagcaaaacagtgaataaatactgtaattagtgttcattgataacataattttggccaagtgcagtggctcacacctgtaatgccagcactttgagaggccaaggtaggttcatcacttgagcccaagagttcaagaccagcctgggcaacatggtgaaaccttgtctctaaaaataaaataaaatacaaaattatatatatatatataatgtatatttatatataatatatatttatatataatatatatatttattatatatataattatatattatgtaatatatataaaatatatattatatattatataattatatataatataaaatatatattatatattatatatatattatatatattatatatataaaatatattatatattatatatttatatatattatatattatatataatttatataaatatataatatattatatatataatatatatataatatataatatatttatatatatatataatatatataatatatatataatatataatatatttatatatatatataatatatataatatatatataatatataatatatttttatatatatatataatatatatatgccaaatgtggtgatgcactcctgtagtctcagctactctggaggctgaagtgggaggatctcttgagcccaggaggttgaggcttcagtgagtcgtgattgtgccactgcactccggcctaagtgttggagtgagaccctcaaaaaaaaaaaaaaagtttttttcagaattccgactatatgccaagcactctgttgggtgctgatcaacaaggtagactaagtctttccttatggagcccacattccagctgcctctgacaatgcttttccccatggcactcagaatcctgattcctgagtcctacagaacattctgtaacttggtaattctgaggctgccttggggaacaagcgtaaggaggagggtttcctcagagcagaaaggagggaatgtttttcctgcaattagagagtgcagtgacagtggcaaccacagtagcctcatagagcaccagggatgacagggaagaaagtgaatgctgacctcggctgaaacagcgctggcagcttcagcagatatattacatggtacttaccattacttcatacagtgttgagagttttggctcttgagcagaatttctgggtctgtattttacctatgctgctcatgcattttatgatcctatgtgggttatttaagctttttgtgcctcatctataagattgagaccattatgatattgatttcataggtactttgcaggcaggattacctatctgagagaaacttgatttatttctttgatgcatgcaaacttaagcttgccaatgctcatatttgtgcatttttccccacacaggacagtgcagtcgttaaggcaccatggttagtgtcatctctacatgcctcagcctatctcaaggtctcctttggacagtttgcaaatgagtgcctgcctgagtctctatatctgagggagtcctctgcctgggggagcttatctgcccatgctcaagacatgagggctagaatttgtagataaatacaacagcttccttgtcccttggagatgattctcagacatattccacaatctctcagaggctccctggtggtaccaaatcccagttgtccacagcaatagtggggttgttaaccagctttcctcccttctctgtctcactgccccacttcctcaatttgctctctgggatcttcccccaaataaatgacatgctcccaaatccttgtctcaaggtcttgttttaggaggaaccccaggcaaaggtagttacagattttagagcaggacttcctcctgcaaattctgacttcattacttacagggattttttttttaatactttaagttttagggtacatgtgcacaatgtgcaggtttgttacatatgtatacatgtgccatgttggtgtgccgcacccagtaactcgtcatttaacattaggtatatctcctaattctatccctcccccttactcccaccccacaacaggccctggtgtgtgatgttccccttcctgtgtccatgtgttctcattgttcaattccaacctgtgagtgagaacatgcggtgtttggttttttgtccttgcgatagtttgctcagaatgatggtttccagcttcatccatgtccctacaaaggacatgaactcatccttttttatggctgcatagtattccatggtgtttgtgtgccacattttctgaatccagtctatcattgttggacatttgggttggttccaagtctttgctattgtgaattagtgcctcaataaacatacgtgtgcatgtgtctttatagtagcatgatttataatcctttgggtatatacccagtaatgggattgctgggtcaaatggtatttttagttctagattgaggaattgccacactgtcttccacaatggttgaactagtttacactcccaccaacagtgtaaaagcattcctatctctccacatcctctccagcatctgttatttcctgaatttttaatgatctccattctaactggtatgagatggtatctcactgtggtcttgatttgcatttctctgatgcccagtgatgacgagcattttttcatgtgttttttggctgcataaatgtcttcttttgagaagtgtctgttcatatccttcgcccactttttgaagtggttgtttgattttttcttgtaaatttgtttaagttctttgtagattctggatattagccctttatttaatttttattttgagttcaggggtacatgtgcatgttttttatatagataaacttatgtcatggaggtttgttatacagattatttcatcacccaataattaagcctagtacccattagttatttttcctgatcctcttcctcctcccaccctctaccctccaaaaggccccagtgtgtgttgttcccctctatttattcatatgttcacataatttagctcccacttataagtgagaacatgcagtattcagttttctgttcctgcattagtttgctaaggataatggcctctagctccatccatgatcctgtaaaggacacgatctcattcttttttatggctgcatagtattccatggtgcatatgctttatcaagtctatcgttaatgggcatttgggttgattccatgactttgctatcgtacagtgcttcagtgaacatacacatgcatgtgtctttataataggatgatttatattcctttgggtatatatccagtaatgggattgctagatcaaatggtattcagacaagcaaatgctaaggaaatttgttaccacaagaccttccttataagggaagcattaaatatggagagaaaagaccattatttacagtttttaaattaaggaaatgattaaacacttcattatttcaattttctcatgtctaaggaaggtatgatgataaaagctacatgatattttttgtgaagcttagctgaaacagtacctgtcaagtgcttctagaccattgcaagttttcaataaatgttagcttttattattattattattaatgtcagcctaccttaaaacttctttaaatagatggcatgaacagctgtagataactgcagggtgtaaaaattctggcagctttttttatacctgtttaaactctttgagcttaacgctcttcaagttccctgctggcctgtaagtaatagaccaatgtcagtggaggagacatgtagatgttaagaatgaactaagtttgtaaggtaaaaagccaggcttcctatatgcctcagcagatggtctgataaggacgctgagagagagtatcatgaaatagaagtgaagtggattaacaagaaaatccatgttcctggcacactaaggtgataagtaaatggttttctgtggctttgctaaaattttgaaaaattcagttagcagcaccgttgcctaaacatagtatggtatgttaagaaggaggattctaacaagcacttgttaagtgcctattgtaattaagacaaatatgatttggtttgtgctctcaagtctggtgggagagataggcatgtaaacagatgaattacagcacgaagtgctactgctgcaccaagacaggcaaataattcacttaagctaaggcagggaagaaagaaggaaggggatttttatatacttttatctgcgctgaaggtggctttacagatgaggaacccgaaactcaaagaatgtatgtcaattcattaaggcatgcagctgctaagtggggagccagcatttgaatcaaactttctttccccaaggttgtctccatcatgccaggctgtagtggtgacaggtggaaaggtgtagtgagccatcttctaggtatatctatccctgagagcaacaaatcctggtggttctctctgtatatagtcacagagctccagggcatgtagtacttagaattttgtttttgctcattgcacaggaaatggtatgaaactgaggtaattcatacacacataatttgaatataaagaagaaaatgatagaggcatctggatgacctgatatttaatatagtaaaaggaaaatgttttcctaagcaaaatgagtggtatacaatgaataagttgtggtcaggaaccatgtccccagagttttggcttttatcctttcattgattcacaacatgaatttttttttcctaaatatccttcactagaaggcagaattaatcaacctttgtaatttaacagattatttggatacaaaactaatgatatttttattcaaacatgtcaagaccttggggatatagcatgggatttggggagcaggttggttgttgggggcagtcgtctaaagaatcagtaacatttgagtgcctaaaatattaattattgtcctaccagcaatactgttctctgtccttaatgatgaattaagagattagaaaatagtaaaaaaataaaaacaaggacataatttccatgcgataatgataggactttgtgatatcacatttaaaaagtaggtgacttttatgagagaggaagtgaggaaaagaagccagcatttattgaatgcttgctgcaggcttctgtgccatgggtattaatagtcccattttacagatgaggaccctgagaatcatatatttagtgtcaaatgctttacctaaaagggcaaaagtataactagaacaaaagttcaatgcttaactctgaaaaaatctgttctctttgctacagaccatgccatcttggtgaaaatatcccaaaagatctggggttgagttacagtgccaaaggggagaggaatgtaatattgcaattagatgatgagagattgtcttaggaacactgaagtacactggcaaattttgggaagcagagataaattatgttgctaaaagccaaggaaggctgggcgcggtggctcacacctgtaatcccattactttgagaggccgaggcaggtggatcacctgagatcaggagttcgagaccagtccggccaacgtggcaaaaccctgtctctactacaaaattagctgggcatggtggcaggcacccataatcccagctactcaggaggctgaggcaggagaatctcttgaacccgggagatggaggttgcagtaagccaagattgcgccattgcactccagcctgggagacagagcaagactccatctctaaattaattaattaattaattaatttttttaaaaagccaaggaaatcatttggctagagagtgtgagcttgagaattggatagaagtaggggaagttaggctctgtggcactgggtggtggaaagtctgcagtcagcactttgatcaggtcaaacccagtaatatttttgaactcttatttttctctgtcaggtgccagcaagcaaaactgagtaaggaaataatagtttatggccttatattttagttagtttgagtacctgttgacaggtggtccaatttttgtgtttaatttagaagaaattctgaaggatgaggtttaataatcacaattgaagtagtggatatgggatcagagtctgattgcattggatacaatattccaagatcactgaatgatacaactcctgcaaaaaggatgctatgacaatataagcataaagccgcagggaagtggacagaggtcttaagggttggaaaaaggagtgggcacatttgtgaaatgtagcagagctatgggatttggactttgcaatgtacttgtacagtaggactaaagcagacaagcatagaatgcatgccattaattcttagccttgaggcataccttctcaataattaggagaatgaaaagaggtgttttttatatatccttccacctttatatatattttttattgttcaatgaagtagaaccctgtataaagaggagttcagggaatctattaaaaatccagggtaccttctatgtcctagtcagagttcttggagttgttgaattataaaaatatgacatcccaacacacactgtagggatcaaaacctaggtgtgtggcaggaagatagctcataggcaattccaatatttgcagttgaaatttggcatgaaacactgacaatttgcatcgtctgtccatccttcatgagctgatgatgcccaatgcttgtctcacatggcaggtctcacttcgtactgaaatgatgaagttacttctctgcctccaacactagattgtgtgttgcctgagggcaggagcaatgtcatcctttttgactttctggcacttaaaacagaatgtggctcatagttggaggtcagtacatatttgaatggaagaatgcatgaaaatataaacgttagactcttcccttatggttattgttttagtttataaagtagatgtaaatatagcccaagataacatagcaatttggcaattctccatgaattttctgtaatagaatatttcagtaagcacagtatacttcctgttttaactttgtggctaactgatctttagttatttgacagatatttttctggcaggcaatgcgctaaacattgggggttctctgcaactgttttttattttaagtggtaaagttgctcttttaattcaaatttgttttttaattgacttataaacttgtatgtatttatagtgtacaacatgatgcttcgaagtgtcaataatcaaatggttaaatctagctaatttaatcataatttaaatagctagatctaaccattttgttattgacacttcaaaacacacaaacacacataatgaaatggtcaaatctagctaattaacaaatacattacctcacatagttatcatctttatggtgagaacatttcacatccactctctgagcatttttgaaaaatacagtatatcatcattaactatagtctctagactgtataatagatctcttgaaattatttctcctaactaactgaaaatatgtatgccttggaccaacatctccccactccccacccccaaccaccccagcttctggtacccacccatcttcagctgtttgtaaatacctacggttgatgaggaaatgcatttgttgaaatatactgaagcctgtggattattgtaataatccttttatgctatcaaagatttactgctctttgagcttaccttagttgggtcttgtaaattgagtgttatttgagaacagaacacaggagggcaccagaggacaagaaaacgacaaccaaaaaaaaaaaaaaaaaaaccccaaaaccaaagcactgaacttctggctctagaatagagaccctgctaaatgtatcatctctcagcagtccatttctattaagtcttattctttaaaggccatgaggtatttgtaaacacgagagctttccaaactttcattaaaggaaagtgtccctttcccagacaatgcttccagctcagtcagatgcccaagcatgaccagaaggagacatggatgaagagaacccagggggtgtctttgcacacatgatgctctaaagcattttcagatctcctctatgggcccagcaagagtgctgtttctgaggaagaaggcagattgctggacggattcacaaaccacggcagctccaactctcctaccgatgcctttactccaggtgcctcagccagtagcaacaggtctccctgttggtgatacccaagggcaccatttaagaagaaataaaaaatgatgagttcatgtcctttgtagggacatggatgaagctagaaaccatcattctcagcaaactatcacaaggagaaaaaaccaaacactgcatgttctcactcataggtgggaattgaacagtgagaacacatggacacaggaaggggaacatcacacactgggcactgttgtggggtggggggagtggggagggatagcattaggagatatacctaatgctaaatgatgagttaatgggtgcagcacaccaacatggcacatgtatacatatgtaacagacctacacgttgtgcacatgtaccctaaaacttaaagtgtaataataataataataataataataaaagaagaaatagacaatgggcttaagtgttcactcacctcctgtgcttccctgggcctacggttatggctcctaggcatatgggagaggttgagtcagtcactgtggcttagaggctgcagtgccttatcaatttctggcattgaattatgactagaatttgaaaaacatcaaacatggcttccatgacatcatagtctcagctcagtatgtcactgagaggttgtagtagtttgcagatgacagtgatcaatgaaaacccaatttatttgactcaaagggctgtggatatatgtacgtgaaaatgtattctacagccctaacctgctgcatctggctctggaattccaggtccacatttctgagtatctgctagtcatttccatgtatagagccatcccttggtatctccaggggactggttccagaacttcaaaggaactcaaatttgaggatgctcaaatccctgacaaaatggcatagtatttgcatgtaacctatgcccaccctctcacatactgtaaaatcatctctagattacttgtaataaataatacaatgaaaatgctatgtacacagttgttactgtttcgagaatattgacaaggaaaaagttctgcgtgtgtttagtacagaggcaaggttttgagaatattttaaatccagagctggtcgaatccacagatgtggacccctcagatatgaaggatcatctgtttatcccaccatctcatactcaggatgtttaaaatagagctaatagctgtttctttctcaaacccagctcttcttttctttgtttcatctaaattaagtagcaagaccaagttttccaggctggaaaagtgtaagtgatcctcaactttgtccccccaccttccattcctatcattcagggggtcacctcaaccatctcttctatttatacctttcattcatttcactctgctatagagcattttgaattcaggatttatttacctcctttctaagtaagttgaatggcctttctgtgctttttctgttctggtcttcacgtaatccgcttcacattctttttaaattcacctttcccaagattcatcattgcttacaggacaatgtccaattccttagcattacatgcagtccatctatctttcctaccttagctctcacttcacagctcataatccctctcctccccaatgtacacaaacacacccacctttccactgtggttcatcttctggctattggttatattttgccttcaattacctctgctggatatggaatagcatagaagttatgcacatgggccctagaactaaactaggggtctgcaaactacaatcagcaggacaaatattccccaccacctcttttcataaataaccatttattggaactcaccaaggaactatggagaaacaaggaagaatttcactataaaagacgccagaggaaaaaagagtacatattgtatggttacatttatataaatctaaaaaatgcaaactaatctctagtgacagaaaacagaaccctggctgctagaggagcagggagaggaagggagtacaaagagccatgagaaaacttttgaggataatgtatatgttgcttatcttgattgtgttgatgttttaatgggtctactcatatatcaaaacttataaaattgtacaccttaaatatgtgcagtgtatcatgtgtccattatacttcaatttaaaagaaaacatggaaaacattcagcatccagtgtccccatagcctcagccacagttagcccgaagagttgcttgtgtcttgatagagagaccactgaagtaatttccacagttcagggttatcattccattgctagttctaagaatcttacccttttcatgcctttggtctctcatcaaagatgtaggatggctggacttactaatcttcaaggcacttttcaaatttctagagtctctctgtggggcaaagtggctcacgcctgtaatcccagcactttgggaggctgaggtgggtggatgacctgagatcaggagttggaaactagcctggccaacatagtgaaaccccgtctttactaaaaatacaaaaaattagccaggtgtggtggcaggcacccgtaatcccagctactcgggaggctgaggcaggagaatcacttgaacccaagaggcgtaggttgcagtaagtccagatcgtgccattgaaaaaaaaaaaaaaaaagaaacaaagaaaagaaaagaaaaagaaaaaaatttctagtctctctgatctccatttaacatgttcagtctacaagtattttggtggtacctaaacttattcaggcagtatgtctgtggtctataaatgtacataccccacctttgctgtagttgatgcctctgctgctgaaatttgtttcttttctaagtgttgcatccctctttgaaacagcaggggctcacctggcaaaacagtcctgtaagcagtagtggagaaacttggctgctcactgttcctgttttgagtaaattacccttcttaattgaacattatatgatttggcttcccaaatttgtgttcttcttttcaaaaatctaacagtaatagagtgtatttagttaggttcaaaatcatattttttaaaaagaaatgcaggaaaaaattcaaaggatgtttaatgagaatatgatagactttgaaatggaagatatcaccaggaaattctccatttcttaggactatataagtgacactgacttcacacagtggttttaaggttgagtgtactgttacaggaatatgtaagctgcttaaaacatttcacaactcatggtcagacaatgttcctttgagaggaaaattcactggcgtttctcaaaaacctgactgcttaaaatccaagtgacccaatgctggccttgcttatttctagggaaagttgccttagcaacctactagcattaagttgcttaaaggaatgtgtgtttaacattgttataagccagaaacagagaaaacagttaacatttagacaagtgattattactggcatccaggtaggctgttggaataaccaggatatgagttgctaatcgttcatttattaatcttcatggaattaaatacagaaaggatgaatacagaggagatcctgtgctggacacattctctgtgttagttcatttattcgtcaccatatccccttgattaaagtgatgatgagtctttccattttgtaacttggagagactgaggctgagagatgtttagatgtttgtccaaggtcacacagctagtacctgctggagcagaaatttgaagccatgtctggctcattcaaaatcctatgttctttctcacaccctgctggctcactacttattgtgaggcatttgaatgatcattcagctatttcctttacctgatgtttttagtttgctggcttcagtttcttagaggcaccctattgggccacatgagagattatagaattatgttgtgatcatggtgggctattatctctgcaaactctcctgacaccatcagtgcaccaggaaggttggataatcctacgtggatgtggagaaatctcaacctttttttatttgacattaggatttttttttccctctaggtggtgttttcactgactttgtggattgcaaaaagttgagtttattttagtttaacagtcaagaatgtggttctttaggacattttctctttagtgtgcctggagcttctaaatcttatttaaaccttctttttgaaatagatgttgcatatctttggctgtaagaggaagtcaggacttgttctctctgcttccagacccactccccagccatgtagactttatatttgaaggtccagagtgatttttcttttttttttttttttgagatggagtctcgctgtcgcccaggctggagtgcagtggcgcaatctcggctcactgcaggctccgccccctggggttcacgccattctcctgcctcagcctccggagtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccagagtgatttttctaaggcaataatctgaccctgtcattcccagcagcatgtagaaaatcaccttgacactccaggtacattcaagtgggctgccccagaggtcatggaacaaaaagcctcctagaccaagctaagatgtgaaattataaattgtttattaaatcaatttaaggtacactttaagcataaatcaaggggaaagtgattggttcaataaacacaggagagtgtgcaagtgggatagaaagactaccatatctcaatccttggttacacaatgttcatctaccttggttccctctctgccatattagtcttccctgctgatgaagtagttacaagaaccagagttgagattaagaaagggatacaacagctgggaaacactggtcctgttacaccattgccctcctggggagacacaagggcaagtatatctggccatagctatcacttgccaattagcctggtgactagatatatgttttatctctatgtatcaaccagagcaaatgtggggccagaatgggaccaaaatggatgtcaccaatgggttgaccagtttagggatgaaggagtcaacagagattgtctgagcttcataaatatttaaggtttactctgtactttcatccctttctatggggaagtaactctcttatttcatcctttttatctttgttcagcacacacgtgctctttttattttctctatgtctcacagctctcagagattatcaatttgctccctacgctttaatccattctataagttccatccaactttttgttgcttgctatgacaaaatcgaataatcttaaataatgcagcaaacacacgttgcagcctgtttaagatattttaagagttctttttgatctaggagataaaacacaaagttttcagtacagcaggttcttgtaagcaggttcttaaaatctcctcctggctacatctttagactcatttcctacctctcataaaaatgccctccactaccctacgacacggaagtactcgacatttgctgaacttgcatgctctcttaatctctatacgtggcagtttttaaaatctcttgtctacctggagcactagttctgcacattcattaaaaagcataagctttgctttctctaacaagtattacttgaacaccactatcttcttaaccccaaactcagacccaaatgtgcatgtatatatgcacacacacactcccaatagcttctctctttccctgtgttccttaggtataatgcaaagaactcatagtagtattaaagcacttaaaacattgtattacatttttatatcactctctactccattagactgtaagtaactttgatccagggatcaaaatatatttctccttttatctccagccactagtcaatgtccagtgtgttataaataagcagtaaatatttgatgagttgttgagttaatgagtaataacaaataaatgttattgtacaacaagttggcagatatttgttccttgaatagaatgatttttataattgtcatttacaaattcagtttagatgggatatttttctcttatttcttcccttgaacgttttcccccaactaccgtgtactcccattactagatttttttataaatcacttaaatatgtttttgtaaattattaatagcagcaagtagtgctgatctgttgggcacctaatgtgtatcaagctgtgaattagaacttgtcttccactggtcccaagagagctggatcagttcacaaccctgcataaatggtagctaggattatgattcagtaggagcatatgtagcctcaagcaggataattagttgtaataagcacataaccacattttctccctgtttctgtgttaggggatggcagtcaattcacactttgaatttcaatgtccataagctgcatttaaatacattcatataaatgcatgtcaagtaactaccatgtctaggccttggactagattctgaaaaaaataggcacaatcactggcctcgtggagttcatagccagcatcaccttaaaatcaatgagaagtagaaagtcaggttattgagaccaggatgatctacgctgcatctaactgggggatattaagttctcacagacattacaagcttatcccagtcaatataagctcactgtataatcaactacctccatatacaaatgtcccctcctccagtggcatgatctagggctggcagggattcacctttccttacccgtggtgcttctcaaaattcccctgctgcctcacccagccacccccattctcacccagtctaagtatcagttccaagaagcatttctagttcctctacccctttgttttccgcaaaccttcacatctgctccctcagaagcaccattggttatggaggtctgatctgaagttctacccatcactcacacattcatcatccatccagaaggcagttttatataaacccagataagcttggctttgcatctacttagtagctatttacccttggctgagataacttaacatccctgtttcttactgctgtcatctgtaaaatgggataaaaatgcttacttcccagtattctggggattaaatattaagctccagtacaaagtgtaacaatgactttatgcgtcattatccccgctggtctcccatagctgttctctagcacccctgtgccatctttgggattgtcgagttagccctgaagtggcaaggaccctatttcagtgctcatatttaaaaagcaccaccatcagcaaaaggggtgtagagaggaggcaccatttagaatcttggaaaatctgaaaaaacttgcttctaggccagagagtagagagaactgtgagattgtgtgctagccacagtagaccaatgttggattggagatgataggtcgtcttaatggaaagtgtgatggggagccaatgtggcacagtagctcagagtgtgggctctggagccaacataagaagagttaccctaacagaatatagaccacagagttcttcccttcaagtatggattcatcatacatccttcaaacctgccaagtacttcactttctttctctctaccaacctgcttcttaccaaccttctaaagtcctgttcttgattcaccctaggctcacctataaccttcagaagccctgtctctgactcttaactcttcctgtcttaacactgagcctctactttcagctttgggagccacaatgagtgtttcagagctgaagaatatctggagcccatatgtcagacatgaaagatttggaaaaacagaaataaaaaagttccttgaagtatttgaaatgatttattcaagtagggttgggacctaaaaatttgccaaatatatcataatgggggagtagtaccaggaacgtagagaaaggaagagaaaaattgatctcatagaaataaaacgtagaacagaggatactagaggctgaaaacaggagggggaaaatgggagacacagagagatttgataaaagacacaaaattacagctagatagaaaaaataagtgctagtgttccagagagctgcaggatacaacaatatacagtttcaaacagctagaaggagcatactacatattaaatgttccccaaacaactaatgataaatatttgagatgatggatatgctaatcaccctgatctgatcaatatatattatatgtatcaaaacatcactatgtaccctgtaaaaatgtacaattatttttcagttaaaaaaggaaaagaaacaaaaaaataaatattctgagaagatgaccttaagagagatgttggaagagagggagggttgggaaaatgggagatgtctgagaaataccctagaggaaatttgaaatagaaaaacagagctgaggaaagaaataaagatgaatcaaaaattaaattggagttatatgatggttcagggagcaacacatgtgtagagaaggaaatgagaggctggaactttggggaatcccagagttaagtaatagacaggggaagaggcagggaggggaggttgctcatgaaagttcatacatgtgggaaaaccatggacagccatgtcactgaagatgggagtggctgctgaagcctaatggtgatgaagaagactagaaaatgttccttatgcttggcgatttgcagattattagtaaccagatagaacagcagagaaaataactagctgccaaaaggttggtggggagggcttggagggcagaggaacctgggctcagcagcagtcaagggggattctgtgaagtctggggggagaagcaccctggtgggacactctaaaatgtcaaggtgaatggagaaagcaagggaaagaggcagggttatgaggagggcttctgtgagtggagtgaaatttaaggtgcctaaagaaagctaacaggaaaagtctgaaggttgagaaaagaagcaagatcactgttaaaaaaaaaaaatatatatatatatatatatatatatatatatatatatatatatatatatatatatatctcaaagaatctagaaaaaggataggaagtggagtcagaggagagtttagtcttggacaaggtggcagggtccttactctaataacagaagcaaaactgtggattaagcttataaggaagggatttcatttatttactcaacaagcatctgagtgtgtagatgcagacatgggcattttagacctggttttcaaggtgcctccaatctggttggggatatggataactgaagaattagtttgcaacagcatgagataaaccatgagggatgctgactggggtgttgaagggtgagaggatggcaggtggtgagagagacattccagagtttccttgtgagttacaggtttggttaggagggaagtggagctaactgttgaagaatagagattggccaaatctctggaatttcagaagcatcaactttgggaaacggaatttgctaatggagtggagtctgatgcagttcttcacttattttcttctggtatgcagaccaaaattatctgagaatgatcttttcacttctggctacaaaaatgcaagccaccagtagaaccacaggcaccagtttacagtgtagagagcactggactgggagtcagatctgggttgtacttatgtggtcatgggaaattccttcccctaggtgcagggactcaggattcgctttagtaaaatgaagggttattctttattgttctcagaaaggtggtttgagaatcacctgtgtggtgggctaagtattgtttcctaaaaatttgatgtctacccggaacctcagcattgtgacctgatttgtaaatagtgtctttgcacatgcaattagttaagatgaggtcacactggattatggtgctccctgattcctatgatggtgtcctcatcagaagagggtacacagagatgaagcccatgtgaagacaaacagagagtgaagtgatgcttctgtaagccaaggaatatcaaggattgcaggaaacccccagaaactaggaagggacaaaaatgattctcccctggagcctttatgacctgctcacaacttgattttagacttctcaccagaactgaaagataacatattttcgttgaaagctactaagtttgtgataatttgctacagcatccctaggaaagtaataccacctgcatccggaatatcaggaatcttattaaaatgccacttcatagtatccatcccagatcttctgaatcagaaatactgagactagagccctgagatttaaactattaacattatttatgtttcttatgaagttttaaatgtgagaaccactggcctaaatgatgccttaacagctctgaacaatctgaaagttaaaatgacaggactattttatgcatatagacgacatctcccccggtgaagtgtgttacttcccatcctataggtatcacaaacagaagtatttattttattaaatacaaaaagaaccagatcgcttccaaactacatgcttctaaacactttcataggttttgtgttctggcagcattttaaagataaaactattaagggttttattttttctggagaggtatttgtctctgagcagtttgatgaatatttaaatttcttttaatctgtgttctcccatcattttctgtatatgtttctttcttatctcattttatctggccttattttttttctctgcttttattcattttctgtgtactcagaaattaaaggcatatccattgtatgtttttatttaatagttttttactctttatcctgtacggcctgtggaaaatatttcactatgaggattagtcattgcatctctgaaccatccctgatgcatctcttggctaatggaggctgtatagtgtagtagttaaggacaaaatggaacgaggctacccaggtttagttccagcaattaggttatgcaacattgggcaattgactgaacttctttctgtgtcagttttctcaagggtaaaatgtggttgttaatgggacccatgtgttagtccgctctgctcagttatgctgcagtaacagatgcctccctggaatcctagtgacttaaatgagcagagctttatttcccaccggcattaatattcatcctagttctgctgcagtgcttcttcatgcctcttcatttctggaccctgcctgaagaggcagctctgatttgtcgcatcctggatttgtggccaagggaagagagctagcagagccatgtggtggccctcagaccttctaagtggttcacactatttctgctcacattttcttggctgtgaagcacataaggcaaaatgcctgacataagaggcagaaaatgtaaccctccagaaagggtggacctattcggaagaggctggtaggaaaagacagcaaatattgtcaaaaataatgtaatcaaccacagcaactttatgggattgacgtgagtattaagtaagttaacataggtaaagcacttagaatagtgtcttatgactattgtctggtggtctattattaacggggtcttgtgcaagtatgtgaagacattaattctttatttgagaatccaatgtaccttccaaggaaagtgctatttagagttgagaaagatacagaaatacaggtcttggtctatgccttatggaatctgtatactcctccatgaagaatgtgaagaggaacagacagttgatgacttccagatggcctgagtgcccaccagcagggtatctagtggacacctctgtacctgttcttccacatgattggtgtttatttgttcaactcccccagcagactctaagctcctttagaacagtgagtgtatctttttcatcttcgcaccccagaaactttcacaacacctgtctagtaggtcatcaacttttaaattaaacccctccttctttatacagtctgaaagtggggtggtaatttcactctcttaggtaagaacagttttcttctgcttgatgccccatgttaatgaggaactcagggtgcatggaggaggcagtcagcagtttgaagtttacatccatactgtgcccaaactgttgcacagaagtatgaagacagcgcatggaaattagtcctgtttgccaacatagtcggttttgcatgcgtcatacatggccaggcttgctgtattaagagccagctgcatttaagtcttacttaaggggaaacaaatacatttgaattgaaatacacttgatttatttttgttgatgttctagttttaattattttctctatgtgcatgtcttgcaagttttatttttgtggggactataaggatatgatatttccagggagacgaagagctataatttctcaacttttcaaacctacatacatattattttaggaaggacaaatctcatcatcttagttaacaagaaccagaatagagtgatagttctgctaatctggcctcctgggtcttgcagttgcatacaccagatgctaagaggataagacagattagccaggagtaagaccattctgtgtggcagctacctctgtccacagtgggtgatcagctaatgccatcaagctcataagctgataggccttgtaattaccatgccaaagaggctgcaaatatccctcttttcccaattttaccttatatttagtactttctattgtaggaaggagatgctgcaaacaccatggaggttgatctgaaaataccgtattcccagaactctttgtcttgggatacttctaaaatccaatgactgtatcttcatatctatacataaagtcccccatccagatgggatattcatccagaatatggcagatagaacctgaagggtctttgggtatcaagagcatatcacttagcttcttacttgaatagacttacgctatttaagaatgatcgtaacctcattcttggcagtagagtgaattagacaaattaacaaattagagttcccaaaagtcctccatggttcagagtgaagagctatgtgattgtgcttagagacctgtgctacttcctcacaaccccaggagtctggtcagtttttggtaatttacaaccatggtccctcagcctgccctgagtgctgacagcagactactgccttctgtactctgtgggcttcatggactctaggtgggtatttaggttaatgggaagtgatctatctgtggagtcaggacaggcagctatctaggttaatgggaagcaatctatctgtggaatcagaaagactggattctttatttaatttcacaattcaatagcttgtgagcttgtgcaggtcacttaacctcttaatctcatcctaggtaattgacgttacctacctcatgcggttgctgtaacatttgagttactgcatgggacatgattgagtgctatgtaggttttatcttagtttgagttcccttgagagcaaagcctgagacaaagacttgggtgagatagtttttctggagtggtccccaaaagcagaagtgaaggagcagggagagtaagcagtgcagaaagaaacaccagtatgagtgtccactgtcaagattcctgctctaagcactgcataggtgggagagatgaaggtgttgccatgaatgcctcccaggattttctgcttaaaacataggaggttggagtatttattcattggctcccttcccctccccattctttgatatttacccctagggtattcttgccctcactcccatttcttggttgctctttcttgcaggcagggcaggcaccctagctttagagaaggcccaagggctggccatgcttgaagtgggggaccatcaaactgtctgagctcacaataactgtcacctgctgcagtggctgaaatctgacattggctgagggaatatgatgccaggcggcacgtgatgcagggtctgctggaagcgcatacaaatatgatatttttcatactcactttcatttacaatatacacatttaacttttttttttttttttttttttttgctttattaataggttctgtatgctaggcctgtaccctggtcttacaaatactttaaagaaagcccaggttatactcttcattatcctcctagaattagattttctgtttcataattagcaatagtctcccatatcctccatgccctttacccagcctcaccctagtcctctttcagtcctgagacaggacaactcagggatgtaaacatggagaaactgtgagaacaaaccagagaggaaggatttttcagacaggctgactagggtttgagtcccacagctgtatgaccttgacaggtcacagagctttgctctgtctcttgattcctaaagctggggtatagtagatcagctgcatgctacaaaactaaatgagaccacgtatgcaaagcaactggtacttctttatatatggtactttcattcccctatcacttccccaaaaagctgcattttttctggccaggaagaatatatattaaaaggaaaagtagtgacttcatttatatctatctgctgcctgatatctttcagctccaaatttgtcaaattcactctactgccaagttccttctgctcctcttccttctccccctctaccctccataaatttactctcctttaatttattcatccatttctatgtattcacttattaattcaattatatgtatttactactatatggaatgctttcctgaatcggttcaatctgtcctattgctaaaatacagtctgcagctctcttcagctccccctccatttcttctctccccctcaacccatccactcatttgtttatttaatttattcagttttatttatttgctcactagtttttttccaatacattgaacaccctcttggtgcaatgtgccatgcttagttgttggggattacaaaggtagaatattctacctcaaagggcatagaagtgaatttttttttttaaaaaaaaactacaatacaaggaatagagtggtcatttgcaaaataaaatttttattgaattgctgaagcagtaaactctcagctgggagggtcagggaaggctgaggagggatggctgcagatagaaaggttataaaagtaatagagggagacaaatgtaagctgtattttgcattccttgattcctatttaaagcaaaatattaattaatattaatgtactagacctttaaattcataattggatatatatttttttctgcatgctagggcaaaaaggtcaattcacaagaatacagacttaaattagaaatgtattaggggatggtaggcagcaggtcttatggcatatcctcgttagaatctctttagctcaatcacattcagcttcaaaatctgtgactttagtgataaacagtaagatcacacgatcagactcaaaagcactataatacctaaaaatcattgtaagaaatctaatttgtattaatcataccattagaaaagtggagaaagtttcagtatctgttataaagtttttttaaaaacaagagtagaatcaatatccacaaaaggatcttcctgcctatccctgagaaaattgcccttatctcttgaaaagtggtttcatggagagagattatcgcaagaaagcttgagcctgtccccagcttaccactgctgagcactgctgtaaatttatggcttgaggtagaggtttggcaatacattggggacaatattctttttcatcttctgaggagccatttgtttctttggaggtatatctgctccagattcattccatttcaaaattgagatgctccattctctcagccaagatgaatgggttcattttacactgtgatcacaatttagagatgctattgaatgggctgccagtgtttgctttgtaatgttaggggcactcttttttctagtcttaaggcataggttacagcacataacagaaaccatgcaggaaagacaaaaagaagaaagagagggagggaaggaaggaaggaagaaaaaagaaggaaagaaggaaggaaggaaaaaaggaaggaaggaagggaacgagggaggtgggtgggcaaatagcaacacccaacaatcctgtatcatcaatagatagttgtggcctgaggtataaattaacactattctaagaaaaatcaggcaagcagtgaactttgattcatacgtctcagcagcaggaagctgccgggagctggttatcaagtgtgactcataggagagacacaataccagaagtagccttctctggctagtaggatcaatcatgtcttacttttttctggaatctttcccttttcagtgaggctgttttcatctacccagtttgtcagagcaaaccctaggaatcaacactgatttctctctttacttctcctactaccaattcacctcccaaaccaatctccaagtcctgttgactccacctctaaaatacatcccaaattttacaactttcatttctactgtctcctagttttagcctaaatcattttcatctcttttctttaatagcttcctaatagatcttgtttccattatttcacttttggtctaatatacctacagcaaccagagtgattctcaaaatttaattgagattatataatctccttacttaaaaccttccaagagcttccagtatgtgttgaagagctttcaggtttgtaccatgtcattaggacttcatgtgatctggactctgcctacatcaccagctttgcatgattggctccttcctaaatgcaccttctcagagaagccttctctgatcatctcatttagtatctttctacccaaccaactgctcaggacaagagtagagaagtcacctcaaagaggccttcctggaacattctacaaagtagccagtcctcagtcctcactccctacccccaactgcttttcatcgtattaccctgccttattttagatagggttgacagaactcaaccctatctaaaattatctcatgttccttaatttgtgtattgtctatcagattttctcaccccaaagtagactgtaaaccatgtaaggcaggacccgttctgtcttgtttatctttttatcctccacaatgaggatcagaatgagcatcagaatgtgaccacagtgcctggttgccttctgatgctcaattagcatttgtgaaagatgtgaatagatagtcttgcaaaaccttggcagaagtgagtaacagtattctattaataccctgggaggctgaagtagaggatgaggcacggagaaagaggtgagtagtccatcgttgaacttgttatatgtggcagtctcaatggtatgtttgcttattaaatcctgataaatattggtggcatttttagtaggttttaactagaagcaggggctcctggagggtgctcaggctgaatagctgggtcacttgtctttctcacacctccctgggagacttctctgtagaagacttcaagaaaaatccctgcaccttccacacctgttgtaggaggtatggcagctattcctgagccttaagtactccagtaagaatgaaatgaactatttgaggtgttctgccaaacgggctctaaaaataattatgatttaaaatgttttttttttccagtgaatatgaacgctttaaaactaagtttgtaaaaacaaaacaaaacaaacaaaacacctcctcaatctctgttgggttagacacccaaagaaagcaaccagaagctgaaattttgtggacagaacataaaacgcctttttcctacttctctgtcctcctcttcttccttcagtcctgttctttttccttatcatccctgcttttacttgcctgatctgttttgtctggggaggatgcctaatacaatgtgtgatgctatgggcttagtgaaatgcttgtcacagctcagctagcctagccaaaggggctggtggaagcaaaggtaagttttcttttttgacatatctttggtttccttcaaatctaacacagtccatcattttgagcatttattaaccatatcatttagatgtataattataggcatctttcactacgcctttctaaagagggtaattttcatatattttatgcattgtagaaattttggttcatgtgaaacatagtttgaagggaaatcaagttactgtttcatttacctctttgaataaatagaaagatgttcaggtaaaaccaagtgattatgatacagatctcaccccctccctccccaacctccacccaagcaaaagtttccaatggttccccatacacttttggaaacagagctttgtggcatatggaaggaatttctaccccctgcgtatgagcaaacccatctggtttagttggtttggccaggtcttagaaatacattgacaaacacgtgtatgtcaggggtaacttgtagtcttgctgcttatattgctcctggggggaataagaaattcatgtaatatgaacagtctagtttttaagaaaactgaaataaattaaaaataattaaaatccaaagttcaccttatgaaggtgtgtgcctttaataatgctcaaatatagatttttaacatacactctgattttctgtctgccaaaagagggaaaaatctgataatagctgagtgtcatcttcctccaagcaatcagcaatgcattatttcctaatattgctgtttgatttcattattggttctggcttcttaaagaaataagggttccatagggttactgtaggataggtcaagaaaaacaatctagtcagtgtatttcatccatgatatcttattccgtattccccattcaacagagaattaggccatcttctgtgaagcaaagccttacctcaaagagatggtgctaaatgagttttcaatgaggatagcttgtgtgagcatttgggtggtattattacccaagggattcattaaaggctctctgttctacaatagtaaacaattaaacactctatttttacaaagttctgcatcccagaaatcttttgcatctttattccaggcatgagtgtcattacctgggaaattcaactgaggagtgttaggtaatttattaacattctctacttagatccagcagtgatagtttaagcagcctcaagagaatcaaaggatttttttttgtgatcaatatttattacttaaactataaaagagggaaaaatacatgtaatacatacaactaatatgtacccagttgcagatcataactttcctagttattaaaaatgcaggaaagttaatggttttgagacgtttcttaagttctcactagtttcattttaaatttcagtgttttcttctttttgtctgaaccatcctttacttacgtgaatcactctttacattcattgcttcactgatgctacttcactgggtttttgcttgaataggccagaaaaagtcatccctagactacatcatcaagaacagttttgtatatttcaaccttcagcttgtgtctgcatcttgcattacttatcaattcacttttatgcctgggctacttattaggtttgtttctcctctctctttgccttgatttcccgctgagtgtaaacatcacttttcctctgtagaatgagttgaccttttgacttgattaaggataaatgccattgactctccacttctggaggccaagggttttacaaaatcccactgggacttatttatttattgtttgaaaatgaatatcaaatactattccatatcattttaatgagatggatgtgaatctttttttttctactttaagaataataagaattgttactgttggaggtatcaaatgtaactaaatagtagggcatgagaagcttcagttttttgggggttttttgagatggagtctcgctctgtcatccaggctggagggcagtggcgcaatctcagctcactgcaacctctgcctccctggttcactccattctcctgcctcagtctcccgagtagctgggactacaggcgcctgccaccatgcccggctagtttttttgtatttttagtagagacggggtttcactgtgttagccaggatagtctcgatctcctgacctcgtgatctgcccgcctcggcctcccaaagttctgggattacaggcgtgagccactgcacctggcctggtttttttttttttttttttttttacatttttattcattggccatcacattccaaagttttacagtcaaatggacagttaaatatttgtgtttgaatctgaccactgtgaatatctcaaggataccataagagctgatggacctccaaacgttagcatcactggactgagagaaagctcgttttatatctctataggtactgtcataccaatgaagcaatgttcccaaactactatgtttgtgttagtcattttccgcttatcttgtccccaatcataaaaattaagcgatgtacaaaaattgcctaaagaacagatgccaccttatagaagatgttttaaatagcccgtacttgtagcagttctgccttcatagctaatattctccacgtctttcttcacttttttctttcttattgaagcatttgcatgtagaataaagaggataaaaacataaaaaaacaaagacagatttgttttttctgagaacatctgttcttgttataaagaatccacatgatgtggtccattttctttcaatgccctcactgttggctgttgtgatggcaactgttacatcaatcttagacctgaacttaataagataatgaagagtagtatctaatcagttgaaaatacagggaaattctgttgtaatacatacattttatgtaatattgagacaaacatacaaagcaagataagctgagatgtaatctaaaatggtttattgtagaattactttattcctaagattcattgctctcatggcatcactacctaattttgagtgcatttggtcctttaggtttccttactaaatgttcaagattcttgtaaatttgggttgcccttgagctttgggtgcattctgaaaattattaaatataagtcatttgctgtgtacattgtaattaaaagaaaatttttcactttgaaactctgtttatttttcaagaggagagttcctccaaacttgaactactaccatagctcttataaccagcagaaaataggaatactaattactcaaaattaaaaggtgtagtttgaaattacctagagatttatattcccctgtataaaatgtcttcagtcttggagaggagggaggagtgtagctagtgacagttacataataaagctttcaaaattacttagataaaatatattgactctaattgatggttaccatagaaacagacttatatagacattgattattcaagcactcattaaagctcctactatgtacttggccctgtgctcagtatatgttggagccaagtatatggttttccaaactatttcacatatatccatagggatatattagccacttatatgttatatcattttatttcctagtcattttcaggaatggggctttccacatatagattgactaatccaaaaatatttaatcagcgtctttcttcatgagctcagctatcctcctacaaagagcaaacttggtctgtcttctgcttctatgtaatcttctttgtcttttaaatttgcatttcagatcaataacgatatacatcctaaaagaatgtgatattttcttcctttattaactggatcattttaatgcctctttgtctctcttgccatctttttcccctaagtacaattcctgttacccctgattctttatagggttcacttgaaccttagcttgagcatctggagcatggatctcttgagacaacttggtttattcctctatttagtggcactttatattagtcatgcttttgtcctgaaaagtttcagttttggaactttacatcatttcagtttttaggtatttggatccttttggaggatgatgaacaatgggaaaattctgggggccctcacattcccttcaggagcattatttatgatggggtttaaaacttgacagtattactattgtaatgcttactattgtgatttctatggtcgtgaatcctagtaggaccctgtgttaatggaaatgtcaagttaaggcatatgtgttgcaaagttcttttctcgtcctattggtggatactctctaaaagccagactggtgtatcatgccaaatggccaaattattctatagaaaaaatactatggtaaatttcctatatcttaaaggaattcgtctggattctaaaactttgagagattaatgactgctaactacagcttcctgtaaatgattgcttactgccattggcatttgaaaaccttatatctaagataaaagaaggcactatttttttcattactgtaccattatcctttatgtttgaattgagacttttgcatttggggactcctacagagaatccactggatcagtaaaattcgaatggactttgggtggaatataattccttgaatgctgctgggtcatgtgcaccagtgtggttttgacaaccctgatgcatgagcactactttcagaattgattctaactttggcacttactaccatccttaggcaaaggaccagagaccttgtatgcagggcagaagctcaatgacaacgagtggcacaccgttcgggtggtgcggagaggaaaaagccttaagttaaccgtggatgatgatgtggctgagggtgagtatgactatggtgaaattcgtctgtcttttctctcagtcctctcagtcactgagtgagcaaacagtgttttgcaaaaccttttattttgcatagtagaagtcacaaatcatgttttctgttgacaaactcaggcaaggctaagaaggtcttcctctgtattttacaataccttttcatcaatgtgcgttatggaaattacctactaactataactacatatttatgggtctctctccttaggcgtagagtatgtgtctggagaacagatgtagggttctacagatccttttattattcaatcattcaaaaatcacatgtcaatcatcctcccatatgccagttccttccatcagtgagtgaatcactctctagtagaagagatgggcaaaccagaaattcagaacattacaggtaaaagtaagtactaaaacagtgcatgatacttagaaggtgctgaataaggtttggtttaattaattacttatttaatcattattaattatctattctgcactacacaccattttacaaggcactgataatacagtggtgaacaaacaagcaaatctttggcctggtgggatttacatttagaatgtggaaagaaacattcagagctccacacaatcaataagtatttcctaagagtctgttctatgtcagcagtatgctagaattgcagaagataaaatggaaacagatgagattacctgtttcctcaaataatgaaccaattaagcagatcagataggactctggtatttgaaaacaggaccaaaatatataatgagattctaattttgatgggtgagattacaatttgtcaatcagaagagagaattacccatttgggctggagaaatcaggagtggtttataaacgtagatcttcagactgaatttgatggtggatgtaatttatgaaggctgaggtacaagaaagagggtatcatcaagtgccattttacatgctatatcttttttttctttctttcttttttttttttttaagacagtcttgctctgtcgcccaggctggagtgcagtggcgcgatcttggctcactgcaagctctgcctcccgggttcacgccattctcctgcctcagcctcccgagtagctgggactacaggtgcctgccaccacgcctggctaattttttgtatttttagtagagatggcgtttcaccgtgttagccaggatggtctccatctcctgacctcctgatccacccgcctcggcctcccaaagtgctgggattacaggcgtgagccatcgcgccaggccttacatgctatatcttataagtcttccctctctgatattctagagcaggacacatctatgaagcagaattcttatccatatgggaaagaagatttggggcagcatggggtattacatgaaacactgttgccatcagatctgggccctgacgttaacttgcaggacgttaggaaagttaacattcctgggccttgtcaaatgcagtcagtggcctaagccatctccatggtttcttctgtgaataagacagtcagtagccctgggggtctaatataatcattgccactaaaatattttatgcctttgagatagatatactaaacctctttttcctaatttcctcatttttaaaattgatattctattatttctatggcctttccagcatgaatattctgtaatttggggtcttataatttaattttatattcatgagcctgagtttctatacttctggaatcaggaaatatagtaagatatgtacgtgcatgtacaggtgtgtgtgtgtagagaaggatagcctgtggattaaggaagagcgtctaggcacatatccagtgcccagtaggcattagaaactgttagctgtgttaagcatatcagctcctttaatcttctatcattcactatagcctttaaaggtaagtgttcttaatgccatttaaaggaagcataaaactttgagagcgttgtataattaagctccaaatccatgtcagtgtgattccacaaaatcattctgcttgctgtacttcaaaatccatcataagaaaataatttatcttacaatatgggaaaaatataatggaatgggttggagtgaggtagggaatgcattagcttattaaagtctcctaagaaacttacaggaggtaggccacaacacttgacctctccctcacaaaaacaaagacaaacagaaccaccacaacaattacccaaaacacttcgattacacatagacataactcagaagcgggaggtgaagttcctggtctacgtgcctggagcataaatttgcattctgaaatgaacattttaaaagagatgtacaaatggttacactatttagcgcccgcagccaacctgaattaattattcaagaactgtatgaactgttggtgcatctggatcctgcaaaggataagtcacacatctgttgctcactcctctgggcttgtctctgaagggtgatgggattcacagccgcttctgaaaagcagccactagatggcgacctcaccctgatctctcctgacagtgagttcgtttcattttccctggaaaataaatgctccaaaagtatagtcataaagaactacagagctgagggtactataatgtgtctctctcagtcattattcttttatgaaaactttggaataaagctatttgtaaattgcactttcttttaccactaataattaaaaagcagggccaagtcacgaaatgccattatccagtaatttgattttttgaaattaatgaaacgctttcattttcagacgtgtccccccaaccccccgaacttcactgctgatggaagaaagcagccagaaggataaagaaatttgagaggggaaaagtgctgttttgcttatgagttacaatcttgggttgctttttatagtgataaggggttgggaaattttaattttagttcacagaagtcataaaatcaggcaatgaaactaaaatacccacagtcctcaagttattaagtagtatctcattggcttatttagtaatccctttaatgttctttaaggcccccctagtgtgtccaatttcagctagtttatagaaatgatgtaaagaataggtctggctcacaagaaatcaaaagcaaggatagaaatattcctcaaccttgtgtttatcatttattgtaatgtgattgtgttcttggaaaagcattaagttcgggtgacagttaataataattgattgatctatgtttctattattaagaatacattactataccaagcataacttgagttatactcctcagaattggggcctaatgctgcatgaactgcctcctctgcctagaacttcttgctagtacaaaaacttgcccttgctagtagaaaaatttgactacactggttcttgttgacttttcctgtccttacctacatagcatgtatagcaccaagctgtaaaaagtcattttgcaaaattttccatttaaaatgtatttctcatagtaatttttaaaaacttgacaaaataggattgaggagtgtgcggtcaaacaaaatgaaatggagttctttattgccaggcttattaggagactttaataagctaatgtacattgcaaatcattgataagtatgcagtatttgctaattttttttttttttttttggttccagaaactttttttactgaagtattttataccacatacttacacacttttaaaaaatgctgacattatggagaaaaggatttgggaccagtagagctagggaattatgggcaaaatatgaagattcttgactggtactctgtaagccttcgttttcttaacttctctccccacgtctaagggccatgaaaggtcaatttgcttcctctcagcgtttcccattattattcttttttgctgagctcttagttttgaccaggaacctcatgtgtggaaatggtgaggacccaaaccttgaccccaaagcaaatgtctcaaatacaagcccctccccccagaagttaggaatgctggctgtgctcagacccctctggtagccactgggggacatatagaagacacaagaggtggcctctacttaaaaagagcccacattctcacacaaaaaaagagaaaaacagtaagtgaaatgaccacaacatgattcaatcatttcggaggaagggagagaaatgaatgcagcataattagtaatagcgcacggtttaagccataggcactctattaaaaactttacgtgtgttgatacgtttaaccctgctaacttcatatccgttttacagatggggatctgaggcatagaaaaattcagtaactcccccaaggtaacccagtgaagaagtcttggaagcagaatgcaaagtcaggcagtacagccctggactctccatgctcatccactatatgctattgcttcataggaataggaagctacagcttgaacctggccagaattttccataactatatgtccttcgtcactctaagagctggtttgtagactgcttgttggccatcagtgcaatatggaagtgaatgtgtgacaaggaggcaaggcaacaatgctgctttagggagggtgctggatatattacccatgaattagatggagtgacattctgatactgggccatagggaagaagtacaaactccttagaacagcttctacatggaaatttcaccagttaaattctacctactgcttttcttgggcaatgatgtgaggaataagtaaaaccttttttccaaagacagttcattgtactagtaaagatatgggctttggaattagcacacctgagttcaatgtaggggtctaccatttaccacctgcatgaatcttgatcaaactgcttaacctctgcaagctaaatgtcctaacctctaaagcaagagaaagatacttctctacaattttattgtgataatgacatttcatagtgattatgcagtatttagcacagtgcttgccttatatggaattttcagtagtcttggttttggcttgttatctttctccccagttacttctctttcccctgaagtttgaaagaagcggctgtgaggtatgaatatatttgccccttaagtagaaaggaggttcagtttgcagacagcattcagaggagatgagtgaaaggtttccatcactactattgattaaatgacacatagattaaaaaaaaaatatttggttggtttggcacaggtttcaaactttcagcatctctcatgctttgcacaggtgcaataatatacttattttttgaagtcttcatcaacaaaggagtaaattcgtttagcacacagtgaagccaattctttttctttcctttttctttctttctttttttttgagacggactcttgctttgtcacccaggctggagtgcggtggcatgatgtcgactcactgcagcctctgcctcctgggttcaagcagttcttctgcctcagcctcccaagtagctgggactacaggcgtgtgccaccacgccaggctaatttttgtatttttagtaaagacgggttttcaccatgttagccaggatggtctcgatctcctgacctcgtgatccacccacctcgacctcccaagccaattccttttctaatttgatctcacatggccttctccccctcccctcaccaacttttagttgaggctcctgtgtgagtcatcctgaactcccagtttgtgttcctgggctaagctcctaaatccactattaacttcacttcttgtacttatccacatccacgctcagtctctctgctatctcaataaacacttttttttttgctatgaaaaattaattttctagtgagcagaatatcccaacccctcaatcctggagatcaattcatccagaatttctctgaaagttctcaacttgactttaaaattgtttcttcagattccttttggaacctcaatcttcaccagagattccccattctgacttcttagttctcatcttagattttttctttgtaaaataagaattagcatgactagcagcatcatcatagttcagtttctctgtttctgtggatattgactatgactccccctccccatcattttccagcccagctccccttcctggtaggagtagctatagccaatttgacagtagatgtttctttcagtcactttattaatttagagcatgcaaatttagattatgttgctttgtattttcacagcctgtctgatttttaacactaagcaattttatttcctagttatttgttagcagatttatgttgcattttgatttttatatttaagttaaccaacatctttttttcttatactaagagagtgatttgtcactagttgtcaaaacactgcatagaagctcataacatgtaaatctaatttttgtgcttatagggaatataagaaattttatttttatttttttagagacagcatctcgctgtgttacctaggctggagtgcagcctcaaactcctgggctccagtgatcctcctaccttagcctcctgaatagttagcactataggtacatacctctatgcctggctaatattttttttttaatttgtagagactgggtcttgctatattgcccaggctggtcttgaactcctagcctcaagtaatctttctgtctcggcctcccaaagtgctgggattacaggcatgagccactgtctccagccaattctttaaattaggtctgagttttttcccaaagagataaaaccaatattgagcacttaagggtatgatctggtttagtctcccagatactgaagtttaagagacctaagaaaatacaatcctccctttttttgtcactgtaattctgagccaatagagaaaatattgcaatgaggatggaaggcaaatatcattttaattagtaataacacacaataatattgcttacacccactgaacttcagaattagacagaactgcccacttgaatagtagttcagaactgggcagacatcctttgtggaagcaaggcttgctcctgtaacacccattctatggatgcatgcagtagaatggacatttctgaaggcagcttgctccagcaaagagaaacaggaggtgttaggggctgagctaagcatacacagcttctctttgcagatcatccttaatatttctgattatgtcacttcttcaggaaagttgttaaagaggaaataaagagatgctatcagtcttgctaatggagttttttcaatgtagaaggtaacaagagaggacaggaagaaagaattccccctctaatgcttggcagtagaacatggtttgttatgttttaacatgatttttctatataaatgttgaggaagccaatttctactctggccacattaatgatgtttttctttattttgttattaaaatttccagtctctttgtatttttttttcaagccctccttatcccctctgccctagtcactcaccacttctaggtaaaataggtaatacaagttctaaatagttcatttgtaacagctgaagatatttccgttgtgaatgtcagaaacccaactcaaacgctttaagcatgaaagggagtctattgccacacagtttgaaaaagccgggaggtgcctggcttgatccagagtctcaaaggacagcacagatgattctcttcatttggtaattgtcttctgggttgctagtcctctgatccctctgattttcttatagcctctagggactcaaagctttcttcttacccctccagcagtccttgcttgcaaagaatcctctttcctaagtgtaccagcaagagctctggaactgagtgtggccgggatggcttgggttgttgccagttctaagggtggtccctaaatcagccacaagagcatcactgtgaaacttgttagaaatgcagattctcaggcctcaccccagacttttgaattctaaactctgagggcctaagccccccaggtgattctgatacaccctaaagtgtaatgaccgctttttaagtctgtagtccaaagtctgtgacagttaggggggtaaagtacattgagtggtctaggctgagtagcttgattagggtcaactttatccagtccaggtggttgaaaggtcaagaggggtgggtagcttcctaaagaaaaattacgtgttattataagataaagtaacagttgctgggcaggtaaactcaactgataagtctataatagaatccttcccacgagtactaagtggagagttattacgagaaaaaatacttggtagtgatgcccaagacttgtgtgttgtgtctttacaagggtcagagcaacaaaggcctttcttcttatagtgtgtattagtgtccagtgattctcctgaatggagaatatcaatagttttatcctttagcctgggttactcatgacctcatatttccccttatatgatgagccgtgctgagcagctgcgtgacagcatgtaatttgggcaatgcctgattgaggccaagtaaggtatctaccatattgaatatttggttttcttgaactcacccaagaaagctgaatattctgtgtggaaacaggttacacccaaaaaatatacttgagggtgctgtgataaatgatggtaacttttctgtttgtacctcatttacaattttcacaggtacaatggtgggagaccatacccgtttggagttccacaacattgaaacgggaatcatgactgagaaacgctacatctccgttgtcccctccagctttattggccatctgcagagcctcatgtttaatggccttctctacattgacttgtgcaaaaatggtgacattgattattgtgagctgaaggctcgttttggactgaggaacatcatcgctgaccctgtcacctttaagaccaagagcagctacctgagccttgccactcttcaggcttacacctccatgcacctcttcttccagttcaagaccacctcaccagatggcttcattctcttcaatagtggtgatggcaatgacttcattgcagtcgagcttgtcaaggggtaagtagaagggatcacgacttatgttggacacctttaatctactgaagctctacgtaaaatatggacataaaaataacttgtctattctactccctaccctccattcctgacacattctcgcatcttccttgattaaatggatccataaaattattaggtctggaaaggagagaggctcatgatttaatttaaaggtcttccactaactcaacactaacagactttttcctatgaaatgtagccctttaaaactattgaagaaaagcttatttttgcaaaagagggctatgatttgtattgcatctaattcttgagtattactaactacaaccacccaatttataccaaaagatgaaacataaatattttaaatcctaccattagcccatatatgcaagtttttagaagctgccctttcctcaagacattttactaccatgtattagaaaatagtcaaaacaaaaaaccaaaacaaaaaccaaaacagattaatggttgatgatgaatttaaaagtcacccccttatgttttgtagtgtacaacctgtgctactttgactctggagagtattagtaggtagtgttaatgaagtggactcgatgagtatggaattatagtgaagcatgatagaataaaatctgactattcttgtaacctcatatcaagatttaaattattcctgcattatgccagtttagcatgggggatttgaagcccactatgtcagttacacacatatagccattaaaccacttcggggattttccaattattgtttttttttttttttcttcctaggtatatacactacgtttttgacctcggaaacggtcccaatgtgatcaaaggcaacagtgaccgccccctgaatgacaaccagtggcacaatgtcgtcatcactcgggacaatagtaacactcatagcctgaaagtggacaccaaagtggtcactcaggttatcaatggtgccaaaaatctggatttgaaaggtaaaccttgtaaagaaatttagtttttaatagagcttttcttacaatagatagactatttccagaggcaaaccacaggttcagagtgccatgcatttttgatacatcatccatatcctgttttaacaatgttgaattatcctgtaatgcaattttttccgtttttacttagactactcatcaagaaatggttcattttctctgataacctcgggaatgtcatgctgtgggggctgagagatgacaggatgagtgtcaaagtgtgggaagggccgtaatacagaggaaggaatataggctttggaatttcagctgaatcatttaatgtctggtgtcatcagtaaactgtcttagccttgttcagcttacatttacttttctttgcaaaatgaggataataattgttagtttctgtataggtcgtgagaagttttgatggcatgtctgtatatccctcagcatattattggtaacaagcacataaaaagcactcaataaatgcttgctttgttgacaatattgttaatctttactccatctatgatgaataaatttttgagatggtatatataaaatgaatgacacataataaatattggtttcctttttttgcagggtagaaactcaggtgcttatctcatttatgctgtcccccccccccccccccagctatcttattccttatctgatgaattatctcaagtgtatcaaactagttgacatggtcaccacatcctttactcattctcttttgctaattactttcctttccaggtgatctctatatggctggtctggcccaaggcatgtacagcaacctcccaaagctcgtggcctctcgagatggctttcagggctgtctagcatcagtggacttgaatggacgcctgccagacctcatcaatgatgctcttcatcggagcggacagatcgagcgtggctgtgaaggtacaacctatttttttcttgttaagctacagccttgttgcaagcaccaagcctctttgctgcctctgccactgcctccttcctcagttgaccagtcctgtctcattctcatttgccacgtgacattgcatcaccatcagtgttctcttgtcactggtttagtatgtcaagacatgtgccacaggctccaggaatgtatgttggcagatgttttctgagtatcacatacttgccaataaaaataaaataaaataaaaaacttccctggcattgacatcaggcttctttcaatgtgtaccttggcttccagaatggctgaaacagcactggagacttttatttatactttaatacatgatgaggggaaaaccagagattttatgtagatgtcactaattaataaaatgtttcttattttggctgatagtgactgcattatttaatgcaaatctagcaggcaataggaaaacgatgtccaaatgccatgatgatggaagggaactaacatttactaagtacttactaattatcaggcattgctaggcagttctttagtgtggtatattggaacattatgggctttgatattagaaatacctggattcagctccaggtagtagctcttgttagctatgtgacatttggaaggtgatgtaacttctgtaagctatatctttcttacctataaaacagggcaataaaacttaccttgaatgtaaggagatcagaaatacacataaaatgcctggtatgtagtaggtactcgataaatggtaggcttattgtttacaaatattattttatgtcaaacatctaataatactgcatgtctacccatgcagcacaacaaaccatgctcagcctgttcctgtagatgatccactgtctcttgagatactaaatgaattttacaggtcttcctgaatccaacaattctttgcagtgtaaacaatctagttttaaccagcagatggcagaagtgaacacattcagccttccctagtagtcttgggttggctgaaaacgtgactgttacctaacttgaaaggcaaagaagttgcctgaccaaggatctatgtaattatttcctttttttctttttgagccttttggttgagccttatggtcctgtgtttgcgcaatatattgtgtttccttgtatcagttgttaatttaccacatcaaatctgttcattccacttctgtgttcaacttcatgtatcgcttctgttcttaaacagcttccatctgggttagctcatcatcgtaaagcacacatttataaaagcttcctgtcagcttatcaggctgacttggagttatggaaattgtttccctttgcctaagagttatttttgtattttgcactagtaataggaatgttcattcctataacccactccatttttcctttatccagaaatatttcttaaattgtcttggccaaatatggtgtttgtactatgtagtgtgtgtgtgtgtgtgtgtgtgtgtgtgtgtgtgtgtgtgtataaagggacaggaggttgggaatcactaagcccttaaagcagccactttgctcctagaaatgaacaatttcattcaatcagggatttttgtctccttggcttgcttttagttcttttgtgtattaaagggcaatcctggaatagacgtagcatttggaattaaattgtatatagtgtttagaagattgtagaatggcagtaattccatttatcctggaataattaatcatatgaagtcaaatcacaatataagagcacatattagaaagcgtaagatactggtcaaatgttacagaatttttattatgccatcagttcttcagatttaaaagttaacaggaatcatccattaactctatgtcagtgttttccaatagatatatgtaacacatgcaattataaatttcctagtagctacattttaaaaaggtataaagtaacaggtcaaatttattttaattttgtattttattcaatttaactaaatatacccaaaatattatttcagaatgtaatagagataaaattatcaatattttgcactttttttcacattaagcctctaaacttgagtttgtattttatacttgcagcacacctcaacccaggggctacatgcatttaaagtgctcaatacacatgtcaatggctactgtattggtagtacaggtatacagaatacaaaaattaaggtgtaaataaataaagctatagtattggattaaaaggaggtctaagctttataaaagggtactaaaatgtataatataaagggagaatgacctcacttaagagagttttaagagaagcagtaagagcatcagcaaaaagaaattacataacgagttggggaaaatgtccctatccctatctacagctctatgtgcagtttggcattactcatcacatgcattacagagagctccgaccttcctctgagtatggttgattgttcaaagccggatattgtggcttgatggctccaccatctgaatctatggtgagtcccatgagcctaatagcactgcactctattgccatggagataattacaacggttacccactgagcattatgcctaccccgctgggtgggatgaagtggagggtgagtgctgagggaagaaagtccttgttgattgtacacaaatgacttggataattagcctaagtggccaggaaaaatggcccaaaatgggttaaggcataaattactgtcattggaagtttgtaccactgtgaataagcccttgcaagagatcccaggagcattttagggttctgtgtaagatggtggggaggtaaagggagagcaaaaaacactggagacactgcaaaaaggcatcatttttattctgaatctcttgtgtagagcatgagacccccaagaaggcctttgagcattaggtagtatgaggaccacaggaaacagaacaaatttcttaatttatcatttcttttacatagaacagtaaacaagtaggggatgaggttttataactaagaactaagaccagaatctcttcaagatatgttttattctagcaaatctagaatacacagataaacatatatatatatatatacacacacacacacagatagataagtatctgtatctatctacatttaatatatgtttccatcaaagtcattgacaatgacactttaagatccctaggtagtaaatgtgttaccttccctattatatcagacccatgacagcaggtaaaataaaaggcaaaagagtccaaaattatttttatttattttattgattgagtgagtgagtgagtgagacggagtttcgctcttgttgcccaggctggagtgcagtggcgtgatctcggctcactgcaacctccacctcccagcttcaagcgaatctgctgcctcagcctcccaagtagctgggattacaggtgcccaccaccatacctggctaatttttgtgtttttagtagagatggggttttaccatgttggccaggctggtctcgacctcttgatctcaggtgatccacccacctcggcctcccaaagtggtagcaaaattatttaaaaacttgctaatttagtactcttcagctctcaagtatgagtagcaaaaaagaaaaaaatcttgaaactagtatttgattttatgtctctgatagatgcaaagtgtataatttagatattaagtgcaatttctgggcaactcctagtcaacatttagttgtaacttgatacctctcaatttaagctagggttttaaaaaaaatcatacctgatttaatatgtggctggtaaatgtatcttcctatattgaggccagctttgctgcagaggccaaggcatgatcagctagaaatgtggtttcacaattgcagatgataaacatctgaaagaaatacacgtgctttgttttgaaactggcacgaataaataaaaatgacattagtctggtgcccttttgcctgcaactatttgggtttggatatatttttaaaattaaacaaattgagctttttggtgttcccaaatcaccgtgatccaaatgtctaattccagtgccaaattcctgggtggcatttgcaagagggcacaaggggtgcactcgagtgactctttcatgctgaactcctaatgtttagaagtatttctatgggctccatctgattgcacacacgtgtctttcagtctgaccgtgcactccctgaggttggctgtgtggatgtgagaaagctcttgttgcccttgttgcccgttgcctgtgctttgtcaagtctgatgcgcccctgccctgctctgctgacttggctctgaggaggccggctctgtccctggtctgcgcgtccccctctgccctactccccaaccccatctttgctgtctctggtgaacctgtagagcatttcaattgtctgtctgagtgatggttatgcagattgcgttttcatttctgtaatgttatcctggtttattctacctcttactaacctctggttattgttttcgctttttctgttcttttgctaacaaagttgcgttgaccaaagctgacctgcaaggtagagaaggttcttgttcccattaccactttggactgaaagatgccctgtgtaacccttggtatcttttctttagagatcttcaagctgtcacacctcttggacagcagcaattgtggggaggtggctgaaccctgtgttcttctgaaagggtgacagataacccagatcaatgcatgaaaaatagctatcaagaggagacctcatgggggaagaaacatgattccattttggggggtaccaaagaggtttgacagcatcccataccgtgactatacataaacatattaatttactctggaaatgataaatacctctccaagtagttgccatggaggggttggctcctcttaatttattcaccatacatagaaaaaagaacttggaaggaaaaaaaaggccaaggccagcccttatgccttaagttattattttctggatcagggaggtcatttcctggagcaggacatttaagtacttgggctttatgaaagagaatgtcattttctcttaactagttttaaagttttaaatatttctgggcatttgggagacactaatgtcattaaaatgtttcagagatttatattttctattggggattttggttgagcactttaatttcctgttttgtgatcgcaggaaaaaagtactcttgaggaagaagatgatctgtcattttaatcctgaataccctataaaataccacatgtgagatgttagtgaatatctattgcagaaactacttcatccactattcaaagaggcatcttacaaagtcagtaatggcccactgatcctatggtgccatgctgctatgtctcagaataacaagggaggaacaagcattttaggtgtcttttggctgattgtcaagcaggagactgagcctcatgacctctgctgagtttgcagtcagtccaaattgttagaagtagttaaggcaaaggtaacgttcaaaaaattacttttcatctaaaaagatcattgactttgctgtgactttcttgttatatgccatgtagctaaccagtacaagcgcctatctatccagaatacatccaccaatgaagactctgtcactattttaccataactttgtttttctttatcgcctcttagcagattcacatatattttaatatatatttaaattaaataaaagaatatacactagttaggacttaaagtcagaggaagctttacaatagctttcagtttcaaagtatagagggcccttgtggcaatactgttgttttagacattatgtttaattgtcaagaaagatccactatgtatttctctgtaaatggaagagagagagaagggggcaggactcaatctgaatgcaagacaatccaaggagattgaagctccttaggactggatttagcggattaaactagacaactacatctcttccctgactttactatcacgcagggtaagaactatatggattttgaattcccagagcttagcatattctctcacctagaaaatctggacatggcaaaataatctgaaagttctcatccaaaggaataatggtttgtagggagaagtgagtcattgatttctatgcctaaagtaaattgtttaccaaagcgtagatacagatttagggacatagtggtttggaatatattgatgtttccttttatggaagctgtctaggcatcaatatggttttaacattattactttattggcacgaactttcctccattcttgtaatgacttgacagtctctttgtttgtggcaggagctgctttttttttcgattatttggggccgtcttactctttccctgttttataggaaaagcttttagttttttgtttcctaacattggggtgtggactattactcacaagctggctttttcagctacaacctgtgagtatagatagtactaattaccatgaagtatgaagggtagtgaagatatatgacaaggaaatgaggcagttggaagcctagacaaaaatgtattcagaaggaaatataacaatgaggtgtaagaagtgacgtaatgagtctagatgagtcaacagcttaagtcctcttgttattgtgtggttggggtagtgttttattttttatttaaaaatttttaacttctccagtgaatgtgttgttgaatttaacaggaagttagtgtcagctatgcctgtgtatcagggactaggtactggggatgctaggatactgcagatgagatgcagtctctaacttcaaagaattccacagatgatcagccaataattacaatgcaaagtgaaaactcctatcctagagacatgcgtcctgccatgtgagcatgaaggaacacactggatcgtgtagggtcatggtggtcatggggagtgctcaggggatatcttctcagacagagtttgagctgagtctgaaggacaagtatgttttagatggatgaacgatggaagcacattcgagagcttggcttaattgggaatctacaagaagctcaatgtggctgaaataatgtgtgtggggggatatgatagcacatgaaatgggagtggtaggatagagacaggtaatgacagacttttcctgtaaggagttggactttatcccaaggatgctgtgaggaggacagagatttgggttggattttcattttatcaggatcactctgacactagaatggagaaaggatgatgcagacagaaactagaaacagagagcagattcaggagtgaagcagcatattccaagacagagggaagagacatgcccccagtgcctgttacttgacttggtcaaggaggtaaacaagtttccctttcacatgaaacctcaaagagcaagaaagaaagtgaactctttctcctgtttgctgcacacaccctctccactgctacactgttattctggttagtagcacatgtattttcacattatgacaaaagatatcaagaaagaagtttaccgactttcctggtttcaggccagaatctacatctctctaggtcaacacaggagacaggagctctccacggtactcctgtgatccacgggagggaggttgccttgctgagcagtgcagtctttgtatcagtgtaccttggacagaatgacagcttctacagaacattcagaagtaactttctaattcctttttgtttttaagaagggtattagtggaaaggaagagatttcctaaaagcctattcatggaagaaaggagctgcagaactataaaagaaatattaagattgacctgtttggtgtgaggcagatgacataaattatgagaaataaaagaataactcttttttgtattaggtgattaattagaatcttcctattccatctttaattataacttctcttagcaggttttatttctgatgtttaatgactttttttctagaaatgtaaggtgtccctctgcccagatggtgaacacgtggtcaggggatccaggatccattggatctgggtgctaagtgctggctattttgagaaagtcaatcaatgtattgggttcagatgccttggaaatctcaagattctttaaaggcattttagaacagagttagaattagtcaaacacctttagttaggtaaaggaaattttaattccccaactgtctttactatgatgaatattgtcctccacctcattttctccgaaactgaagattgtatcacattctccattgtattttttgttataaaatatagtacttgacctactataagttcctcaaaatgctttctattgtggaaaataataagagagacataaattgcagtgaacttcccattattgttcttgtgtccttttcctccacattatacgagagaggcgtacaacacaactgtgtcagtgtggcacactaccaaaatgcatcttgtttctggactcctcatcaactgtacacccaacttaagtgggaggaggaaacctgattattgtcctttctagcagaattgctgatgatctttattgagagtctccttgatgaaggcatacactaaggacttggcaggttgtatctccattgtgactacaaccttagctgatagatactgttgtctgtttcataggtgactttataggtcttgcatatgttctttcatttaatcttcacaccatatgatgcagtagaaatacatatctcccttatacagatggggacactgaggtttagagtttaatatcaccagcccaaggtcacattactagtaagtgattaaactggattttaaagcccatgacctttcgcctattatgccgtatggtgtgagtctgggtttgcttatttccaaagcagaaagagtacatagatgaccagagagtatctgagagtgtcctccatgctgactttatggtagatggttttcatatcaacaccatttcgaaaagttctagataatatttgcacaatgttagagcaaagtattttaaattacctctttttttgttgttgttgagactgggctttgaaactccttctctctctcttttaaagtatattccactgccccagcagacccctacatcagtgcctagaaaacaaggaaaagcagacagactcctcagtttacattttctaaagaatcattgacttatgagggattgtgtatcactttgaaaagagttatttgacctttgtgacccaggcatcccatgaaaatagggtgggttgaggaagaaggcttcatgctaccagccatcctctcactcttacaaataccctacctgcagcaagtatcaactcccacctctctactgtcatggaaggtgctgtgggtaaatcactttactcttaagctgtaattattctttttagatcattgaccatcaagagcagtgctgtgctagagctggcactggcacaggaatttctaggaattttgtaagccagtttacatgaggcaacatgttatggcttgaaattggctatgaggggagtactaataaaaccaacacatgttacaaatcagttttattttccttttcctggggtgctggttgttaaacatttactagtgatatatcaccaataaaaggccactggggataaagataccatgaagccatctcagtcaaccaattcccatccatggccataaccaattttatacccaacgtattatgagagggttgaagtggttgaagagaaaagggtgttagtgaaactgctccaaatgttagattttattctttgtctttttcactgatcactctaatcatgtgacctttttaaaacctctgtttgagaagaggaagccataagcatctgaacatgcttgagaagagtggttttgatgccttgcttagctttggtaaggcataggtcctgacttcaagacaaaaagcatgatcttgggaatacagccacccttaggtctctctgacaatgagattttataataagatttaggaccctattctctggcattgccttatgttctataaaatgtgacctagagtattcgcgtctcagtggattcacttgacatttttaagtgatcattgctttcttattttaaagctaaatataagtgaatttggcttcctccagttaaaatgaatagatcttatgttgtctgtaaatgactctcttcagaaaagccaaggggactcaacactgtaaatttagaaatactctgaaagctatggaagtagctttgctgaagggtccaagacatatattcagctaagtaaataggctatccttattatcaggaataccctctgtattagttagggttctccagagaggtatcatatatatcatatataggatatatgcatcttatatataatatataaaatatatattatttagatatatacatcttatatataatatattatataaaatatatattatttatatacatatgtataaaaataggaattggctcacatgattatggaggccaagaaactccacagtccgctgtctgtatgctggagaataaaacagttggattctaaagccctgggaatgggggtggcaggggcagaagtggcatgatagtgtaagttctgctctgattcgaaaagcccaagaaccaggagcacaagtgtccaatgtctgagggctagagaatatggctatctcacctcaagcaaagaaagcgaattcctccttcctctgcctttttcttctattcagaataggaccacaacagattggatgatgcctactcacactggggaccatctgctttattctcttcaccagttaaaatgctaatctcatttgtaaataccctcaaagacatacctggaaataatatttcattattattatatataatgaccaggtatctgggcatcccttacctcagtcattttgacacataaaattaaccatcacattctcctgaagactctcaactctttaatttttatattttagcagtcgagactatagattgctcaggtaggcagtaagagtctttcataatccatttgcattttcaaaaatttccctgtagggtttctatagacttatttatatgagacttatataaatacacacacatatacataaatctatgtatattcatcttttttctgtacttttttccttccacccaactactgttcactcatttttttcctataaaacaatgtaaattttaaaatgtgaaagtagaaagattaggcacttaccaggggtagaaaattaaactaaagttggaagatctctttagacagttcatggcatgtattattctgttctcatgctgctaataaaaatatacccaagactgagtaatttataaagaaaaagagacttaatgtactcatagttccatgtggctgggcaggcctcacaatcatggcagaaggcaaacgaggagcaaagtcacgtcttacatggaggcaggcaagagagaacttgtgtaggggaactcccctttataaacccatcagatctcatgagacttattcactatcgtgagaacagcatgggaaagacctacccccatgattcaattacctcccaccgggcccctcccacaacatgtgggaattaagggagctacaattcaagatgagatttgggtggggacacagccaacaatatcagcaactcttataatgctccttcccatggaagctgtggtttgttgggacaggcaaaccctttggttaacacggaattctactatgataacttcacatttaggttacaccgatagagtctaagccctttgacttaagcccttcactccttgtgattaaagttagtgaatgttgatagatcagcctcacctggtccccactcctgggtcaccagccttggccctctaaaggaatggacattgagaagacaaacttgatatggcctccaggcctgtcacttctccttttctcccttaccctctgcctgctgcaccctacatttctccacccacttcttgtctggctagaaccaggtggtgctgctttagcactatttatgaatttcaaattggggtgtttgagacataggtttggttaagtcttatttgggcaataacagagggaaagtgcattctgatactagtgttgtgagctttaggaagaaagtctatttcaaggacctacaaacaataaaaaatactctatcaactttggttttctaggccatgaagaggaattgactaaatcagtgtacacgtgctgtaagggtggattagagcagtaacaggcataaaatggttgtatcagacaattcttaatgagaagaacaatcccaccatcaagaaaaatgataggaaattttggcagccatcagaattatctgataaataaaatgataagggaatgagatgcaatttcatgttttccagcaaaccaaaagcagggctggaaattagaaaccaaagtactaacaccattgacatcttattcagtctttccagacacatttctgttgtcttgtcactttctgtagtatacaaagaaagtcaccatcttttctcaaagggatatgtgactattttcgtgagagttattcacatatcaagagcaaaaataacttataccattcctatacaggaacttcctaaggcctttggatgttttaagatattaataattaataatgacaatgataaaaaaagacttcataaatatgtaattaaacaaatttgtgctgtcttagaatgtctggaattttatgttggtttggaagagtgttttatgaaaaattatgattattaagtccccagaattgtctgtcatgcttataaacgtaacatttgatacagatttctgttcataaaattggacaaaatgagatcttcctgtttaactgaattgaaatggtatttgaaagttttccttgtaaaaaacaaaaacaaatccttacatcaagacgtcatcttttcccagttgtaggtcagaaataccttaagttactcttattaatccaatgacaccacacatgcacattccccactctggcttacacacatccgtgagaggttaggtgagtgggctgcacaattagcaagcttgggtttgagacctcaccctctcacttgccacctatggattttggggaaaattatgcaacttttctgtgtctcagtttacttttctgaagtctttgccttttgattcaatcaacattttaaaaattacttaaatttgaaattatggagatctcctatgagaaaataatttgtttctctgattctttactacttttaattatatttgcttcatcatgtgcttatgaagattaattgaattaatatcttaaaagcatttagtatagtgtctggctcataataagcactaggtaagctgtgtctattgttatatcctctttctgatttgtacaagattattttatatcaatagatgtttagtgggaagcactgttgaagcttttggtttttctcccccaagacatgtttttctaatttctttgacacactgctatgtgaaatgcatacattaaatacattgacataaaataggctctgtttaggaaaggatgtacttaaacaggttgaagtaagaataggagctcacaaaatgatcatctagaaattgttctagagtctagcccagactctcattcattcaatagttattacatactgtacttgggcttgggaataccaaagagttcttgtcagcatctggtgagtctgaaatcaaaggacacacggccaattaaataccaccaccccacccaccctaagaaaaaaatgtaaataaaaacagtttcaagtaagagattacttatgtgagctcttattggtaaattctagggataaatttttacaagaaccattttgctttaaattctaaatgaatggctttatttctttattttttctttgttatttagttctttcttttattcaataatattttgaatattttgaatagaaccctcacgctataccaaatacaatatcagaaattagagatgtaaaggtgaccaagacagacaaggcttctgcccttgagaggcttacggtccagtaggatttgaaagacagtgaggaacttaatagttctgacaaaaaacggatgcactgaccagtggaacaggatagagacccccaaaataaacttatgcattatggttaactgattttttttttaacaaaggtgccacaagtatgcaatggagaaaggatggtctcttcaataaatgatattggacaaaatggatatttacacgcagaaaaataaaattgtaccctttttataccatatacaaacatcatctcaaaacatattaaagattcaaatgttagacctgaaactataaaactactagaagaaaacgtacaggaagtgctccattgcattgtttctgggcaaggatttcttggatgtgacttcaaaaccacaggcaacataaacaaatgagattgcatgaagccaaaaaggttctgcacatcaagaaaacaattaatagagtgaagaagtaacccatagattgggagaaaatatttgtgaagtgtatatctgataaggcactattatccaaaatatataagaaacacaaacaactcaaaataagaaaacaaataccccaatcaaaaaatgagcaaagaatctaactagacacttcttaaaagaagatatgcagatggccaacatatatatgaaaaaaatgctcaacatcactcatctttgggaaaatgcaaactgaaaccatgatgagatatcaccttgcacctattaaaatagctactatcaaaaagacaaaaacaacaacaacaacaagtattggcaaaggcttggagaaaagggaacacttgtgcatttttggtgggaatgtaaattaatataaccattatggaaaacagaatggaggttcctcagaaaactaaaaatagaattaccatatgattcagcaatcctgcttctgggtttcagtccaaaataattgaaggcagtacgccaaagagatatctgcattcccatgttcattgcagcattaatcacaatagctaaaaattagaagaaacctgggtgttcatcctcagatgaatggataaagaaaatgtggtatatgtacacgatgcaatacatttgctcattttttgattggggtatttgttttcttactattgagttgtttgagtttcttacatattttagataatagtcccttaacagattgttttattcagccttaaaaaaaagtgggaaggctgggtgtggtggctcatgcctgtaatcccagcactttgggaggccgaggcaggtagatcacgaggtcaagagactgagaccatcctggccaacatggtgaaaccctatctctactaaaaatacaaaaattagccaggcatggtggtgtgtgcctgtagtaccagctacttgggaggctgaggcaggagaattgcttgaacccaggatgcagaggttgcagtgagccgagatcatgccactgcactccagcctggtgacagagcaagattccatttaaaaaaaaaaaaaaaaaagaaaaaaaaagaaaaaaaggctggaaattctcttatttgcaacaacatggatgaacccggaggatattatgccaagtgaaataagccaggcacagaaagacagataccacatgatctcacttatatgtggaatctaagaaatttgaactcatagaaatagagaatagaatagtggctataggaggcggggggaggggatggatggaaaaataagagatgttgatcaatgggtacaaagtttcaattagacaagaggaataggctttggtaatctattgcatagaatggtgactacagcaaataatagcgtattttaaatttcaaatcattagaagaatagatgttaaatgtttttaccacaaaaaagtgctaagtatgtgaggtgattgatttgttaattagcctgatttaccattccgtgttgtaagcatatattaaaacataacattgtatcccataaatataaacaactattatctttcaatttaaaagaaattaatttaattacagtccacgtaattgttattagttaagtaaataggaagacatgatgaagagtaaaagttctgctaatgggggcttccttaagtaggatagtttggagaaagctcattttgagctgaaactcaaagaataaaaatgaaacagtcatttgaatctggagaaagcacagttaaggccaagggtccagcaggaagcgcaaaggaactcgaagataggggtgggcatgaagtattaaggcagtggtccaggaatatgagcaggcatctgaaccacctggagggcttgttacaactcagattcctcaattctgcccccagtcagtaggtctgggtacagccttaaagtgtttttctcataagcttccaggagatgcagatgctgctggtttaggagcaacactctgggaatcattgtgttaggaactaaaaacaggagagggctgtagcactgtgagctagggacatatggtaagaaatgagactggagaaggaggcaggggctcctaggagctcaatcttgaaaggaggttcaaggttagttccagattgttgagaagttgaaagttctattaagtccttagtgacaatactgttgttcttggatgcttacaatgtagtcagtcttccggtactatctgattctacatggcctttgccccttaatgcaagtgaagcaaattcagtggaattgataaataacctataatccccgccctgtatttggtccctgatgaacttctgacaaatggaaaagattgcatactttgcagagtgcagacatgctcctacactcaggttttggaagcatgatatagcaaatcaagggtggttacaattcagatcaccctaacatttactggaacactttctgcatcttcacaatagacttagtgccacaaggacctaaccagagaatattacctgatttctaatagcaagcagctttcaaacttttgatgataaaatagtaaaaacataaagcaattagaggattatatgaggagaagacagtgcaatgcgtaataaagtgctaaactgaatattatatgcaaaaattaatgacgcagataataattgctatggccacaacaaagcgggagaattattgtttgaagttattgactaatgtttcatttgaagaaggcattcaggctggtccttagaaaaatggttaaaatttggcagttagagggaaggcgaaagatatggaaaaggcttcgtctttagattcaatcaacattcaaagaattattgtgttttcccagagtttttgctgttttactgccttttacagtaaaactttccataaaccttccatgtgtttctgattattgagtacaattgaattactagccaattgtatggtgagagctgtttggccagggagcccctgtggacttctcagaagcttttatcctttgaaagaagctgtcctgatttaccattgttaatgaaacttgtataacacaatgcttgagtttaagacccactgagaacatgaccacatacctcctttcatctctacatgggggaaccacatggccaataggagctgcagaaagccagcagcagtactgtaaccccagtgttagtaattgttttgaactttcttatgtcatatcctcatagcattgtcttatgagtgatggcctgtcctgcttccacccttcatgaataaatacaaaatgccttgccacccagaagacgaaccctttgtagtcgtgcatctcttttgaacatgcgtctttaggaccctgtgttctttcatttcagtattcttgcttttgtgaggcttacgttagaaactgtgaaatatgctgttattgcaatggtaatatgttttaccctgtcaagtgcttttatgcattagttcctgactaatacatttggtgagtcaaagggctcatctcgtttgctgagattctctgggaaattcatggagttatactgaatattaagatatttcctgtgagctcagataatcctaaatgtatagatttatctttaatcccaaagttaaggcagaaaatgtcagtaaaagagagagaatggttgaagagaagtgccaggcggaccgaaagagtttaatggcaatctgtaagagagagatcatcaaaaaaattttaatgcccccacatgtcagtaaaagatttggagaatgccttcaaaataggtaaatttacttgtaagttatatacatgtactattattcttatatattaacatatgaaagacacacagaaatagaaataatttagaattaattaaaagaaacacaatttctaatattttctttctatagcacaaatgattctcttttgcatgctccagcgcatgcacactccatttaagagaatccatttttagcttggtgcagtggttcacacctgtaatcccagcactttgggaggctgaggtgggcagatcacgaggtcaggagatcgagacgatcttggccaacatggtgaaaccctgtctctactaaaaatacaaaaaaattagctgagtgtagtggcgtgtgcctgtaatcccaactactcgggaggctgaggcaggagaattgcttgaagctgggaggtggagattgcagtgagccaagatcgtgccactgcactccagtctagcaacagagcgagactgtctcaaaaaaaaaaaaaaaaaaaaaaaagaattcatttttagaatacctagagcagcagtgtgctgtagtgcaacggctttcaaacttcagactgcatttgaatgtcctggaagcttgtaaaaacagatgtgtgcctccctgcaaaagtttctaattcaatgggtctggggtgagctccaagcgtttgcattcctgacacattcccaggttgtggtcgtctgagaactacacattgagaaccactggtatagtccacagcatgcgttttagagttactttacctaagttggacatcagcatccttcaattaccaaatgtgtgaccttgagtaaattactgtgtcttcccgagctcagtttcttaaaatctgtaaagtggaggtaatcataattacttacctcttagagtacctggagagctcagcaagataatgtaaatacattgtttagtacccagtactcgccccctaaaaaacatcaatacatgttggctgctaaatcctccttcttctccttctcttccttctcttcatcattatcaatatcattaaacatctttttttatgtcacgaagtagatatagggactgttggtttcaggattaaaaaaacactgtgccttaatttataagaatcatgggaatgattttttttttctgagttagcattctacattaaaaaaagctataatccaaatgagatatctttctagttgaaaggtagagatgaagctattttgcaaagtcaacccgaaggagaacagtgtgttcagccctctcccttctgtgtataactgttgatagtttgtggctaagtgtgtatttccgtcatcttttgtatatactgagttcttgttgcatgagattgagttgacaattttggtggtgtgtcttcaaatgtttgggggcatgagaatggtaaattcaggtgatttccttgaatctaatttttaacatttcttctctctctcctttttctttttttcccctcttcttgtgcattactaggacccagtaccacctgccaggaagattcatgtgccaaccagggggtctgcatgcaacaatgggagggcttcacctgtgattgttctatgacctcttattctggaaaccagtgcaatgatcgtaagtacaacaacctttcatactggaactttgtgaagatgtttggagatttggagaatcttaaaggacaatatgtaaaaggatggctcttctgaaagattcataagtaattctctcctccagaaacttgggaaataaatgactagtgctcttatgagaagagtgaagagatgtgtcttgcttaacaacactaaatattctcccacttgctcactccctgtgttttttctttagattagaatagcgactgagaaacaataaccacagcagcaaaccatttcaggcaatatttttgttgtaagggcttcagttcttcatgaattaaatcaccttatcttattgaatttaactccaaattggttaataattttgagactctccccttttgcattgcctagaattttgaggctatttaaagggtatagctgttttctcaaaaagtttgagttctctgaatttcttaggccttacaaatgacaaagacattcaagagtttattttttacaattagcaaagcttaaagcgttcttgggtatctttcagatatagggtagaaattctctctgactaaatttattggtatctggtttatatacacatagctattctgtatgtatgtgtgtatatatatgtgtgtgtgtgtgtatatatatgtatgtatgtattttctattttgtgagtatattttatatgtatatattatgtatttggtttttattggaagagagtcttgtgattgttaattgtgtccactagtgatgcttctggctcgtgggtttagttctgacttcatgaaggtgcttctagcactgatggtggagacacctcaatgctgtgggcatctataacctgtgtctccacttctttctcatgttattttcttgatgtgaccatagtaaagatgagcacacacttgaaatttctgaataaccgtggcaaagagatttgttgaaaatccctgactctgtgggtcctgctaaccttctgactttctaaatgcagcctttgttttataatccagactcatttgacctcttggttttagaaaaatgatgcatgatgttatctgagaaaatagtaaagtcacattatggtgtgaccacatgggagcagacaccaattacaatgctatgccccccagatctatgtggtttttttgattctttatttctcagctttttatctgtgtgcagctgtctgttgttgttctttttcccgttttttctcagtagttttggtcccatatgctctttcattctcttaaggtacactgaggagaaacaagtggagaagttggcaatatagagagaaaattatgtaatacgcattcatctaattacataagcatatgtctctgtatctgtcatgtgaaggatacgatgtctggagaaagttttggtataagactgctcttaccaagtcttttggtattattgaaagtcatgttgccatatttatgatgtggaaatactgtttcactctgaaacaggtagttataaacccagccagccagagaacctgaggaattatactatatgctctttctttttcctccaatttgtcagtatagcactcactaggaaggcttttttctctaaatggtggcataatgcttctttatcctcacaagtttatttcttgtcgcatatacgtccctttctgggtagaaaatggtcaggaagagactctccacacagaacaggtataaaggtaagttatcgtaacgtggtgagcacgcacaattttcagaaggtaggtatgtctttttctgtctttgacaagttcctgtctgtcacccaatgccaggcattattttctggtaaaaatcaggaaggattctttctagcattctgtgactgtttctggttttatcaagagcagattgtgtctcattctgggatgtggagtatcacactgtctgacttggggaatttgttgggatataatgaagcactagaacttacattgggaaaatgtcagctttcctttgtggcaacagcttatcacagttcaaaaacatttctagtaaatctaggtttagggcaatacattttgaattttattctgtaacaatgcagctaaatcttttcattatagcagacttgggaaactgcctctctaacaggagctacttgcctagtcccccacctggagattggaccacggcttctgtgattggatagatacatagatacatgcaaatgatgaagttcacatctatttttttttttttttttttttttttgagacggagtctcattctgctattgcccgggctggagtgcagtggcacaatctcggctcactgcaacctccacctcccaggttcaagcgattctcctgcctcagcctcctgagtagctgggattacaggtgcctgccactacgctcagctaattttttgtatttttagtagagacagggtttcatcatgttggccaggctggtcttgaactcctgacctcgtgatccgccctcctcagcctcccaaagtgctgggattacagggaagtacacatcttagttgtggagtgtgataagtatatagaattgagacatataggatgtgactgtgaagtttgaatataaacttttaatgaaatccaaccaaatatagcagaatggtagattgtttaaaattattacattggacgtttctgtttccaataattggtattcaagttatctggaagaccttctgttttggaactagcagcaaagccagtttgttctacctagaaaaagcagtctcactatatcatagaccattattttctatagcagccttgacccttagagttataattggctatttcatctcacaaacatcttcaaaatgaagttacctgcatgatattctatatgcttacctttgttgataaatttttggtggcgtagcctgtatcaggactcaagtgttaaccttcatcatcaccggcagacttgaataggctcatgcttatcatcagcaaaaagtggtgggggaaattgcaaagaaagataagctcatggaggaggaagaataatgatgaaaaggaatatagagaaaatcagaaagtgggtcttatatggaagagcacagaggtcatcagcaattgctttggtaacatgcctgccacaagtggcctgcctttgacctaaataacagaaatgggtcacagcattaaaagtcgagtgccatcaaggaaacctggcttttacctaattaattcctgcaaagagagtgttctatagaatgttgcatatagctcaaacaaattgtatccatttaaatgctatcataggaccatgcaaataggttagagatgaaatttaattgtaaaaagcattttgtgggggaaaaatggttatggatatctcattttccagaagctgtttctcagggcaacagattgatcctcaattaatgaacatgaaaacacttcagtttattactacatatccaaaaactgaaacttactcaacagggaaatagctaggtcttatattttccaaaataaggtactaaatccatcatgtgtaaaaaagttaatcatatgtaggcatgacttgtaaggctctaaaaatgtctgcattttagggtattcctttttcctagcattggttcttttatgacctttgtgtttttcttgcctgtttaccaaatatgattgcctgacaatgttaatgtgctgttacatagatgttgcctctatgagtacagcgtacattttaaaacttagtctcatttagtgtgagttggccaagcctggatgttttcactttatttctttattctttgtgtgaccctggtgggttgatggaggcagtgggatgaatttcagtttcactcttataaacatagctgtgcaaagctgatattctttagagctgattgtcttgtataagagtgactcccttgtatggggttaggaaacaaaaatcctctgattggaaatccaagtgtaattgatttgctaattgtcttacatagttttagatatgaccttccacaatgttatgtaatggtaaagtcatggggagtttcttttgggttgacttttagggctgttttgattctgcaatctaatcatcccagaagaaatgttgagttaatgtagaagtcagtatgatctgtggaagaaaacataagtaacattctccaagataatcttcagttctcgtgaaacatttaaaattgagggagctggctattcagagggtgagcaccacctgaaaatcaacttaatgaaagctgtcttgggctacattttaagaacaacaaaagaaatggaaccttacaaaggttcttgataggcatattcttttttgatattgggttcttattagtattttaaatcaggactgagaacctgggaaattctagcatgttgtagccatggcagcaccaggcaaatccagaatctccttcctgtattttgtggtaatattgtcactgtcagcctgctgttgagtttttctttccttcaaacatcgaaaaatgttgtgtagaatagaaccctcctgcatgcacccacacatgtgcaaaagggttgtcatttttatggactttgtgaaaatagcagttttaaacatttcatacctatccttaacaacattgttggcttttaccatgtacatgacaactgttttgagtggcatacaatttgggggtttggttattgcttctggtgccctggagaagcacatataggacagtctttggcacatgagtccttaacacacatcaagttcctgactttatgaggtgggtgctcatcatggctttgtggggtgaagtaaagggaatgaacgtgggtcctcagcccacccttaggagctggccaccctgtgctacattgctggtcacacactgcaggatgcctgttggagaaattcctaggttcacactggcatgtggtaatagatgttctttgcttgcaacaaatcaatagcaagcagctgtggatagtgcagatagtggagtgtaaagcgtctttttcagacagttttctgcaggagtggctattaagctgcagtgttggctattgattggccttttgctttttatttattgtgtgggtttatttatttttttaatgtaggttggtgtattgattaaatctgttaaaaacacatttcccattcaagcttcagaaaatacaagcaatgtatgcattactcagtgtgcaaagaaggggacagatatgtgtatactgattctgtctcttgggtccatataggtacatagacattatgttaaaaacctatgttgttatgaacctatgttgttccagacctattggtatagcagtaatttttaaggatatcatagtatagtacatccatgtttttggttatgtgttcattccccgccattgttttcagactctacctgcccagcgaataggccatatgtaagaagttcacttgtaaaacaattgtttgttgcttagaatgcactttatcatgtattgattcattcactcaccaaacatttcttatttgcagatataatcatgaataagagagttttgttctcaaagaccttctagtctaatggggaaagacacatatgaaggtgcttcagtagaaacatgaacagtgtatagcgaggagtcataaggtggagtaatggcagctgtccccagggttgagactctatgaagagcagctgcttttaggatggttttcattgaagatgagccttgaaatttttttttttttttttttttttttttttttttgagacagaatctctctctgttgcccaggctggattgcagtggtgcgatctcagttcactgcaacctccgcctcttgggttcaagtgattctcttgcctcagtctcctgagtagctgggattacaggtgtgtgccacacaccacgtccagctaatttttgtatttttttagtagagacggggtttcaccttgttggccaggctggtctcgaattcctgaccttgtgatccgcctgcctcggcctcccaaagtgctgggattacaggtgtgagccactgcgcctggctgccttgaaaatttacaagtaggttcaaagcaaacatggtatggaagagggctggaaaggaaaggtagcgtgccagcaggcaagcagggaaaatatatgctgcagtcactgttaacattctgcatgtttccttccggtcttcattttaagcattagcatggttcagatcacattctgtttgacatttttgccctgctttgtttggtttaacactataggctatgcatttttcaagatataaaaaaaaattagatttcccaacttctttcaatagaatgcatgttatggtgcccaactcttggggagaaactcccctatgttgaaatcattgctgagtcctaaatgtaggcctcatagggctcaaatctggatttatttcattgagtcgttggtggagatcgatcttgaaaatttatttataaagaatccaatttttaaaagtttgatttgtaatgtgtataacttattaaatgataaaagaaatcaaagcatagtcattaatttaattggctctagaatcaaactgctttaaatgccagtcctgagtctttctatctgtgaagttgaattgttcacttagcttcctgaaactttggtgtaacataaggagtgtaataggtacttggtaaataggattagtggtagtttttattgtagctaattataatatttgacaactgttaagtccttatcatggtcctgacactctactaggacctttataaggatatcattcttttaatcatccccaaattcttaagaaaatattatagtacgatactcctgattttaattatgacaaaactgagatcacactgttagaatatagctgattgagggtttggtcccaggtttgtctgacataaaagttcacattcttattcgatttgctgccacttagtcattattagaaataacagtttaacatctgtactgatattagactaggatgcttaattccatgtgggcaagtcttcacagacaatcaaactgcataaaaacatagaactgggaaagggaaattgtgttcttgatgattatttgcatcatattgtggaattcagaacatttcaggtcttccttcttaacactcagatgaggccatttagaattaaaatgtctttagccattatagaattagagtatcttgcccatactccaaactatttatattttcattctctgttgacctagatcttctgatttttatgtgtttgctttatttcaattccaacatatgtcatacagcacggtggacgagaccactaatgtgtaatggggtggcctgtgttcaaatcatgactctgtcccttaatatctatgttaccttggacatgataattacagtgcttctaaagtgcagatattttgtaggtcctatcttgtaagaataaattttacaaacataaattgaataataataaattgaatgtgtagtggtgaagtttaggagatatggcacatgatggccctgccggctactcttcgatattactttcaaaaagttaaaaacatgactcatacaaatataattattataaagttaaaaacaaaacactcatgcaaatatagaatgaatgtgtgtcaaatttatttaactccataatgagagaaacaagatggtaacagtgtaaacaagatgacaaaagactatttgaagaactggatatttataggccttaagaatattaaaatacaaattttagatttaaaagtggtaaatgtcctacaaagcaaaaatctcttaacctttggtgttatcttttctatggaacatctgtgctgaacaaaaatctacaggttcagagggcatcttctgtactctgggcccccgctaacaataaatgtcagtgccagtcacaggttcttctcccatagagctaaatgtttctcgggtgggcctgttaaacagtgtccttttataacattagaaagacacatgatttttttcccctaacttttgccctatgttttggataatttttattaatttatattcagtttcatttttcttttttaccttgaatacctctttcatacacaattacgttttttaaccgcttaacagtgtgccccaatgtgctgaattcattgtcatttaaaccccacggcaaccctaaaagtagatactattgtgataccagtttcatagatgagagaactgagacagaaaagtcaagtgatttgctcaaggtgacaaaactattaggttgaggaacaaagattcagagttatgttagtctgactgcaaagtctgggctctggactgccaatatcttcttaatgcctcagggaaagtttcctgatgagaattcatctgaattcataggggtttagattcacattagccacagagcttaacgacttttgttagcatcaattatactgtaatttctagtgtctgtgttattcttttgggggggatgctattttattttattcactttaaatgagggcatttaaagtaggactgatttgctcggggaacaagatcagaatttccatcaaataagtgccattttgcaggtttggtacatctaagcagggaggaggctgagtcctgagaagtcagtgaggctgagaggggcagcatagctccatgataaccaggtcccagaaggcgagacagatgcaaaagaaacgtcaggagtggcagcaccaaaggttatttctctgcatctgtttttattctcgggcccacagatattccatggagccaaagggaagtcagaagataacaatgaaacccagggtcttctaagagcagaatgaagctagcggtactcttaggaacagttctatagatgtgggttgtagcttgttgcccatgggaatcacacttgcttttaagttccatcaatattaagaagggatgatttggagtattctcaagctttatcagggctaatattaatatgtgtgcaatactaaaccgattcagcaagagccaggactgcgtgcagctttgtttttcacaaccctccctgaaaataagctgggactcataggtgacacattggtttctacaaaccccagtagacacttggtcctatggttcaagaaaaaatagtctccataattcaaaggcatatagcttatcatggattatcataagctgttggagtttgtggcctcaataatttcatttccaccatcttccacatgctatatttgtagaccattttcattgctgtgtttaattatagcccattcatttctggtgtccttggctagttacttacttaaggtgacggcaataatccacttagagcctattgcttcacggaagacaatttttgtattaccatgttagtcacatacaggtgcaattccaacatatttttcaacatggacataatttcctatagttatttccacatctaaaggcacaagaaagatctaaattactttactttgtcttgtaaaatagaaataataaatataattttgttcttttcatttatttttctcctctactttctttttagggaaggaagagatcattttttgaaggtggtaaaatttacatccagcaaaatgcatagatcttacatgcattatcacaaatgcttatacccaagtaaccaacaccagttaagataaaggatagtttcatcttctcagaaacttttcttgttccctttccggttagttcttctctttaaggtcattgctgtttgaatttgtatcagcatttgttatttttgtctcttctggagtatatataaatggaatcatacaatatgtgatcttttaggtctgttttctccagctccatgtcagctctgcattctagccagctgagagtctcttctgagtcttagctccatctatataactgcaggagttggctggattccagctggaaccttcctgcctgctccatgatgcagaaattctctccaggcagtaagctggagcagtcttaaatctcacagtttatcttctctatttcagaaaccactgctcttctttgcctgatgtctcatgtctcatgagccattgtttcatgtgttgtcattttcccggttatatcaggtcagttgtagttccagtctttgttactccatttaggttgaaaattgatgccaacctattcttttttacctgacttcacctttgcactgtgagattagggtgaaggtagcaggagaagacataacatgtaatgggctgtgcttcaagccgcaaattctaagggttttctgaggctttacatcagtcccagagtgatctggcagtatgtaatattctacaactgttttatttattcatttattttagggaaaagccttcaactccagtgataatccctctgtagtcaaagaaccttcttggccaaagaaaacgttgcaagaagctgcgcaaagctagttaaagacttgccaatgtgtctctatcaagtatttattaatttgagtgtttctgttaggagggctacattaaatttttttttttttttttgagaaggaatcttgctctgtcacccagactggagtacagtggtgccatctcggctcactgcaacatccgcctaccaggttcaagcaattctcctgcctcagcctcctgaataactgagattacaggcaccagccaccatgcccagcttttttttttttttttttttcagtagagacggggtttcaccatgttggccaggctggtcttgaactcctgtcctgaagtgatcctcccacctctgcctcccaaagtgctgggattacaggcgtacattactttttacttccactccctctgaaaacacttgattaagctcagtgattgcaggcattgatttgacttgaaaagctagtggttcttattattttcttcacttagaattatagtttattttctcaacctacccttttcttgtggatctttgaccactgattcatgtccctttgccaagtgaaattaacaaatgttttcaaacaaagaatttggagacttcagaaaagtggagttgtttctataccttgtagtgttttggccattgactgtccttattttgatcaccaggcactggtttgcatttatgattttgctacatgcctacggaagaaatgaaggaaccttgcattattggtacctttgatttaactgagtttttttggatatggaaattataaaagctcactgctgaaaatgtggaaaacacataaaagtatgaggcagtaggaaaaaaacatgcttaatttcatcaactattaatatgaccttgtttcagaatatgcatgatgtcaggcacataacagatactcaaaatatatttgttggttgaatgactgagtcttgcatattttcagcatctgagttgtgcaaagatcttagctttcttttcatgaaaagaacactaacagttttactaggactaggtgttttcttgccagaagaaatgcttttaggcatatgggaattataataagtatcccaatatgaaatttccttcttcagataaaaaatgaaaatgtcaagatggttccatttcttttcaatcttgcccttctcctttctcaaagaaagccttgctgtttctgaacagtcattcatacatacatctatataaaagggaaatggttttacagcggatcatggttggagggaaaacaccgctataacataatatgggaaaagagcctcttggtcccagtttcttctgtggcactcacttccaaagtgatgttgtggtttatttcacaagatgagatttcttgtaacagtctagtactctagtgatcgagtgagatagtagaactttatcgtcaatcatcaaatcccacagttttatgttgaccaaaatcagtactacatgattgaagaagttggatgcattatatactgaaaatgtaaaacacaaaattcccctgatttttttcacaccctggattgcaaatttttatttccctgtaggagaattcagtcaaaccttgtaaactgtaacaactctcaggagcattggtaagaaacaatatcatctaacttcaggcattatttcctggtaaattaactacatgctctttgaaatcagccctttactaaatctaaaactgcagttttactcagatattcttatgtgagtgaaatcaaatgcatgtatgtgcatacatatgtaatataaataaatataagttttctttaggagttttcccaattcttctgagatgatttttctatccaaatacctttgtttctatgtcttaaggagttatagctttcggttgcatcttagtccattggcaagacttgtatttctgtaatttctgtaaaggtaaggtatctacttgggccacagatcaggtatctgtctgcctttgtggatgtttggcataaagcccctttattccacctaaattctcgatatttggggtatgattttatttctgtaaaaaaggatttaggcagggaggtgtcatctggattttatctgcccttaagagtaagtgttctttctcctctccctatctaaaatttccatgtgattccctcacactggcactaaagtgtgtcatctggttagagctcacatcagtgccctgctgctggtggaggttgcgggaggtgagctttagaaaagggcctgcagctcaacatacatgtcatggacacaatcgtattgtccccaactcatgaaaattcctgagaacagagcaaatcaaaaataatatgttaaaacaagaaagtttagtgaaacaaactctcggtattgttagaggctttattctaatccctacaacacagcacatgtattctcaacatctaacatatttaatttgcatttggattcctttagcatattgtcctattatataaagtttaatgaacaataaacacagctataaccaaatttcacagctatttctcagtgtggggtaagattttgcatttagttatatttggtttcctaggtaatatttgattgtggctctatttcctgaagctgcatctcttgtcacatggaatcttttggtggcggattctgccgaccgaggggaagccaggaaggagtaagttgctttgaaaccactgaagccatgatagtgaagaagacttcacagtccttgacagtctttgagctctccattgttgttctccaggcttgtatttctgaaatctactgtatgtactagttccagatcagtcttgcccaaataccatttttatcctgtcattcctctgctcgtgaaccttcaatgacctcttctcaatgtagtccaaaccctacacttggctttcaaggtcttccagaatctgtttttcaaaagctgtccctcgaaccacattttcttgaatattcatggctttctatattctaataaggtcaggtttctcgctgtcactagcacattctgtcgtcattatgctccatgcccttgcagctgtacttctttctccctggaaggcgctcttctctggatctatacccctttggggttcagcccaagtctcacctattttcccgagtcttctttggtcagttaaatccatactcatgccttatcccaaatcccactgcatttatattcagtgctgagagacactctggcttggcatctaaagggaattagcgtggacctgagagtaaaaggtcagttcaagttctggcttcttttctttctaatttttgtggcatttgtcaattaatagaaggtgatcttactatggaagtctcacaacagtctcagctttgttaacaaagattataaataatgggggcaaagcagagtattgggcctgggaaagagtttttgtaaagcttcaggtagaaccttatgttagaaatgtaaaacctcctctaaagaaaaatgttaccaataaataaagcaagtaggattttgagtagattatcatttttgttgtgtattcaccctgtttcctagagaatcaactttcctactttgtgcttactatagtttcctctagagtaggggctaactgtgtagaagaggttgtgtgtgggtcgtagggttactgggattagactattcaaatagcacaaatattctgtgtattctgatttcaaatgtaaacatattcctgattggaaatgtgtatatgtattttttatttttagttctggggtacatgtgcaggatgtacaggtttgttacataggtaaacatatactacggtggtttgctgcactatcagcctatcacctaggtattaagcccagcatccattaggtatttttcctaatgctctccctcctctgatcctatcccctgacaggccccagtgtgtgttgttcctctccctgtgtccacgtgttctctttgttcagctcccacttatgagtgagaatatgcagtgtttggtttactgttcctgggttagtttgctgagaataatggcttccagcttcatctacgtccctgcaaaggacatgatctcattcctttttatggctgcatagtattccgtggtgtatatgtatcacattttctttatccagtctctcgttgatgggcatgtgggttgattccctgtatttgctaatgtgaatagtgctgcaatgaacatacgcatgcatgtatctttgtaatagaatgacttatagtcctttgggtatatacccagtagtgggattgctgggtcaaacggtatttctggttctagatctttgaggaattgccacaccgtcttccacaatggttacacaatttacattcccaccaacagtgtaaacgtgttcctgtttctccacaaccttgccagcatctgttgtgttttgataagtccgtataatttaattagaaacctaagtaggttttggaggacctactacctttacttaaacatcctgaattttatttatttgtttattttagaattggggtcttgctctgtcaccaagactggagtgcagtggctattcacagctgtaatcatagtgtattacagcctcaagcttctgggctcaagcgatccttctgcctcagcctcccaagtagcttgaactacaggaacccatcacagtacccagtatatcctgaatttttaaggcagcctctccaagaacattctgaggtgttctggtgtctttagtaatcttatctcctaattttggttcttgcctggaatgaagaaaattactggtctgtgaatctttggctcttgtcattgtaagacttagggaacaatgctgcaatttttgcagcctctgtaatgaccagaactttcaatacacaatcttaactttgtagatattaacttatttttaaatctgctcatttaaagccataaaatgtaatctaatttagtctttacaatgaaatatttacagtagataatttcacagtcactgctccctaattcaaaacgctttgagcctgaagctctaaggccaggccagcttgagtctgatactgatgtgctttaacatgaaacgtgagaccaggaagtggaagacccgtagccaaactctcatccttattcacagtaaatttcttgacagaagaaaccagggaactatggggtttctggtttattatctgagtggtctaatgcaggaattattgcctgccatggggagatgattgcagatcactctccggtggagtttgactgaacaagaagccacatcccaggtctcaggaataatgttattccacaccctccctgttactcaggggtgctctatgatgggctcagctgccgaacattaggggattcgaccaaaaccttaatcatggcgattttgataatcagttccaatgagcagaatcctgtgggctctgtgaaacccgtgaagctgatagtattgaaggaaatgaaatgtgataagtgtgattgcttgacatgccagaagggggttggtggagaaagaattcaaaaaagaaaatttagctatcttaaaaactggcacttctgagaataattatgtagggaatttgcactttcatactctaggtgtttctgagaacaaacacatcttaagaatttagttagaatatgtagataataaagatttaaactgattgccaagggtcctcacacaggaatgatttttcttttatagttaatttattaatttgagtaaaatgtgattcatttacttctgagcctttgcatggtgttcatataaatagtgttgataatttctttctttctttttttttagactgtatctcactttatcatgcagtggcttgatctcggctcactgcaaactccacctcctgggctcaagtgatcctctcacctcagcctcccgagtagctgggactacaggcacatgccaccatgtccagctactttggcatttttggtagagatgagtttcaccatattgcccaggcaggtctcaaactcttggatgcaagtgatgtgcctgccttggcctcccaaagtgctgggattacaggtgtgagctactccacccagccaatagtgtttgtaatttctgatgacaaatatttcatgctaaataagtagccgaccaggaatgaacaagtaattaccaacagtggggcacactgttgtttgatggtatatgttttcctaacatgaacaaactcccttacaacttcaacatctgtgccttaactaaaatctggacatgctgcattgagagagcatctcttggaagtctcctttagtgaaggatgcttttttcctaatgttttaaattcctggagtcagaccttgattctacaatcattcttcagtgatgtttcttcttttaaggtcacgtattttttatatgctgtcgccccgtcctcatcattagcatttattgaccttcaggatgtaaaaaatactctgagttcttcccttgtagccttcttctcactccatcctttgcattgtccttggtgacttaagttttcatgttgtattttttcctaataacctgatttcctcaaatacctggccacgtagcaaagggagtttctattgctggtactgcttcctaagttttcagttctcccataccttaaacctcctgacactactttctgtgtcaataatctcaaatgtttcactagcctccatgtggcagttggagtttctagtctagaatacaaatggtattcccactaatacgcaggagctcttgcctcatgacttgatacactatccaaattccaaagacattcccttgctcggtttcttggcccctgccttacagctagaaaaagtcatgtacttggcaattacttcctgtaaatccatatcctcttaccttagcaatgccctcagtatgttcttttttgtggccatctaagctttgtccctaaattgtgaccattttcttttctactcaataatatctcattttctacgttggtagttagtacttactcagtagaagttatctgatgagagtctttcttcatatttctttgtgtcaaaatgcatttttatgtttaaacatctcaaacctccctggcaattaagacattttgggacttttctccaaacataacattccatttaagtctgggactcactttcataaacccatgcacctgtgggaaaactctcttccccaacgtgccctaaactttattgatttgggcttaccttccttaccttgttcatctagatatgttcaatgggccttgtactgaatatttgtgtggtgtttacatgtttatacatgtttacctgtgtgtgactttttttttctaatttgaaccaggactatgtgattattttacttgtacatttcttagaacagtgtcggtcctcaaaaaaaacgagtgggtttcttactctctttcctttctttcactaaatatttcatcattgtagcactgatcttacacatatttgttaatttttctggctcattgtcaactgtgagttctacagggtaggtacaatgcctcgtttatttttatattcccggtctctgtatcaaacctacataggatttgcaggaaatgagccactgggagtttttgagcaagtgtgtgatatgcccaaagatatgccttagaaagattcctcctggcagagtgtgagaagcaggttgagagaaaatagtaagctttgttgagagaagattgtaagcctttctgagagcagacaacacgtggctgcataaacagaccctagtgcaatgtctgatatatagtgcagattcaatgaatattttggggaagaatgagcaaaatcaagaaagctattaggaggctcttgaaaataggtgtggtaaatggcaaaaaacaaacaaacaaacaaacaaacaaaaaccccaaaagcatgaactaaagtgtcagtactggtaattttagggttagcctcaactttaaaaatagaatataagctgctacatacacatgggcacagccaattatagtagtcaaagtatagtagtcaaagaactggtgaaatggcaaacatttaagaaatttactccatttttaactttataagatttgattattattcctttatagccttagctttttttttgtttttacaattaaagatgtttttaagttaaaataatccacttatattagagcctctttttctattatccagacagcacatattattctatccattaaaaaatgtgaccattaaaaatggctagaatagcttaataatataatatcatatttattctatgatttccagtggaatgaactgttatggtctccctgattgattataattttaataaacttggttgtgtgtggctaggaacaagttcattccaagttcattttttccctgatgtagataaaattccatcagctaagttctgctactgtgccccatctccagacttctagctaaatgaagtactacagggctctgattcttgctcaaactcactactgctaaactgaaatgcttgaggtattcaaaactgttattttctgcgtcaatttgatatatgtgcagcatttcttttttaaaaggacatgttctgaatgtttagagtgtgtagataaccactcccaccccccaacacactcacgtaacagaagaaactttggatacttttattgtgtaaacttacagaatttgtgtcaaagaagttcatgtggcaaagacatcaggtgtatcaaatattttggtggttttgtttaaattcagagtgagaattaaccaagcatctacaatacgtacacctgctctgtattctaacccttttgttcatggcatgcacattaaaacacgtagctccacttcgctgcattgttgattgcagttgatgatgagggttgtcgtttctgtcaacttttagtattgaagagaagcctcatgtgtagtgatgttagggacagttcagccatgttacatacctagaattgtctctgaaaaaaaaaagtcatgaactttttttttttaaaggcaatagaaagcaatcaaccaaccaaacaaacaaacaaaaaaaaacaaaaagtctgggcgtggtggctcacacctgcaattccagcactttgggaggccaaggcaggcagatcacacggtcaggagatcgagaccatcctggctaacacggtgaaaccccgtctctactaaaaaataaagaaaattagccaggtgtggtggtgggcatctatagtcccagctacttgggaggctgaggcagaagaatggcgtgaacccgggaggcagagcttgcagtgagccgagatcatgccactgctctccagcctggatgacagagctagactccatctcaaaaaaaaaaaaaaaaaaaaaaagcagaaaaatgtgttgattacagagttaagggggagaaacttataaatcatggttatttaccacccctgagaaggtaggtacaaggttgactactacttacctcttaatcctatgattttctggttctgtggcttagaaggtttaagctctgtcaagtggctcaagcaggacagcccaaggtgactccaattctctgtgactttgttttcccatgtgggaagtaaaccctaccgctgtgttgtaaactgtttagatatccacataagaaggggttattcggtattttgggggggcttaagataaaagctatctccatttgagaaattagaaaaccatttctacaaatcaactctgttaaaccttgtcgccccaaatcaatttaggacaaaaagcagcagcacattacttttttaaaagcccaattcaattttaaagttttgaaaaatttcaagcaaacataaaggacagaaaatgttaaacatccttgtactcaccactcttaacaagcgtcaacattttgccacatttgctgaatactataacttacttttttgctttttaaagtttttattattgaacacagacaagtactatatgttaatatgtgcaatgtacaagaataatgaaatagtcatatgtctactacccaacttaagagttatagatttattttttaaagaaaaagtataattactttgagcttgccagcgtaagtttcctcctactctctccctgcaaaaaaaatagttgtgtacaaaataaaattcctggggttgacattcagatgaccccaatgaatctgattttttttcttttctttttttctctttgctttttttttttttttttgacagagtttcgctcttttgcctaggcaggagtgaagtgatgtaatctcagcttcctgcaacctccaccccttgggttaaactgattctcctgcctcagcctcccgagtagctgggattataggcgcccaccaccacacctggctaatttttgtatttttagtagagatggggtttcaccatcttggccaggctggtcttgaactcctgacctcatgatccacccgccttggcctcccaaagtgctaggattaaagacgtgagccaccacgcctggcctgaattttttttctgttgctcttcaagttagatggtttaagtaatgatgtttgccgggaagagatttgaggacctaaccgtgagatagtcctgccctgttcaggtctcccgtgtttcctcattagaccttccagcttattactggaaaagcattcttttctccatgttttaaacacctattgagtatgaatgttttaagtgcttattaaatactggttcataactctttgtaagagttaggggagaatcatcaatatctggaacaacaccattcttcatgatattggttttgagagccacgtgggcagagaaataaattctagaaaaaaagaaatggtaatctgacatgcagacttggattataaatatggtcaaaggtgtacttaaaaacaagatattttgcttcttggttagctttactgagaatccagggatcaagtaaaatcattgccattggtactgacggttgagagtcagtgcgatgctaaaccacaggaactccttacttctatgcatgattaaatccagttgtcaggtttgggcagaagagagccctccttttcctcaagtctatagggaggtgctgtgggggagttttctcattttccagaatatacagagcaaggatcatccatcataatcagacaggggtatttcatatcatccatttccagtgagaactgtggtaaaattctgtcctttttcccatttttggctgctgtgattgaaacccgtcttataaacagaaaagggtagtttgagttattttaaaaaataagaatccttcagtctctgttgcccattttctcctctatgaataatttctgcagacaggtgaccagttcaaccatctctctcggttacaaatgcctgtggttggtccacttccttcagccttggagtaaaataaaggcttcttttgcaagatcacgaaataattcagcaaatactgtgggactataaggtattcctgtgttgtcaccttttcttttgaagaatatagagaatatgcttttcttcctctaattcaaatacatagattccttatgcttgtataatgaaagaataagggctctgatacatacatatcattgaacaactattatcagtattaggcaatttagaaaacaaaaaataagacttcagaatttatatcagctccttcaatacttcatttagctggatccatttaaatatttcattttttagcctatgttgtagtagattgcttgattggtccaaggtagtctctaaatccaattagagaaaatgaaattcaggaagcacatcactgtagattttggtacagtgacttgagtatataattgccatctctttctatgttagctcaggggtgggttttgtgccataaaccaaccatccaaccaccagtctacccacctacccacccaactaaccatcatttgggctatatctatctgcatatcatacataatatccttgcaggaattaatccagcatccatatgagtgtaactcatacctaggctgataacaaaatctgaaaggtttttcactgaaatatatcaggtgactaaagaatttcacaacccaaaagaggagggtatatcgatcctagtggaattctatttcatggattttgttctgcctttattgacacagttagacattaaagagaataagtataataacaaaatttataagaaatgcttatggaatattttctaattttagctacaatgatgggttgtttatattctgtggtttgatttttatatcaatctttatgcagctattatcattacccaaacaagtagatattattgcccctttaataacagtgaaggaaactggaatgtaagaattgaggtaactggcccacacaccacaaagcgaggaagtaggaagctggaattcacatccaggtttgtctgttagaagcccatccccttgacctttctgccatattatctttccttatgctgtggcacaaaaaaagaattgtgaccataccatcttcccagagagggattagacaaagtccagagaacgtctagatggtcaggaactctagtcatggcgatgctagttactataagaggatacttggcaaacagcattgcacccagatggtgcgcaacccacacgtctctatttacgtagaggtctcaagtgtttgtattaacaggtttggaggataataaaaggagttgttgtttgttctttctttgtacgtctgaaattaatttttagcataaatttaaaaggggagtttgtaaattcactagacactgagagactggagatccaagcaaacatttgtctgttgagtttaaaaagatctggtgtaaaagtgattgttttctattttgcccactaggtggcgctttggtctcacaggttccttttaatgggctggatttccccgcccccccacctccccccaacccacctccccccaaccccaccccatacctagatgttggtccaggaaaaaaaaaaaaaaaaaacaattcaagactgattaagaggactatgtcagttgagtttgttcagtttgggttttctctatcattatccatgttgataacaaagataattaaacttatttgaaaattttggacactcctttttcaaccttcttgcaataaactgtattcacttattttggaaaaaagcatcaataaatggaactagtgagttatcttctcagcatgtctccacaggctacacttacaacagtctttcctcctacagagcggggcaagtcataggaagtgactaaaaccatgtcatttgggtgttcatattaagcacactggctatgagatcgccccggaatgtatacacagcccaacatgtcattttcttaacaccttaacatcagtgtggacaaaaacaataaggaacaatgttttaaacatgtttacatcaaagaggactggggtcataaggaagcagttcgatgggagaataaataacattattccaaattcaataaaactgatcagtcattctacaaatgtacactgatttgactcattccattaccatgcaagaattttatttgttgactgttgtgaagacattcctgtcatcaagaaggaattttctaaaattataacctgagatagtagtaagtgatagaaaaattcactaaatggcttttccatgaaataatatttatttatacctacttctgaatacctactatgtgctgagcaggtgcagggtgatgtgaaacatatattaaatcccttaaggagcctacagacaaagattaagagatggctgaaagatagtgtatccaaggtcacgttggcacagattactgaagtgagtggggtggcctggaagaacattaagtggacatttaagatggaacagctaataagacaaaggtaaaatgagtctagaagaatgactagactgagaagagaggaaaggaaagaggcagaaatagtagaatgtagaaaagctttaggcccatggtgattatggagaattgcagaagtccagtaatctagagcataataatgcatatgtggaaagagtgggaaattggggccataggtagaagccagaatcagggactttgagtactaaattgagcatgatctattttctagaaggtataggagagactttgaagaaggctgtcacttgctccccacgtaaccctctaagaaggcatgccattcacttccactttccagaagacacaggtgtgtttccccagaagaccatctggatccagaatctgtgcagactgaccatctatcatggtctttccttgtgggaattttaagtcttgactttccttctggagctttccatgcgaccgaggaagtgattatacaatagcagatgagatccttggtataattaaggattgcttgtcactttcaacatttccccccatcaaaccgtggacagagaggccttggaagggtttagttctgctaccatactcatttaaccctgctaagcatattttcttcagcattttgcaagcagaaatttatagtaatgttttttgacactaactctgagtcctgcattctctgcctgacttgctgtatttgaaggtggtagcgaaacacatggtgtatgtgtatgtatgaagtaggaggcatggtggtacagatttagctatgggacttttcagctttgcctgtatgaaattcatttactaagtatatgtaagtgaaattccagcaattcagaaagggttctggaattgcttaaagcccatcactgcttgtgaattcttcccacattaaaatgttatcttacagaaggtcaaaatgtctttcctgcatgaatataataatgacttacaccttagactgtaaccattgtgaatttattctatgtgtatctatctctggttttctttgttggagtggcaagatttaaagcaggccaattttatgcctcattctatgtgcaccaaaactacttacatgatattggttttcagtgcctgctacaacaaaaacaatatcccagtaacagcccactttactttctgtgggtagacaatgccctcacaggggttattaacttctcccagagaagcttttgtctttgcaatcctgaatgcatttctcttcatattagattttaccagtcaccttgttgattatgaaatgctaagtcagggtctttattagactgactttgctttccctttaataattcaggtaattattatatttacagaatttgcctattttttgaaatcaacactttgttaatcaccagacccatgacaatctataagtagccactttacgtggcttatagatctaaagtgaatgttggttttcacacattcattcataactattatttttactgatatattaggcaaaatataagattcatttatgagtttgttcatcagctagttataaaattcctgttgcatggtaagtgctgtctgtattgggcaacagagataaaatgggaaacaaaacaaaaatcttccctactgtcatggggtttacaacacctggacttctcaaaggacactgaatcaaaggttcttctctaagactttgtatgaagtcttagtcagaatcaaagatggttggcaccatcattcactaaagtggcctgagaagtaaaaaacctctgtatggcaaggagcagtgggacctctctttttttaaacttttattttaggttcaggggtacatgtgcaggtttcttacttaggtaaattgcgtgtcacagggatttggcatacagattattttgttagccagataataaacatagtacccaatagcttttcaatcctcaccctcctcccaacctccaccctcaagaaagccatagttcctgtcattcccttctttgtatctctatgtactcaatgcttagctcccattttttaagtgagaacatgcagtattgggttttcttttcttgtgttagttcacttagcataatagcctctaactccattcatgttgctgcagacatgatctcattctttttatggctgcgtagtattccatggcatatatgtatcacattttctttatccagtctactattgatgggcatttaggttgattccatgtctttgctattgtgaatagtgctgcaatgaatgtatgtgtgcatgtgtcttcatggtagaataatttatatttctttcagtatatatccaataatgggattgctggctggaatagtaattctgttttaagttctttgagaaactgccacaaccattggtggggagctagtgcagttgtttggaggtaagaaaatactctggcttgttgagtttccagagttcttgtgaaggttctttctcatttgtgtaggtggatgttccttcaatctttgaagttgctgtcccttggatggatttttgttgctttcatcttctttgatgcccttgggggcttgattgtggtataaggtaggttcagtcaactcatttaagttcgcttttccaggagtcactggggaccaggaatgagtcctggtgcatggtaatcccatgcagagttcccagccatccctctgtcagcccagcacctgtgtcttcccacatccactgtcaatgccttccctctgagatttgctcagagtgcgcctgtcttcgcaatgtccccatctcttggtgacagatgttcctcttggctgcatctagtcagccatcttgaatcaatctctggacctctacttaatatccctgagaatctccttctctgttgtcaccggtgcaccaactgccaaagacaccatttttgcagtgtttggtggggggtttgtttacctctacaattgcgtaactgaatgaccctgagcaaacggtttaacctttctataattaacaggatttcttcttacatccaagccctccctgctgctctgacccagctgtgggtgatagatcattttcaattctgcaaaccacggctgagaaagatggcagtgtgtaaggctcctctgatagattaggaatcatggaaggaagggacattggctgctagctatggctgctcagacagacaacccatgggtcttggttctctctagtggatctctacagggcttccttaaagtcagaggctggctttgccttaagattcttgagcatgagtagaactcccaacccaaagtaaagagagcaaaatccagagaaggacttttctccattctaaggcccgcctcccaagtccttaatttctgttttaaggtctggctcatctcaagaagaatgacacttgaaattatgacacagaaagaccctgtcttctacccaaaggggtgtggcattgtctggtgatgtgggctgcttaagcacgtttaaacacagtagtccaacaccagtaaatgataccctacagcagggagatgtttccttatggttctgttgaattctctggcagaatgtgaattctatccaacctcaagatttgttgcttatctagtacgattggctgccttgtccacaacatcctaaaggccctctgctcttttctcttaaagggcactctaaagtgccttcccagtgtgtaggaacaggactgaaagggccgtttttcttggctgctggtgactttccaaagcaagtgtctttcccttctcaccttgtccatggccccttgtgccctttatttgctctttctgcctgatgtagcagccacaagctgagagggctttctgtgaagtggcaggacctgacataagcagctttgtgcagtgggaaggaaatgtttatgttattatacacctgggacctctaagtccacaaggttcactttttattgtacacctgggccatccttttctacacttctggctcaatttgtttttggtttggtttagaaggttttcttctccctaaaatctcccttaagtcttaggccctttttatgcagaaatgcctgatctccaggctcaaaaaaagcatcttgtgcaagggaaatcgttttagatttaggaaacctcttacacagtaaatttgaattttcaaggtgactgaaaacttaaattcaacaaatatttttatccacctagtttatactcaaagtgtgctagatgcaagggatagcacggtggtaacgatagacatggtcccagctctagtagagcctgtgatctggtggagaaacaggcactaaatcaatagctacaagagtgatgaatgttacaaaagaagagattccagatgctacaggtacatagagcaggaggatttaacctaatctaggggatttggggagttttcatttaactctgctgttgtctaactgaatgaccctgagcaaatgttttaacctttctataattaatagcatttcttcttactcgccaagctctccctgctccagccaaggctcctgggtctatgaactgtaacgtcaagagagaatactgtcaacaacagtaagcctgactgcagagagtaaacacaaggagaaaatggccttggaaccacagagtagactccagagtatcaggaccatttggaggagagaatggggaaaaggctcgtgggcagacagcagtaaaccctgtgatagacattccatctgtccattagtataaacctggcacttagcccagtgatcctcaaatatttgtggaatgaatgaaatgcaaagcaatgtcaatttctgtccacagctgcttgactcttaaggttagtgttgatccctttggggaatataggcgagcagatgaccccatacattggctaactatgaattgagtggatccaatgaccactgccctccttgtgcagatcgccccacggatcactggctgtgtgtgcccatctacccctttctacaagaacttttctagccctgccaagcaactggttctgttcatgatgctgtggggttaccacaaaatacgtaatagctccattcacttagaaagactcatcctagataagaattatcctgcctcatctacccctccctcatagtttttcatctcatccattccctcctcctccccatgccgttatcaactttatacattggaccccatcctgggactcatactctgctaatcctgttcttggagttagggaggttattcaagtggcttggagaggagatggggaaagtcactctagacaagaaacattcagactctacctaggactaaggtcaatcacaatactccaagcattactggagcaaattataaccgtagtcgggtcagcttgcacattctatgctatatatataatgagggagatatagttttcatggcaggttctctgttaacaatgggcaaagactttggggattgatgtctgcagggaaaggatagaaggaactgaaacttctctccacagaagcacctgaaacccagtctgtgggcctttcgtgtcagaatctagtgaaatgattttgacaccacacacggcaaatctgtgcatgtttttctgtaacaaagaactgagaaaatcaggagtccttatcaaagggaacctttgatgaccctctggtggtcaccttttatagtgaaaatgtttggtaaatagagaaaaaggggccaggcatggtggctcatgactgtaatcctcgcactttgggaggctgaggcgggaggatcacctgaggtcaggagttcaagaccagcctggctaacatggtgaaaccccatctctactaaaaatacaaaaattagctgtgcatggtggtaggcacctgaaatcccagctactcgggaggctgaggcagaacagttgcttgaacctgggagacgaaggttgtagtgagccaagatcatgccacggcactccagcctgggtgacaagagcaaaactctgtctcaaaaaaaaaaaaaaaaaaaaaaaaaaaaaaaaaaaagagagagagcaagaagagtgaaagttataaatgaaaacaataaaaaaaaatccaagaaactcaaggaacctttgatgggaaaactgggtttttctctgacctcactactttcccttaaccatcatagccctgccacttctacatgcattggaggaagtgatttctccactttctgagatcctagaggacttaatttgcatctctatgataagaattttaccattatgatctttttattctcatctgttttattgctacaggattatgggctcctctggacagtgttttattcatcttcctctctcactctcctttacagagtaggcccctaataaatatatgcagaatgaataagcaaaatcaataattaatagatagcaaatacattcatgctgacttctatgattctttttctcttttctgtcttaggtttttaaaagtagtacaataaacctattgctagtgtctcaatatttgcctccaagagaataaattgtccttttaagaaacaaaactatctttatctaaatcaaggctgaaaaagatatctaggtacttccaagttactgagcacccctgccctggctttcaggaattacagctgctgattaaacatctgtttccctgccttttctctacttattatccttctctacttattcatccttcaagactacttgaatttttatcttcttactcagtaaaggctttctctgtctaccaaagctggaaacgtttttttcttttctgatatctagcatgactcattactattcccattcattcagtacagatgatgtagggacaagcactttggagacagtaccttggttcaagtcctactgtgctactcagtgatggtcagtgaccctttgatcttgagtttcctcgtgatgttgataaactcctgtgttgggatgactggtctagagggtgagatgaggatatgcatagaagatgcctattccaacacctggtgcttattgagggctccattaaaggcaactgctcttattatttgcatatatcttatgccatgctctagattgtaaattcaagtattatgtatctttccaaataacagcatctgacttcttgctttcagtgagagagatagtcaataaataaacatattatatcatgaaagatagtgataagggctatgaagacaaataaagcagggtaaggagagaaagaaaagggccagggataatgtaattgaggaagacttctgggagaaaggtgcacttgaatagagattgaatgaagtgaggaaaagaattatgtccgtgctcgggtggaagcaatgcacttgataggtacaggaaaggaaactccaaaaggtgtagaagaattacagcatcctagtgacacagaggcccatggagtggagttttgcaaggaggaaagtaatcctcagtttcaaatgcagttgagagggctgggagggcaactgcagagaacacttcctggattgagtaagtaagagagcaagaccaatgacagtggattggtgagaacagcagacttggggatgccctgagtaatccaatgagggaaaccaagacaggactgtaaccagagagagaaatggattgaaaggggagttagactttcatctgaaagacttggttatgtgtctggtagagaaaaaaagaaaagttaaaaatttaggagagagataataactgacagcatggtcttgaagaaggcaggaactgatggtttggtcttaagaaaagaagtgataccaccacatgcagggtaaagagggaaatactggatatggataaggctagggatggcttcaaggttgctttcttttcctttcccttcccttcccttcccttcccttcccttcccttcccttcccttcccttcccttcccttcccttccctcccctcccctcccctcccctcccctcccctcccctcccctcccctcccctcccctcccctcccctcccctccccttcccttcccttctagatggatttccgctcttgttgcctaggctggagtgcaatggctcgatcttgtctcaccgcaacctccgcttcccaggttcaagcgattctcctgcctcagcctcccaagtagctgggattacaggcatgtgccaccacgcctggctatttttttttttttaatagagatggggtttctccttgttggtcaggctggtcttgaattctcaacctcaggtgatccacctgcctctgcctcccaaagtgctgggattacaggtgtgagccaccacgcctggccgacttcaaggtttctaattaaatatatggcagagtttgcagctgagactgcgggtcagggtggtgagcttgattagaggggtggaagtttaagctagaatgaataagaaaagaaacccatcaaggaacatttaaaaaacaaagtttgttctctttgatcttggggaaagtaagtcatgtactccatttagtacaaataacaacccctaaccacattgtccatattgcagggtttcctaagttcacaccaatgaaccaatctctgtttatgaaatgcgctctgcctgtgcttgcattttacacacacacacacacacacacacacacacacaccactctacatctttgccaattcataaccaatcacctcaattatggagggtgatagtcttttctttctttaattaatgagtttccagtttagatgtgtgatctttacacagtactatttaatactgtgcagtttagattcaggtaataccacagtggcagttatttctagcagcaggtgtggttggttacttttatagacatatgctcactgtgatccagggactatgttggacacttgatacctatgttatcatattgaaaatccttacaaccatactgtaagctgactgatggggaaactgaaatgtattgatattaaggaatttgctcagggtcgcctggcttgttaaggtaaactttgaggttgcaggtgcgggtctgggaccttaaacatcatcatgtcacctagctacagcaagagccagcagaacaatactcttcagcctggttttgatatggaagatgctcttcagcttcatgctggcttgaatttcctttgcagtgaagggagaggagaaagtgcattttaataagcttcaattaaattaatttcattttacttcttttgatgtatggtctcttcaaaaaatccaattctactgatgtttattaagtgcctctacttacttggagagtgccaggcacttcaggggatctatggatgagtgtgattcagccctgcttcaagagctcacaatctagtggagaggatgggagtgtgcaatttgctctaatactagattgaatgtaataagtaccatcagaagtggcccaaactgtggttttttaattctgaaatgcaaggttatgtgactaattagaaaattggcttggcagtgcctaaacaccggaagcatcacacaatagaactcttataaagggtctttatttcaaacatgattatgcatttgttcaaatctatggcatacaatgagtgaagaatgtattgatggtggtgacatcatctgccaggctgtgaaggtcaacagtgccagcccaagttgtggcatagtgttgggtgatttaaaactcaggggcaagacagtaaactcacaacaatcccagtggtggtgcatgacctgcagctgttcttggttctttgtgtgttttggcaagcaacagctgttcaagacattgaactgcaattgcacaaaaatatatgttatgtgaagttgttggtttttcttcttttattactatagggtgcttttttgaagttaacttcggaaatattgtgaactcagaataggtcaagtcctatatattccagctaaacaattgtttaatacatttttaaggagatttaaaagtagggcagtagatactgccataaaattcttttccaggtttactgcaagcttttggaagaaagaaataggagctagagaacatgagctagtacaatgtaccatgtgcaaataggaatttaataaatgcttcccaattcttttttttaaattggtctcctaggtgtgttaggttctgtaatagtcacttccaaaatacacagctgaaaaaagcattgcttttgtcttctaaggttttatatctaaatagaaaggctggggaaatggtccactgacaggtcaaaagcaagatttctagtgtcatattattgggaacacacacgaagccagaaaatccatcatttcataacttttgtagcacttcacactattctaccaccacatagatgtttgcttccatatttgtctgaacatccttgcattttctttgccacactcccctgctgcaatcagtccatgcctccctgatggattggttgcagcagcatttggtgttgcttggatgaggtgatggatgcttctctctcttcttcagctacttggagccaaaatacaaaagtgctggttaaaaggtgattaatcttccctaatggttttgtgcattgcaaacaggactgcagccaccatgtcttcattagccttaatcagggcccacattacctcagatcaggtaatcggttatttattatagaacagcaggcaaaggccttttgagcaagtgtcaactgtataaagtctatttggaaaggaaaaatagtggggttccagttgccaagcatccatagggaaggaattaaagctggagtgtatttctgggcacctctcctgctaagcactttggttgatggagggcagcgggtggctttgaggtcatcaggatggacactcagtaacagccctttgccttttttttttttttttaacttcttttttgcttccagggtgacattatctgggtctagggactgaaacagtttgggaaatgttgtcttctgaaaatggaagatggatttttagtatctttgggggtttggtgtacttcttaaaatatgagtttagaacttgctgtatgcccagtaatattcagggtactggggatacagagatgagcacaacagaccaagctccaagcttttgaagcttacattgaatggaaaagacaggtaataagcaagtaaacacatgcaatagaataaaatattagcactttctgaaaaaaagcaaagcaggtaaggaaagaaagagtggggcagggactgatcagggaagtcttccctgaggaaaaaacatttgtgttgggattaagtgaagggaggtgtattagtccattctcacactgctataaagaaatacctgggactgggtactttaaaaagaaaagaggtttaattgactcacagttctgcattgctgggaaagcctcaggaaacttacaatcatggtggaaggtgaaggggaagaaaggcatcttcttcacaaggcgacaggaaggagaagtgccgagcaaaggggaaaggccccttagaaaaccatcagatctcaagagaactcactgtcacaagaacagcatggggtaactggccccatgattcagttacctcccatcaggttcctcccacaacacatggggattagggaactacaattcaaaatgagatttggatggggatgcagccaaaccattatcaggaggggtgcccagcattgtaagaagggccttctgtgcagagggaacagccagtgcagaattcattcttcaagtggctatgttccttttatttattttatattttgcacttcctaagaatcattccatggaatcaatccattccatcccttccataaagtacaagcaaagttaaacgagctgaagtaggtgaatcactagaacggtgtctggcatatcattcatgttcaaaaaaaatgtgagctgcttcctttcaatgtgcaactcaagaaaatgacttgccatccattcttacatacagagggtggctaccatttgccactgaaacaccatattctataacttcaggccatcaatgggaagcatcttccttttgcttccctctctcctttctctctttttttcttctcacctgtgtgctgaaacacaagtgcctcaaattcaggtttttaaataaataaaattcaataaaatcaaattcaggtttttaaataaataaaataaatgtaatctgcagatcacagagtgaacagctgatgactctgtgataacatcatatcacatccacatattccataccatgatccttaaagaatacatgcacacacagaacagtgggaacagctgaattaggtattaaagtggagtataaatagaaatgggtaagttttgtgggtagctgagaatttagagcatttaggagttcagaacatcattttagtgcaggaatgttggtctttcttgctaggatctgtagagacacatgataatgatggcctttcagggcttggtaaaacattgtaatctgtataatattgtgattatctccaaagctatccttaaaatgtttggggccctaacatcagtgttcaaaatcccaaaatattattctcatcagcaaaatattgctcctacacacaaggtacctcttctccttttttcacttgctaataataatagcaagtattaatataaggtatttgttgagcaattattaaatatgtcatctctaacacaacagtccaaaaagacaggcctaagttcttctactttatagatattgagactcatagaggcataaagtcctacagtataaatgagaagctgggatggccctggatgtgactgcctgtaaagccagttcttcactcatactatttgttatttttcaaaacattcaaccattctcttccctttgagagtttatcatttttctccctaagtcctggagaatctttcttggcaatgtcctgatattctattcattattttcctaccctagttctttcttttcatagtctttatcctttcaaatctagactgctgttcttttctgttggtcctccagactccaaataccttccagtatcagctagtcttatgcactgtgattggatagttaaatactactttgacacaaggctgccatcttactgttggaactctccactgttcttatagtaatcatcaggctctgaacactggcttcccagccctgtataatctcccccactttatttatccaaacttatttcagcagcatggctgaagtcactatccatggaactcactgcgtgtgttcccccgataccttgtctcaaactgtatgccctactaaaagggcctccaccttttctttacattctaaaaggtccagatcaatttttccctctaccgtgaaatttattttcccttctcctggcatattgatctttccctgtgaacactttctgtaaacttgaaaggtctataaaatggtcctttttatatagtctttcaatagaaacattttatcttacaaaagatgccccttactgaaaatggattattttctttggcgatgggtgactgttcagctgaaactaacagaaaacacaacaaatgttgacttaaccagttagaggttgaagacattaagtaagaaaaagttgagaagtatgctcgccagggtgaggcagctgtttaacgatgccatttgggagccactctcttctatctttctgtttcatcatccttgatgtatatgctttcagcctccagtttgttgcctcttagtcacagtatagttgctgcacctccaggcaagaggaatggaacagcagaagtccaggtatgtctcatcggtcagcattggtcagaattacataacatgttacccctagctgcaagggaagctaggaaattgagttttgagcttttaagcttgtatagagaaagtaggactggaaaaatgtgctcaagaactgatcttaagtaaataagcctatagtataaggcgcagcaaagcttaatgaatagatttttatattcatataatgctccattcttttatgatgggaaagatattagagtgaagaaaatggaatactggagtcagattcaattgttactgaatattggcactgtcctcttgtagtcttgagtaagtgactgttctttctgagacagatttcctcatctaaacatttggcttaataataacactgcctcttagagttactgtgatgattaaaagaggcgatgcctgcagcctatgatgtggcacatgtcaattctttttccctcttccatttgaggccctggtaggtgtggagaaaatcctaaaaacaataaaacaaaccaacaaacaaaccagaaaaattgaatcaatgaagacaatatctgccaccagctagtcccataaactcatttcaataaggaaaaaatatcaccccagtaacggaactgcaggagtgttttagatttatttatcttgtaattgagtggaaaggaaatctctgaatgtttgtgaaggtgttgacccatggatactaaggtatgtgaaaataactcacacatctcaggtgtttaatgaggatcaataacaatttgtgggcccatcagctctacagtcctatcacctcaaatcacacacaggaaccctgcttctgaaaagtggcacttgggagagagaatggcagagtgaaatccaattagcaagatctgcaaaagaggcacatgtgccagaatcatgcgtgatcccagaaaaaaaagtatatatatatataactattataattttatatatatatatatatatatatatatatatatatatatatatatatatatatatcatagcacattcttagcctacccacctcccactaccccaaaaagcaggacaacattttccatatattctattgaagttttttttttttttaaaacttgttggcacagaagcctatatctgtagatattttaaaaactttacttatatctatttgaaatgtgttaaaaagccatatattctttttttttcttttgataaaaggaaaagcaacaccctaccagatgttgggaggaatagtaagcaagtgattcaatcagatttctcctatggggacatagactctctcggtcaatgtcacagaatgaaatagtctcagattcacccagcagtgagttattccatctggttgtggcaattaggagctgaagatgacgggaagttaaatgactatctttatgaaacaaagcaaaatagaaaagggaacagctgggggactggatggcttggggatgcagaattggatctagaataaagaatctgttacttcgagttgctagttataatgccagtgcaggttaatacaaattgaaggttgctgctgtgtgctagcagttagctgtcgcttgcctgaaatatgaccataacatttacagtactgtctggattgaggtctctagaatgtaatgtcctttttacttaagggccaagccaccagattaactacatagacagggagtcattgaacttcagctctggaaaggatgttgttaccaagttcagtttgtgaattgccaggaatgttatgtgtcttttctttgcatgtgttatagtctaaaaagatgcatagcttttatcaaatccaaaggaaagaatgtgaatccaccagtccttttctaccctcttcccctcttcccccacaaaatgtgaagaacttgctttagaccttgtctttggagttgggtagtctagaacataagcttttggcttactgcttactagctgtgtggccttgggcaagttatttaatctctactagatttattttttctaatttatacaatggggatgataatattgtttatcctattccataatgttttatgaggaaaatttgaaataatatatgtaaatcgttttactgtaacatgtacgaaggatccaataaatattggctcttattattatgttgaggtatgctgaaagttagtggcagaaacaggaccagaacattgatacccaactcactactctggcctttggaaaacatggtgagcctatctctcttcttatttgtcacacccttcatgttttggcaggactcaagagctaacataaggtactgaaatcaaataattacttctaccattacagcgctaagtggtctacttctgcattttgagctctttttcagaattctttaaacatcttatctgcactgcagtctggaaagggaaatcacagagagaagggaaatcatactttggctttccaacaccctctacccaagttgcccaagacaaaactgtgagcaaggttaaacgtctgactcattagtaagaggaagtctttttaggcagttcctctgttgaatagataaagtggatcaaacaaaagagatgacagattagaaactgtctggtggctaatgtactgtttactgcagtataaatgactggtgtttgggaaatgacagatgagagagaatacaaatgtggacgtaaataatttccaggtttctacagtggaggagagtcatggttggttaggatgttgacagggaagggggaagtcattggttggagtttcagggaaatgagaagagcatggagaggacttttgaattaatccattgatccacgagttaccatagcctccgtgctgcatacagaaggtaccatgaaggggtatagttcttttgctcttttctcactgcctgatccattctaaatgtaactcttgttccagaccaagtgcagaaatctttacagagagaaagcattgggatggggatgaggctatgctcagccagtctgggagatctctaggggaaaatgtcataggaaaaaatagtgataaatatgcttaaaagaaggcaaggaagaaagcaaggaaggaagaaataaagaaaaagagagagaggaagaaagagagaatgaaaagaagggggttgggagggaggaaataaaagaaaaaagaatggaaaggaagaaaggaaagagagaggaaatatggtatatcagttattctgcatgatatgtttgagttgagtttgtggtggttacttgccccagggtatcaaaagaagtctccaattaatttgtagccagtgtaaccatatagcatctatttgcttagttttcaataataataatactggttctgattaaataaagcatattgtcaaacttattatttgcaaacatattactgttgtaactggtaattgctcagatctctttcggttcctgccccgacacccaaaagtcaagagggtggaaggtgaccctttctaagactttgacatggaaattctttattctgtttcaggaatggcaaattccagtttacagatggatggaaaagatttcttccttgtgataatagaatgcaggacagtatttctcaatagccatgccaatgacattttttgactggttaattctttgaggggattgtactatgcattataggatatttaacagcatccctagcctctacacagtagctgccagtagtagcctccccaacactaattgtcacaataaaaatatctccagatgttgccaaataccccttgtagaggcccaaaaatgccccttggagagggctataattgacatttttgaccggataattctttggggcaattgtatggtgcattatggtttgtttgtttgtttgtttatttatttatttataaaacagggactcatttttttcacccaggcctgagtgcattggcatgatctcagttcactgcaacctctgcctctgaggcttaattgatcctactgtcttagcccccccaagtagctgggactacaggcatgaccactgtgcccgtctaattttttttcttctttttttttttctttctttctttctttttttttttttgtagaaacagggtttcaccatgttgctcaagctggtcttgaactcctgagctcaagcgacccacctgcctcagcctcccaaagaatagaattgcaggtgtgagccaccacgcctggcccattatagaacatttagcagcattcttagcctctacatagtagatgccagtagtagcccccccaacataattgtcacaataaaaaaatctctaaacattgccaaatgtcttttggagagggccacaattgttcccagttgagaatcacttcttcaggatagactgttgttaaaccattgattcagattcccagggaaagactggacactcagcagccgagcatcctgctgacccccagaaccctgccttgacacctgctcacaaacccctcctctccaccctcaagggcaaggtgtaatttagctgcagccttttcccaaatgcctgtagcttctacaattcaatcttttttatttgtaagtatctttgcagttttctactttcaaaagactcttagtgatttctaatacctcaaattgtacaggtacatggctttttgtctctttctctgtgtctttttttttttttttttttttttagcttttcattgtagaggttcctactttttattttttctttccatgtttattgcttttgtgtctctgtcttcctgatttcattttggtgtggaaactgtctttctctgctattatcaatatcttactacctagatctcaatttcattttatggtttagccttttggtgtttatctccccagtcgctatcatccttttaatgactatttgtgtttctgggtcttttttcgtgtggcagcttgtcttttggactgcctctctctgtttgtatctttccagctattttttatagtctcctcctacttttggagaatagcgatatgttgttatgacatttctatttgtgactgcctttttcctctattgacttcccttcccctttctgcctttcttttgaaaatggcccatctggattaagtttctatcaagatctctttctataagcaggatttttctcaggtatgtaatggaaaccttttacttctgttgaatggtaatcctaaggggaggtcagggaatggacttttcagttaactgctcagaggcaattgtttgttttactttatataatcgaacttttataaaacttagaatattaaatccagcaaggttaaatatttagccttttgttaactttgtaaaataaaaatagaacttaaatgattcattataaagcaattatcttagaaaatgaataggtaacacattattagaatcaatttgttctcaaagctatgagaaataaaatcaataatttttagagatagataaagtgttttaggtaatgtttgggaataagaaactataagagtaggatttggctatttgcaaagtacctgacttttcccttggttcctaaagaatttcgaaacaaaatgagggcactataaggttcacaaggactgaaaactatttgatcttctcatttttggaagaaagtgagaatcgtaatatacttgcgaaacagattggattccatctggtgtagccaaattaatccttctttaatgattgtttatattgtgtatccaaaatcaaactcagtatcaagagttaattacaatttataatcattttggctcaacaaaacaagagggaattgtaaacagtaaagtttattttatagtataaacatgttaaaaacatggatcttcattggaccatatgtaaattaatcaaattatctccagtttttgttgttgttgtctgtttgtttaaacgtggtgcaggaaaaagcaatggctgctgagactgcagaggtttgtgaagaagtctgttaggttttctgaacattcctcccctccgaccaaaaaaataacccaaccggactaagacaaaaaactgagaaaaccaggatggaaatttgacagaggtgtaggaactaaacaaggaaagggaatgtttctcttctctctagtgcaggataaatttcatcagttccctgtctgaacctcattaaccttaataatacactatcaaaaagtcaactctatgcaattagtatttaaaggtacttgatattttaggtgggaaatttattttctctgaaaaatcacacatgcctccaacaacttgaagcttgctaaaatttatagcaataacattgaattcaattacattcaatcaaattccaggcatcaagtcgttattaaacatttacctctatggtcattgtgctatggttgggaataagaataatactaaggcaagatcttctcctttacaaagctctcagctgattaggaatctcataaattgtcaaatgtcactgtttcagctaacaatgtttctaccataaacagaactgactcaaaggggcaaaaagtaaataaagtacatgacatgggagcatactctcacctgagccttagagaggaaactgacatctgtcaattcacttgttctgttaattccactttgatatttcttaaatatatccactcactagggctaagccacaccataactgacttctaggcattcatctttcttccacttaaattcattctccaccttgcagctatttagttagttcttctagcaatacattggttaaaactagtcaatgacttttcatttctttcaggataaaatgcagtatagtatgcagtggtaggaaattaagcactagaatttgtgtttaaatcctaatttcctctcttatctatctctttgccctggagcaagtaattttactgctctatggttcagttattttatctgtgaaacagggataataacatcacttacttcatagggttactagtaggaaaaattagttaataccagttaagatgatttgtagagaaatggcaccttcaattaatgttaactgttactattgttgccacctctagacactcatcccttcgcactgcccttttctcatttttccctggattgttttgagtttcttagaacgtgtacatgctgttccctttgtccccatcactagactgactcctacttgactttcaggacttctgactttttcttcctccaggaatcatcttctaccactcctctgcatggcaggttagatgcccctcttaaatgcagggttaacctctatcgtacatttcacaccttgtatttacttgtttgcttccctattcttccttctacaatgcatacactttgagggcagaaactcagctctgtttgtctttgcagctctgtcacctggcacagtacctggttcattctctgcagaatgaggaaacctcaagcatccactgaagggaacagtgtagcatagctcatattaccaaatatctgcatgttagaggcttatgtgtttatgagtaggcaggtgtcttcatggaactctggtatcttccagatgttcataggtatatctggaacgatgagtatctggccaagtaatatatggaatcaggaatatgtctctcctaaagagttatattttgatcaacctcactcttactgcagtgggcaagcaggtacaacctagagttttccaaaccgttcagattatgaaacctgtcgttagtaatatattggaaaactcaattatagtgccctaaagagctataataagaaacacagtttggaaaatacaagtctgagttagtaaccaagatgtctttttttcctcttgattctaggattatttcaggaggttgtgagagacacaatgaggccttcagctctgggtagactagtttcagccggagctcttaatgggcatcaaccatcacaagttgaagccattcagggatgagaattcttttagctattagaacctgtctccatataaatatttctacctttctcctccagtggtattctctgagcagaggagatgggttgcatagtggccttaaaaggcacagccccaaatttcactggttatgtggacataatatgactttaggatttcttatcacccacttcaaaaaccccagggtcacttaattaaaatgactgattcctggagcctcaacatgtgccttctaaatcagacagtctatgaatgtgagactaaagccaaagtttgtactgagttctcctgtgactcttatgctccctcatgtttaagattctaccctgagtagaggccacttcaaaaatagaaactttttaatagttctctgtttacaaggtcaattctgttaagccataaaccatcccatttggaattagtactataattatggttcttatttcttacacacacacacacacacacacacacacaggttttttggaaaaaaaacatgttaagagaagacatttaaaagtttaaagaacttagatgttttattttgtgagaagaacaattttggggcaagtcgcttaactgtctgagccccgttgtaccatctgggaaataggaaaagtggcatctgcccttgctccgcacttgggatgggagagtcaaatgagaaagactgaaagcaggtgtaaaatctaaagtactaggaaaaacaaggtgttatgatgtcttgataaacatttggtaagataggagtcttgttacacataataacatttttctgagtaatctagtttggtttatttttctgtggggtttaagagtacattttgataactgagagtttaaaacaataatttcagatgtattaaaaattgtacgtgattattagaagtgacgaaaacttctgggattatataaaattgagttttatacaacattctctttgactctaacaagagttaaatgttaggaatcattgatgtaaactattcttaaatgattccacattccaagcaaatgctctggagaacaaataggagaatcatctgtgagattaactttttactgatgccatgtggagtaagattatcgaagcatcttacatttaagaattttacctcagacttaaatagcacgttaaataaaacaggcagaactaacaaatcctgatatcaactttaatttcaactttagctcttttacacttttataaggccctttcctcttataaatgtaaacctattttttaaatggaagctaatttgttaagtccattctatcagaggtaaattgaaaaatgccagcaggcaagataaatttgacagaaaataggtaaaatcaaagttttattcatgtacagtggttaagaatgaagatattaagataaattattttaagtgaggactgtccttttaataggcctcactctatagccttgtctcatttttcattttcacaaggttcttgatgtattcttttcattatataaaacgtgccatatttggtcttttcatgaaatgtatctgatattctcctttgacagccattcacgtgaaaagaaaaggtcctatttctgtccatcacctacatgcacatattcatagaaatcatagatttttggtaaaatatgctatatacttatacagcatcttaatctcagaaacccaaagggtttagatccataactgtaccatatttcctttctgtatgttgagagatacacatggtcaaatttcctaaaacctgaatctaactcaatctaaattatatgatttccgtttctacacagtggaacaagtgtgtgtgaaataaaatcaccagcccagaggcattcacccaaataaatcttggagattttctgcaacatttcatccctctacttctatatctaagtattgctacttctagttggatgtaaaatgcatccttctcaatttatttttgtttgtgggggatggatggaactaactgttcccccactactttataaacaaatataaaatgtggatgtgtaggtattttaaatgctaacagtagaattttagtatctagttaataaccctattggttggaatttaaatcttttcaggaggaaaaattaatcatccattatatcattcatcttgatgctgtcactttcttcttgaaatcagaaaaacatcgtagtttttacatggtagtttttccttgttggaggacagttgcattttactccacactgttaaatgcattaggccatgtaagagaaatataattctgtaattattcagaactcagttggttgtttatatggtattcagcaagatacttcccccccacctccaacttcttataacacaatttcaaagcaccaatcgtcttcctcttttaaagtaacaccatgactgattgccttaaatttatatatgatcttgttctaatgtcctttctaaaaataagaaaaaaatattccacaagtaaaacgagagtatgatagatacttcaccatggtgctggtgtatgtagacttgcgtgagggggaggacatggaatggtatgttctccattcatctctagttttatttcctagatgagttatgggtgaatactgtgacaaaaacaaaacaacaactaaaatggaaaagtcccaggagtgaacagaaaccaggacttaaactgcttcatcattattttattgtattgttttcgttttgggtttttttttttttttttttttttttttttttttaaggaagttacaacaaggagcagctaaggacagataaattggtagcagattgtggtttatgataacgacagtcccgaaggaacttggctttcttggtgacgttgaagtaaattgcattactcaagatgtatactaagaaggatagataatgaggtgtatgggggaaaggcatgatgactatttttatagtattgttgactaccaaaatgaatggaagggaaggcgggaccaggtggagttccttgggttaatttcgatgtaccttataaatgacaaaatttccacccacttctcttagagggataaaaatatttgaaagtgtctgaaacaattgccgaccactatttcaattccttttcctaacttctagtacctttgatttactctgaattcctaatttcttgttaaatgggaccatatttgtttataattcacctgggttaaaaataatgttttcttctgagaagaggaaagaggaagggagtgctctagcttcttcatccagaaacagactcttatgtaaaacccccaggagattctataagatatcagggaagattcacctaaagattaggaccctttgagcctgacaaatctcctgttgaatgccttgctttcaaccaaagctgagataaaaagtgcgcgcatgtgcacacatgctcaaatacacaggcagaaagctctcagctacaagacctgcttccgtagtttacagagcacctgtagcccatttcccctgtgttttttaggcaaatctttgttatcatggtgtatgacagccacatataatctgagtaccacttcctcccttcttaattttccaccatttatgccaattagaagcaaaataaaagggatgatttctggtcacttaaaatcggggtgaagcaaggatggaggttgtcctgcaaaggcattttaattctaaagaaaaaggagattagtggcctctacccatcttagagaatagagtgtcctgacaccttcccttcctccttgctcagtattctccctctccctagtgccacattgagaggagattcactcctaaaagagtgtgtcattttaagttgactttcttggagctgagctaagagccattgccaaggccagtgggcgtaaattcagtccgcctgacgggagatgaagggttgtgggatttatgacttatttgagttctcatatatcaccctctgtgtcgctcgcttatgatggccctgccaaaagataaagaagtgtaggacgctggtacgggctgtggtgacaggccagggacaaatgtctctgttgggtaaattgatttgaatgactctagtgaaatatcaggttaggctgaaaatatgattgggtttaatgatcctgctgactttgtagactgttgggattccaaatcctggacaagttaattaaggcattctatgaagggggtgtgtatgaatatttgtaaatccatgtaattattaatgtcaataaataccaccatgtaaaaactcagacctgttctttcacataatatattgaatgtccattgaatacagggaacattacttacaatttatagagtatttatctgggaaaaactgttgagaacgttattttttctccacatcccagagtcaacaagcagagaccgaaaggcataaaaatgtggaatgaaaagatagagaagagataagcagtttattctctcctggcaaaatttagtagccttacccttaatagtggagaagaaatttttatgtgaaattggggttgttttaggccactaacccaaagatcaaatggattgctttttcaattacaaaaacacatatattgttaccttattttttgaatgtggctattcagttaaaaataatagagtttagatttctttgtaggaccaaaattttttcagcaggtttctgtttttccacttaaaattgcttccaaatttctgagtttacttctaataatgggtatgctctccttgctatttttatctctaggtaattgttgactgcttgtagttttttcttgttgggcatgaatgactggcttcatcttccaaaagtgttacaaaacaccagttatttctttgagctttagacttttcctttgcagaaaggagccttatttacatccaaatgaattcccaggagagttttccactgatgccgactggttaacagaagtacaggcgagcaggaatccctcgctacctggcctttcgttccctggttccatctggatctctgggaaaattttccatctttatttgccataaagtatgatttatttatttcaacgagtggctaagagccctggaatgccatctttaatgagtgtagggaggatggtaaattgggtttagagaagaatattgttaaatatgttcaacttttagaacccaaacaaaaacacaaccagtgtcagtgtttgagagtgctgtactcatctgtgaacgtaacagagaggaaaggtgtctccgaaagaactcttcattcttaggagaggccccagaataatcacaaaacttggaactgtatctatggaatatagaggtttccttgtcttggagtggattcttagagtaaaacatgcctatatccttctgttcttttatcaacttcaactgactgtgaatgatgtactcactgagaaaaatccatttgctcaggtctaattttaggtaatttctctttctgtatgttaatggaacccataactgttttgcctactggtttccaactgaggattaatataacagtttccactcaacaattgtattgcttttttatcccccttatttccttttctttcttcatatgagaatattgagaataagagagattaggaaatttacactgcttctgagggacaaggcagcttttggacccaattatgcatgcctctgaaacacatgttctgcaccacaccattttttctgttatgtttgagagataaaaagttgtccgtctgtctacctctccaggctaatgtctcaccacattcaatcaaacttctccttccccaggccaggattcatgcagtccctacctgtaatgtgctttttcatattcttttttattttaaatagagacagggtcttgctctgttgcccaggctagagtgcggtggtgcagtcatacttcactttaatctcaaactagactcctgggctcaagcaatcctctcatttcggccttccaagtagctaggactataggtgcatgccaccatatctggctaaatatatattttgtgtgtgtactttttgtagagacaggatcttgctaggttgcccaggctggtctcaaactactgacctcaaatgatcttcctgcctcagcctcccaaagtgctatgattataggcctgagccatcttttcattatctttcttcagatctcaaattatttgtcactcactggaagtgtacagctaatctgaagtggccttccacagttcccatctcgctcattacctggataatttcctttatagcaatgaccacattttggtattgttttggatattggttaccttgttaaatgcctgtctgtcttatctcctccaaccaaaagtaaactctctaagatcaggaatcctgcctaagtttttggcctgcatatcatcagtgtcctgcatatagcaggcccaatagttgttctaaaaattaatgtatacctgaatgaataaaagctcttagagtgacagaaatgtaaacaaatacttctaacgctaagaaaagtttgttacatgttctaacaaagatttaaccaaaatgttgtggctacaaagaaaaagatgggtgaagaagaatggacaaacactaggggaacatgagaaagttcctggaagaatattgtcatatatgaattgagactggtgcatggtacaatttcatatataaagatagtggggaaagcattcttggaaaagtctcttgttgtgaggcattacccagagttctttgtcttaaaaccaagagaattaaggagcatggacagaaagggtgaggttggagtgaaagtttaataagtgaagaaagaaagctttccaccacagagaggggtcccggaagagggttgccatttttacagttgaatgcaaaagaaactgatgagggctgggtgtctcatgtgcataaggtgtgaatttctggtagctccaccttgtcctcctaatgcgcatgtgggctcttagcttgagttactccatattgctttgttccccttactgcacatgtgttgaggtggaatttttcattgcaggcatgtctgggcaagtcacctgtttagcctttcttatctgtgtggctgtgggcatgtcctagttaggcaagtcccattttccaagttcccttatctgtgcctgcaggctgttctttcctttgagagaattcagccaaggacccaccctaactgcctgcctgaccactttcttcctttctcctctctcataatgatgtaacagtaaaaatacctgagttcaaatcctgatttttccttttaatagctgttgactttgggctatgtgcttaaaaaacattttttgcagagctttctcaatacttggcacattattgtcactgtttctccctggatcttagttttttgggttgctaagtgagcataataatccatagttcagaaatttttgtgaaataatgtatgtcaaagagcatggtttttagcaggtactttcattcatagagatagtagctgagtttaggtgacccgttaaatttgggaaaggattatttaaagtcaaggagcagatccattatgacaccataattagaatggataaccacatccgcagaaagtgcgctgcactatgagtaaatgtaattttgttcgtaaagtgctgggcctagggttaggggagataagttcttaatatgtcttaatatagccttgggttctgggatatgctaaaaaattattcaactcattagtgtctcagtatccttgtgcttaaaattattattataaaaatacctgaatgtgaacttaacctcttcttgagagtttcagtaaggaaagtgaggctcacttctttctggaacattaaacttaagcaggaaggtgccacatgaagtattatatcataatggaagcaatgtaaaaagaagagtgagtcacttcatcaacttcacaatgcaaaggtgctaccataagtcataattctaatacaaagatttatataaataatgattctgggattagccagatctcctaatgttctagggtttgtcatcatgaattgtggtatcacttagtaagtacatacttaaagagaagaataggaggggagggaatgttagaagaatagtgaacaactaaaaaaatgtgagagatagcctggagagaaaagcaaaaggacaaggcaacacaggaaaaagcaaagtggagaaacagatatgcctagcaagaggaaaccaaagttagcccggtagggtattgttgcaaaaggaaagccggccttgtcatttatctaaccaaacattccactcctcagtgatggggtagctgctctttgaaagacaagcaactgtgatggggacctgtcagtcttccttacatgcagctggttctctaaatattccaacgattcctatcattttctgtaggagtacctgcaaaactggaaggctaggctgatggctttttctccattaagcagtaaacacgttaagcaagcttgagccaggttctggaggaggtcatcttgcaaggataaaaaacattgcatttattggatgaatacttaatgcacggtttgccttatccctaccttagagatgagaaaactgaggctaagactagctaagtaatttacccatgtttgcatggcttgctgatgatggatccggatttgaattccattttgtctgactccataaatcatactcatgctagtacactgccctggcctggatgggccattttacattgtgtttttcttttatagacattaatatgtgtaataaatagaatgggagtatgtattattaaatgttaattttgaaatataagattgttttcagatggaatatccttttcattctttatgatccttaatgctgatttgaaaattagaataggaaaggtatggcaagtgtgtatttgtgatgggagtagctaacactgctcactttaacagtaaagctctgccatctgggttattgcaaattcttgtaaattggtatggcctgtcctgctgtcctggaaagggagcaactagcacaagagaaaccaatcaaaatgcagcaaaaggattttttttttttggtaagattttgcttaattatcactgcagtagaatggctagccaaagtcagaaatcttttatttctgctcagtgagcagcccaataaagcttcagaacatacagcacaaacaaatgccatttcatttttctttacttcttaaaaaaagttaatcaggaatttgttagaataatcctgtgttaaatcaagcagccagacaatgaaataggaattaaagaaaatgaaagtggtgggaattatagaaatattaaattatttcaaaaaccctaccaagtgaattggttaataagcatgtacaatttattgccctatgggtcctctttttacaggcatctttatggttcatcagtttgctcccatctacaccacctgcctataattcttgacaaaagtctgttttagatactgaaagtatccactagatttgagaacaaagcaaccctgtagcgtgagcccagagtccagaaggatgtgggtggaggcggatcaggatccaagattttagcaaaagatggcttgcttaagtgaagcagtttgcactctgcctctttattcagttaggcctggtgtcccttccagcaagaaaagcaactggaggtcctgaaattgcacactcacccaatttccccaaattctttacttctgaggactattgaatcacagagatacagcagtagacttcatgaagttcatctagcacctaggatcttgggatctatggcccgggacagctcctgctgtacaggtcttgggtaggctgccatcctctaggtggtggcggcagtgtggcttgtggttctttttgagtgtacactggctgccttacttgcgagaatctagttctatcaagtgtcagttaaaggccgtttttgtctctgattgcataacagggtatgtttgagagagacatcgctgagagaaattcaaagctaccatgtgaagatcctttcctgaatatagtgtggctacctcagatcaggattctcaagcttggcagttttgacattttggactggattcttttttgatgtggggaaactacctgtgcactgaaggatgctttgcagcatctgaggatgacccactagatattagtagcacctttctcccatggtaacaaacaaaaatgtctccagacatttccacatgtcttctgtagggcaaaatcccactggctaaaagccagtgatggagtttgtactctttgaaataagaccactgactttttgtcttccacctaattacgctcagtaagataaggccttcttttgaggtagactttcaacatctatctctgattctttttgagaaaacacgttgcattttaatcttttagtgaccgattgtccccaaatgtaaaatagaaagttgagggaggcagtagttatatgcacatattttttgagccagagttccctgagtttgagttaaggtgtcctgagttttgagttaaagttccctgagtttgctaccaattagctatgaaacctgggccgagttaaaagttagacctttacagtcttaagtctccctttttcatgtgtaagacaagggagaataatgattgtacctttttcataggttttgatgatggttaaatgagttgaagtagtgaaagctcatagcacaatggctggcccatgttgaatgcctaatgaatgtttgctataattactactgttgatgataatacttttgaaaacatagttgacttgttataattaagccagtgtttacatctgctttaccaaatacttcccatggtttttatctcagaaaatagactcaaaagtgaacacacacacacacacacacacacatatataccacacatatgtacaacctgcatcgtctaataagctcagtggttccatatactatatctttggccaaatccggggctttctgattagcacctctagttttttttttttttttcttcccactcctgctataaccattctcagcattttcttccagttttttccttctagaactactgccaggtgaactacaaattattttcttgatttgcagcccatgcaccaatgagaaaatgcctatggtgtcttttgattttatggttcattgcttaggccttgtcataaaaaccatggcgtctcttaaaagaaaatataaaacaaaaacaactttctcttggccagagtttatcaaacctatgcccataatggcatagaaatataggaaatgagacaatcctactcccccaatccccgttttctgtttatttgtttgattcctgccaaagcaaagtgaccttgagggggcaccggctcagtgtttgctttttctggcgctacccacacccctccttcttcatctcctactgctccccattcagctcctcaacaatcggcaatcactctgcccttctgctccaaatttatgaccgggagcaagccataaacagagaaggccaatcctgatcctaggcactgcaccttcctgtttgccagaggtatgacagcttgatgggactgtaaagaataagcctgcatccccacaagccgcatgaatcatgtcctaggataatgactagcaaaggctgctgcagagactgcaggtgactcagagccctgaggcagggctttccctaaaccacctagaacaaagggttcccatggatgttctctctgtggcgtcatctcacaaatgagaagacctcacccactctctgatctataaaagcagcctttttattctgtgatccatgtgaaatggcaaagatcactccagcttattgatgctcagagaattatgaaggtgccacctgaatgatactcctataggaaatatttggtgaacaagataacgttttttcatggatactatttgcctcctccagttgccgcttggtgtgtatattattcgccagtgattgataatgcctcgggaccacctagtgatcttgttcagtttctaatttagttgatctgaggtggggcctgagaatttgcatattttaaaaactcccaagtgatgctgatgcaaaacagctagaagagaataataattcaaataaatgttcctggtgtaaaggaaagataaatatttcaggtgatggatatcctaattaccctgatgtgattgtatgaatgtatcaaattattccaggtaccctgaaaatatgtatatctaatgggtaccaaaaacaataaataaataataaaaatctgctttcaccaactgatctaggtttaagcaatggagtaacatgacaccagtataacaccttttgcatttctgaaagcttccttcccctcctctttcccctcccctcctctcctttcctttccttctagatctgacagtagtagctgcagcttatgctttagatttgagatacacagttgggatctatgatggtccctgagaaaggacaatgagtagaagaagcaaggtgcagagaggatctaacaatttttgcatggacatgagatttggagcaaggtctagaagctcatatcagcaaggagtaagtatgcttgtggcttaaagattatggtcttcaagacttgctcctggactggaaatattcccctaattttttgcctaaatgaaatgtgctacaggcctgagtatacctaaatcagcttcatttttctgtcaaatccctccctgtatgcttcttccagtgatatgtcatgcagatgtccacaggggacataggatcttgtagtgcaaaaaacatgagactttcatcagacaatcagtcttgactctcagactcactgttgattctatgacctagctcaagctacttaactctctaaggttaaatatcctcctctataaaaacctgatagtatgtactaaagagggtatttttgaaaattacatgagataaaacagcctagaatgctatctgatgcaatagtcatccagtaaattttaatatcattctactttgaaccaggttgtttatattaaatttaacagaattaagcaacatacagtagcgatttattctgtgggctctggagtctgcctgtaagggtttgagctctagctcagcgacttctttactgtgtgaacattgatatgtttactttaatctctctaggccttagttttctggattttgaggcttaaatgagttattacttgtaaaacacttaggagagtctctgctatgtaataagtgttcccaatatatagattttatttcatctagttgaatttagagagtagcaagccactcccttcccgccccacccccgaaaaaaaaaaaaaacacaccaccaccaacaacccacttttagtgtggcaccatatctaagaaggtattctccaagacttctttatgtgaagtagttcagccttggcagagttaaaagttttcagttataatcttgacaaaaattaattgggatgtatcatcaatctagacaatagctaaaattataaagcttctaggagaaaacatgggaaaatatctttgaaagtgtgaaataggcaacaatattttagaatacaaaagcactaagtatataaaagaaagtatcaatagattcaacttaatgaaaacaaaaattcagctcatcaaaatatatacctaagaaaattaaagggtaaattttaaaatttttgttccccagacatagactgggagaaaatattttcaggatatatatctaaaaaaggacctgtattcacaacatatgaggatctcctgcaaatcaaaaataaacacaaacaataaaaataggcactttataaaaaagatacgtgaatggtcaatagtcccatgcaaagatattccacatctttagtaatcaagaaattgtatattaaaatcacagtgatgtatcattttataccaactaaaatagttaaaatttaaaagacggacaacaccaaatattggtgagcattagaactactgaaattgtcatactttgcacatgggaatgtaagatgataaaaccactttggaaaaattgcagtttttaatatagttaaacataaatctaaactaagacttcgtaagtttacttttacatatttatccaaaagaaatggaaacatatatacacaatgacataaaaatgttcacattagctctttaatagtctcaaaatgaaaacaagacaggtatccatcaagagtatggataaacaaaacacagtatattcctatgatggaatactaatattcaataaaaataataaactacaagtaaatgcaacaacatgtatgcatctcaaatacagtatatttttgtggagagaaagacaccaaagagtacatactatataatttcatttatatgaagttcaaaactaggcaaaattaacctgtgttattacagaaaacaatactaattgcctatgagtattggcaggaaggggcatgagagagctttgtgggatggcagaaatgctctacattctgatgggagtgttggtttcaggggtacattgatttgttaaaactcatccagttgtatataggcattccttggagatattacaagtttggctccagaccccataataaagaaaatatctcaataaattgattgacaccgattggcacacagctttatttcccagtgcatataaaagttatgttgacactattctgtagtcttttaagtgtgcaatagcattaagtctaaaaaagcaacatgcacaccttaatttaaaagtactttattgctaaaaaatgcgaatgattatctgaggcttcagtgagtctttttttttttttattttttgctggtggagggagggtcttgcttggatgttcacagctgctgactgatcagggtggtggctgctgaaggttggggtggctatggcaatttcttaaaataggccgggcgcggtggctcacgcctggaatcccagcactttgggaggccgagacgggcggatcacgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaaaaaaaaaaaaaaaaaaaaaaaataataataataataataataatatgatggggtgtgctgcattgactgattcttctgtttacaaagaaagatttatctgtactatgtgatgctgtttgatagcattttacccaaagcaaaattttcaaaattggagctaatcctgttaagcccagcagctgcttcatcaactaactttatataatattctaaattatttgttgttatttctagaatgttcacagaatcttcaccaggaataaattccatctcaagaaaccactttctttgcttatcatacgaagcaactcctcattcattcatgttgtatcatgagattacagtaattcagtcacattttctcctgtacttctgttctagttctcttgctatttccaccacatctgcagttacttcctatgccaaagtcttgaaccccataaagccatctacgggggttgacatcaacttcttccaaactcccgtgaatgttgatattctgaccttctcccatgtatcatgaatgctcttaatggcatttaaaatgatgaatccttttcagaaggtttttaatttactttgcccatatccaacagaggaatcactacctatattagctatagccttacaaaatgtatttcttcaataagacttgaaaggtgaaattactcctcgatcccttcaatttgtaaaaaatacaatatatataaagcacgatgaaatgaagtgcaataagatgagatatacctatacctaaaatcatgggctccactctgtataaattgtaccacaatttaaaaatgtatatcatatatatatttaaatattataataaaactaattttgaattattcttgattctaggcagtctctctgcaggagtctcactctgtttgttagactcttttcttccaccagaatttctgtcctgcagctcaccattatctagaaaactgagaaacaggaatatcataacagtaaacaaaagtcacttagttgattacatgcatctctcaaaagcctgtaccttctgctatgattagattattccagaagcctcttctggaggaatctcttacatttgcccttcatctatgggattctgcactttcgcctttctgtttctgtgttgtcctgagatatctcatgtagaaatgaattgatggccctttatactgcggttggactcttcattcagattttttcaaagcacattataaactctaattcattaacgtcatcataaatggtaatgtcctgtgaaaaagagaggtggtggcaccaattaaaataatcttcttgtagtcacacatcaaatcaatgtcagtgcaaacacttgaaccaccagttaatgcagccccatttctttttatattgacaacagcacagtggttgaagctgaaatagaacctcagttcatacttatagaatatgccatgctgcacttaacacatggatctacagggagaaggaaacagaagtgaacatggactagatgagaatctgatggacgatatgtaccacgtgctttgaaatagccataaggatgtctgcacaagaatatccatgcattcgttcttagaatttcagggccggttgtagctcagtcattttgccattgacttaattgaaatccaaatcaatgcagacacttgctcaaggtcacatagcttgttctctcccagctcccctgactgccggcctcaagcccctgcctccacagactgtgggctacagattccccaagagatttccttattccctggattctcctaagtttgcataacagaagtacttaaatgcatcacttcatttgggtatgggattttaaataaataatatgatacaaattctctcacactgcagagagtctaataatagcttacagtaatagaatgaacactctgtgcccagaactcctttgaatattttacataacattaacttaatcttcacaatatcctatgaggggatactattgttatcctcattttattgctgtggatgctgacacatagggaggtttaaaaccctgccccacataatgcagtttgctagtgatagagccagaatcagaatgttgaaggttggttctagcagccacacagtaattgctctgacctatctcctttctacaggaaatggggtagaggagattcgtttcctctgaaaaaaaaatagctaaaacctcaatgatgaaaacctatgagtgactaatgagtatgacagctaatactaaatggacaattgtcactgtgctaagtggtttatttcatttgaattatcacaactcaacaaaaaaaagttattttcatctttctcttatacataaagaaactgaggcaggcggtgttaaaggaacatgcctttagccgcacaggtggaaaagagcatgaacccagacaggctggctccagggactgcggcaatgttgtaataaaatggcatttgttcagtccagttttaattgatgagatactaaacagagtcggcactaaagaaaatttccttggagaaacatttatgcttagctatttcagagctggaaagtccctttggtttgatataaacggccttcatttttatggagctggcatcaaactgattttagaaagaactggcctttctccaagttagccctggtcagaggaacctaacacatttctcagtttaaactagtaattctcaaggaagggcaaggtttggagagagagcagtgcaccgctaagggaggtatcagtacctggaagaggggaagcaaatacatgttctgaaaacaaaacattgctggaagacggatatcgaacttgacctaagattttcttttccatctcccctggctaagatgaacaagtttgcattgggcaagtagagtcagcatttacactggtatcttgtgcttggagtgaaaagcaaaatgaaacaaaaagaggtttctttttctaaaattgttttggttttgatttgcgtttagtcataattcttaatttatgtaatttttaacatttcataagacagcatgaggattttgtttttgaggaacatccattttaagtttgaagaaaatccatttaaatgcagttgggcagagctgccacatgcctatcccatccctgttctgatggtggccctaagacgtttcgaagagcttggattctacttatccaaaactaattctgtacatttacgggatcatcagaatcatgaaaaatgtttctagggattctaggtttttagtagagagagaaaatgatttctaggataaaattcagataagccttgagctaggaaactcatagttcatgttgttacaaagaactaaagctgatttttcagagtaccagcttctcagaggacctgagacttgcggatctcatttacagattccaaaacccctcgcagttacactggactgatttttggcttggaaagagcagtgggatacatcctgcactagcccttgtcctgatggattgagacacaaagcttggcctgagcctctgtgtcaccagtgttagagatgatctttgtttctcctgcagggagctttctcactgccaaatggcgtggggctttcctagctttaagatgaaacaaagagaatgcattctcccatagtcttgtctcatagactcccatctcatgaggaattatctcaagtaagtatcactttctaaacaggttgcaaaaatccattagacaggtaggattcacctcgcctgcccattagggatcagaggctgcctgctgagagcccatatctgcagtgttttctgggtttccttttttgcaatggctctcataccctgatgtcacttgtttggtgtgcatgattgtgcttagccaaaaagaatgtgcagtagtcacttggcctttaagtagcaggtagtgaaagacagcagggagagtgtaacgaatcttattctttcagaaaatactaagattattttatttcatgtttcactctcatcaactatttaattacattcattcattcattgatttaaaactcatcatgttgccactatttgcctgttctatgctagcactggagatctatggatgaagaagacaaacaaggatgctattctcatgtgcattacatttaattgtggataggaaattaaagcaactaaactcactgagaatcagagctaacatttgcccagcacttagtacatggcaggtgcagttttacagcttgatgtatgttaactcatttaattcttctaataagcctataaggcataagctattatctgcttttagagataagaaaatgaaggactagagactttagttaactttcctagggtcacacaggtaggaagtgacagagctgggatttgatccagggctccctggctccaaagctcttgcttttagccatgatactataatgcattgaataatgggcgatatctacctttccttgatggtcaggaagaaaggtcaaaagaaaggttgttagagctaaaatctgaaagaggagaaaagtttttcagataaagagagtgtgcgtgtgtattttgtatgtgagtattgtgcgtgttctatgtgtgctgtatgccgtgtgtgtgtgttgtgtgtgtgtgtattgtgttgggatagagcagcaacacaacagtgtccctagcggaagaagtaatgtctgtgatggtaagggaaaagagggtgaaagtgagaaaagagtgagagagaggctcggacaacttaaacaactggaaggccagcaggataatggttatggtagaggtggagagaaatatgaagttggaatgggatgggatcagggacacatcatgccaagtcttctatgccacattgggaatggaaagtcatgaaaagattttaagctggagagttacctaatttatcatagattttaaaaagattcctcttgcagctgggtcttaagaattagtggctcttcattgatgagttcatgtcctttgtagtgacatggatgaagctggaaaccatcattctcagcaaactatcgcaaggacaaaaaaccaaacaccgcatgttctcactcataggtaggaattgaacaatgaaaacacatggacacaggaaggggaacatcacacaccggggcctgttgtggggtggggggaggggagagggatagcattaggagatatatctaatgttaaatgatgagttaatgggtgcagcacaccaacatgccacatgtatacatatgtaagaaacctgcacgttatgcacatgtaccctaaaacttaaagtatataaaagaaaaaaagaattagtggctcttgcagttgttcaggcaagagatgaaggaggcttgcccttggatgaatggcaagattctgtgtgtggtatgaaagtctagagcttccttgatgaccatctcctaccccatgcatttacagctttctctccttagaaaaggatttttgacataagcaaaaacttttcacaaaaatttgtgtgaaatcttatttggggatttgctctctgtgcaaggagtcctactccagcaggtttcccagtcaaaatatgcctttgggaatgcagagaactgaaggccctggctgagcaaaccccagctggagagacagactggggattctatctgtgtatagcatgaagaatttattctaaacacttggatatagagccaatgccacttacaagctttcctttaagaatcctaggccagttgttaacagtttttaatctccttaatttctttatccatagatacctgacaggaacagtttggactgtggaaagacaataatggtccctttctgaaacagtctcctacttgctgaaggctactggaatagaagagaaaatatagtattttctgaaaatgtaaacagatgttagtttaccatttgtgagctgcagggttcagttaaagtggatgttgtatgtaaatacagtggtagcttgggagctgcagatgtctctaataagcattcccaagtgcactgtgttccattagtatgtgggattccactaccctaatcccactactgtggcttactctgggctccttctgtttctattcctgcaggacacataaagacaccttaggcgttagctgtctctatgtttccattccaccaaatcggaacttcatgactttttcaccttctctctcagtcataagaagacggctttttaaaggatgccaagacaggtggatcatggtaatagtatactccattatagcagttgttattcattgaacacctactgtttgtcaggattgggcaagtggcagtatacatcatcttatttagtctgcacagcaggtttaaagggagataatattactccgactgtacaggtgaataaatggaagttaaaataatctcggcttggtagtgatggaatcaaatgatgtaattgcctcattgtgaccagctaagggcaattctgttaggatctgtgtaacacattttaagagaaacattggcaaatgaagaaaggttagaggaaaacatctaaggtcatttaagtatacctatatacatttctctcatatgatatgacaggcttgaaaaattacacagctcattacgagcaagagagcagtatatatatattaacattctaatcttaataggaaaaactaaaggatgctgtgggaataaatggaaggatcatcatacctagccaagaaaatgataacttaggtcctggataaataaattttaagtagggaaaggtgggctggagttaggagcattctaaactcaatgaacaacatgcacatgcacttggagacagtgcaggtcaatttaggagctcacaggccatttagagtgacagaagcagagtgtgcaggtcaggcagtaataagacatgaggctggagaaatgagtaggaagcagatcaaaggccttgaaatgtcaagaactttgtaccttatgggtactgaagaagtgaaatgtttaaagaagccgaattatatgatttcttttgacttcaaaatggaaaatacatgtcgatattgggggagaaattaggaggttcttgccataatacaggtggcaaatgatggtagtcttcaggtaatggcagtaggaatgcatagaagaacacagatatgaaagattcttagtctggcagacacctggaagcaagggtgcataggaatagctaacagttaaaaaagtatttggagagctatcatgtgaaacagagagatgatttattttttctgttcatttactgagggcatagtaaggactaattggagaaagtcatagggaaacatattttaatttcaataaaatctgatgctccaaaaattgaaaacataacttaccattcatctctgaatgtatccgtgcattttttttttcattcaagttacatttttaaatgatgtgcaagttctatagactgggtaacagtgtacataacacttaacaactaactaaaatcagtgaaacacatatcaatataaacaaagagctatggaaattaatcctgtccggggttcagaggagttattaattaagatggtaaaactagctgaagggataattagagggaagagttgtgtggggtctgcaggatctacaagtggaattgcccacagaacctttagatcttatgaatctagagcttagaaaatagtcagggctggtgaagtatactggggaattttcagtgtaagcaaagaccatcaaagcaaatgtctctgaagaataagcaagtaatacaaataagtgagatggacaaggcataaggcaataagtactgggactatggaaaattggcaagcaggtgccccttccaaatggcaccactgccagtcagctccagtaaattgttgctctgtgctctcagatctccacagtttctaaataaaaacaaaacattggatatttatgtgatgcttctagttaatatgatatctcacagcatgtccttgatctaactatagcccaaaggctgtcagattgccttgtatgttataagatgattgttgaagctgtgagtaagactgaaattttctcaagcgagtagaccactggaatgtatacatgggtaatctttctcaagtgggtaaccaaatgttatttggtatgtaaacttttctatttccacatctgaggattcatgctgctataagtgatgtctgagaaagtcatgcagcacattagccagcaaggcataaaaggcaaagagagagataagaaagatgatgttaatctagagcctaatgaaaatgtgggagttcataaggagtgatcaaatacgtaaggtgataattgtggatatgtttcgatatcagaaaacattgcttttctgtgtgatagtgctttctttataattaatgtggatttagtgtgtgttatttttagccttttaatccctataaatgtgccacttcatattctacgactgaaaatggcactataaacaaaatggtttaggaaccagtgtagagagcaggagccaaagatggaatccagagtcacagcatgagggatgagtaaggaagatgactaaactggtagattttagaatgagctatagcagtatcaccaaaaccaagagtggagagaacttcaagaggaaagacacatttggaccttttaggtaactgaaaaatggcaagtccattgggtttaaaaggtaaaggcttctggtgacctctgagagggcactctaaggggagagttggcaagaatccagtttgcactgcactgggcagtgaacgggaggtcagtgagtggagtgattgccaactgctccttgggcaagtttggcaggaaagggaaggagagatgtggtgccattccaaggatgagacgaggttaaaaaaaaggctttactcattttttttctagtggagtagaatttataatatattaagactaggagtgataattgatgaagcaaggtacggaatgaggcataaaatggagagatcagagttagagcaattgataattatttttctttcagacaggttaaaaatatgaatctttggatgtaaccgagaggaaaattgagggagcttatgcctgatgcctctacattttctctaaagtaggagatgcgggaaggggtcagtagagagttgtgggctggaaaaaaaaagtttggaggagctgctgtagggaatttaacaggggtgattaaaaggattgctgaggttcaaactgaggttggaaaccattaagcagcaatgatcagtacagttgtgagcatttctccaacagtatcaggaagtccaggaacaggaaggggaaaaaagagggtctgtgttgctccaggtttttagaataacaaaccaaattcagcagaagatcaaagtgaaacagacaagcagtatgtaagtggagaaatagacaatggaacacaggcttgagaaggacataaaaggagtcaggagaagactgattttctgagagcaaagagaatccctgagatatatatatatatttttaatattagaatgagagattcttgcactgggtaggactttgacctgagtgaactttgaggttcctcctaattccaagattctttgattctagacatgagaaaacaaagctagtccctatgctgttgtcataactgtcatggtatgtgatatggtttaactctgtgtccccacccaaatctcatctcaaattgaaattcctacatgtcaagggagggacctgtagtccgcaagtgttgagggagggaggtgatcggatcatgagggcggttctctccatgctgttctcatgatagtgagttctcaggagatctgatggttttatgaacgtgtggcatttcccctgcttacacttctctctcctgctaccatgtgagaaggtccaagattgctttccattcaccttacgccgtgattgtaactttcctgaggcttccccagccatgtggatctgtgagtcaattaaacctttttcttttataaattacccagtttcaggtagtatcttcatagcagtgtgaaaatgaactaatacagtatgtaaaaatggaagtcctgtatatacctgtctctctcaggattggcctcaaggaaccttaccaagtagatgacatttctcacttgttcctctcacttgttcctctcacttcctgttgtagtatcatcttctatttattctccttatcaccagcagatcaaaacaatgagggcattgatctatcataagaaggctgccttcaggccctattctttttttttttttttttttttttttgagatggagtctcactctgtcgcccaggctggagtacagtggcaccatctcggctcactgcaagctccgcctcccgggttcatgccattctcctgcctcagcctcccaagtagctgagactacaggcgcccgccaccacacccagctaattttttgtatttttagtagagacggggtttcaccgtgttagccaggatggtctcgatctcctgacctcgtgatcccccagccttgacctcccaaagtgctgggattacaggcatgagccaccgcgcctggcctcaggccctattctaataaaacttccaggtagatgcttgttctccttctctgtgagtccaaacaaggtctctagttattgattctcatgttattgcagcttctacaaatttcaccctcaagtcagctttttggcttttctgactcaagtcacaagataaccatccttttgtttcatttttgtaaattctcataaccccaactggatggtagatgaatatgaggaagaggggaaatcaaaagaatgagagcaatgagcctattactcttgagatgaacagagggagagattcaacaccaaatgcgtccctcttctgaatcccatctctcgaatcagacagcacttctgtgtacttcccaatatccatacaaataccaggaaacttattttacttgcctctggccttggtttgcaggtttggggaaacacaggagtcaaacagaatttttttgggtgaacccacagatttcactctgaggaacagctcccttgctgttgagacagctgggtgcactaagcaacacatttgaaatatgcctcagactttgtggaaccaggtagtctgaaatcttgccaggactttagtgcctcttgggatacttctgaggtagggcaaagtcccattcaatgttctgttggaggagagaatctttagtgaaatctcaagaatgaaagccaagaagccttaagataagagcgagagattcaacagcaagtactatctgtaagaactttgatttcattgcatttaagcttcttttcctagtggactgtttttagttgaatacttcttgaggataagtgttgtgtcttctatacttatatctgcagcttagcacagttcctgccctatggtacatgttccttatatgtacatggaaattagccaaatgtcaggatgccactttttcatctccatctctattcctatgatggatgactggtaaatacttctctgactatgtatgtgtagttcaaatactctagtttttttttagcataaagtgctgtgaaatcccaccatcaaaagagccaaagtaatatgatgaaaagaatttggtttcagaattaaaaagaaagcacacatttttgagttctcgctcaaaaacaattttgtgagggtaagttatttaacttctccgtgtctcagcttcctataaaactagaattatgagatctctcttataggtttgaaataggatgaaaattcctccctctttttttttcttataacctctctcaaaaccttgcctgtgtctctatgagtgtgttgtgttacagttactgctataatttctctactagattagggtggagaagttcccatggctgttcgctctctcagaggaccctgggcaaagttggtgctcactgtgcatcactgattatatcaaatactgtgtggcatgctcaggccttgttggtctctctgtaccagtgtctatcgtgggacataataattcatgatgaacagtcaggcatctacttagtggcttatacgtagaagtggctctcctttcagaagccagaaattaataaatggtctacagtcagaaggagatccttaattgattaattaattcaataagaatttattaagtaccttctatgtgctaaacactggggagacaacagtgcataaagagatcccatctttgttcatatgaaactatattctagaggaagagacacacactaattgaatactctcacaagcaaaagtacttttgtaatggtaattcatgctacaaagctgtagaccttggtgctatctgatacagagatctgatggaatcagaaagttcaggaagagatcgtctgagagttcctggctagagataggaaggaggggcagagttaaccaggaaggggaggcaaaagtatcacagtcacagagaacagtgtgcaaagcacccatggcaagggggaatgtgataagggtgtgtagtgaatgaagccatagtgactggaatataggggacaagattgaaagtaaaacttacaaggacgaccattgcttgggagtttgggttttattagcactgcagtggaatgctgtgaaacaatgaactggcattgtagaagctggcatagcctgcttttttgaggacatccaacacccatgacaaggtctacggcatcaaggattaccttggtttgtctttgctaaccaaactgggttatacacaagttacgagttgtccttgtcccaactcacaccctcaccattggagaagaatgtggagtgcccctccccatcccggcccatcccttatgtcggtggactaacgcagcatgcctaatgccagagtgggcagaaagaataatagctgttgtttcagtttacctgtactaatttatcacaccttacccagagactccagctccactttctgagttttctctgtctggaggtgaaacacacaagcacataaataagtaggaagctgttaggaaatcctctttgtcactactgaagcatgttcatttatttagtaaaacgtccataatttttaaattgctttatttagccactggctatttggtatcttcaaggggtccccattaggagctgtacttccccattacctgcaaaaacaaggcaggcttttgatccctggaattaattacatgcaaagattttcattgcttggagcagcaagcagctggttcctacgggacccaggctgaactctcttgccaatttccctctcatgcttgtccctccctccacacctacaccctttctttctttcattatgctcaatgggttcaatctaatgagggaaattgtaattaaacatttacaaggttccagttttctctatgactgcccttaagactgtgaacattcacagttcactctttttccaaatacagcacaatggcaaagtttccaggaatgtccttactgactcaggccccccagaatggtattaatccatttgaaaacaacttcacttgagttattagagctggggcaaaagcagggagggagagatctactcgttagggatgagggagcaagagcaatgatgactagcttttgtcaggacacaaagtgcgtctctggtgcttgtgcagatcagttgacaatggtttatagcttttctaccttcctccctttcctattaattattcatacttctcctaccaagagaggggtcttgttttccttttaggtgtaattagagtaatcaaagggtttgtaacactcatgtgttttatttctcattctctattcaattttgtttttcatgcaagagaaaaatataaaacacgaaacaaaaaccccaagtctctgggtgttgtgaattcttgcagggaaaattggttttaccatattagcaattggcagcaataattctgaggtgaaaaacctgaaattactcccttaaaggcagtaatttgtatagtatgtattttgagaaagggggggaggagtaggtgataatttaggtgaatgttagcagtttatctttatattttgtgataaacgaggaagccaagtgttggtgtgttcaactgtggacatacatttgcatatggttttgtttctattgaatagattttggtttgaatgacaaattaaactcccagcttccaaacactgaattcttttgttcagactttacacattcttgaaaggaaaggtgcccacatgcacttatcctttaagggtgaggttaggcaagcaaggaattgacagttattttatgtttttttgttttttgtttttgtttttgagatggagtctcgctcttattgcccaggctggagtccaatggcatgatcttggctcactgcaacctctgcctcccgggttcaagctcttcttttgtctcagcttcctgagtagctgggattacaggtgcataccaccatgcccggctaatttttgtatttttagtagagatgaggtttcatcatgttggtcaggctggtctcgaactcctgacctcaggtgatgtacctgccttggcctcccaaagtgctgtattttaccttttatattaacaaaaccttcttcttgcagttcagaacccataggaaatattattggaaaggtatttcaccacatcatcacaggcatttctatggtgacgaagcgatgtgccatgaacaaagttatgccattttttaatacaagccgaggaaagagaaaaaaaccaggagcaagccactgcttcagggattggcaacctctttatgtttgctcaagatagagcgaaaaactcctaaggttttaccattaaagaaccaaataaaattgtttaacatgttggaattgtgggtcctttttgtatattgacttgagaaaaaataaaaatattgatacagaaaaaagagaatgcatatgatctttttatcttagccaatatattatgttttcttgtttttgtatatctacatattcataaaaacaagtatgtgtgaagaagtttacatcacagtgcaagtgtgatccttcatataaaactaaagcaagtgaggatgaattcctaaataattaaacggtaaattacttgtgtttgtatcagctcttgagccatcttaaactactaatcaatttctcataatcatcagtgcttttcatctgtgagcggattatttggtcaaacatggagacaatggcacagccgtgagtagagcccaggtgtttttctccgatttctccacagaactacaatgccagcagaaaggtagagtggagtaataataaaaaccaggtttaagagaacactaagtttttttttcagtgttgttcacggaactgcaagtggtatagaggttcaggaagtcattacagtcttcataggggtgcaatagttctcacttctcctttcaagaagagttgtaatggaaagttgaggaagaacagtagggacacagggacaggtggtgtctccaattggtcatattctccaagttatttttggtctatagttggttccctaaatctcacttcttctcttcctctagctttagggactggactcagcattttggtttcatttcttttttgaaaagtaaaaagaaaatttacaaaactataaaacaagttatatatgtatatataaaactagcatattaacaaatatatatgggtaattatataaaattatttatacatatataattacccatatatatttttcataattacccatatatatgtatatgtatatatatatataattacccatatatatgtatgtgtgtatatatatataattacccatatatatgtgtgtgtgtgtgtgtgtgtatatataattacccagaattaaacacctttaggtgtaattagagtacattaaaatttggcatactttcctttagttcttttctaaattataaaagtaacatatagtatatttttcttctctaaaaatattgaaaagttaaagtttccttatccactttctcctcaaccagagctgcttctcccaaaatcccaagggaatcattattttgagtttgctgtagatacttcaaacgtttaaaatatgtatttacatgcatatatatatatacatctagaaaaatactagcatatgttattttatgtagtttattcagttacttacatagtacagtgtactatgtaagtataattcacatcttgcttttttctttcaacactgcatttttgatgtataggtccctgatacactgggtattcttcagacggataacatttgatttagattctgaaagagggataagattttgccaggtcaagaaaggaaccggtcaggtagaacattagtttacgtattagcacttacttcataaaggcatggaatagactgcggaaaatcaaggttgctggactttagggtggaactggtgagagaagagacaggagactgagtaaatgcagaaagggtggccatgtagcctatggcagatattttgaattttcactgagaggcagggatattataagtgaaggtgaagtgtatcactttgctagagctgctgtgacaaagtgccacaaaccaggtggcttaaacagaaaatgtgttgttctggagactagaagtatgagataaaggtgctggcggggttggtttattctgagaaccataaagaagaacctgccttgttctctctcctcttcttatggtttgccagtaatctctgccattctttatagacaagtcaccccaatctcggccttgatgttttcgtgacattctctctgtgtgcatgcctctgtccaaatttaccttcctttatttttacaatttttattttaagttcaggggtacaggtgcagtatgttcagatttgttacctaggtaaacgtgtgccatggtggtttactgcacaaaccatcccatcatccagatattaagcctggcatccattagctcttctttctgatgctctccctctgcctccccttttgctgtgcagaagctctttagcttaattagatcccatttgtcaatttctgctttggttgcaattgcttttggcgtttttgtcatgaaatttttgcccacgcctaattcctgaatggtattgcctagattttcttctagagtttttatagtttgggattttacattttttaacccatcttgagttaatttttgtatgtggtgtaaagaagaggcccagtttcagttttctgcatatggctagctagttctcccagcacaatttattaattagggaatcctttccccattgcttgtttttgtcagatttgtcaaagatcacatggttgtaggtgtgcggtcttatgtctgagttctctgtgcttttccattgatctatttgtctgttcttataccagtaccatgctgttttggttactgtagccttgtagaatagtttaaagtcaggtagtgtgatgtctccagctttgttctttttgcttaggattgacttggctattcaggctcttttttggttccatataaatttaaattttttttctaattctgtgaagaatgtcaatggtagtttaatgggaatagcattgaatctataaattactttgggcagtatggccattttcatgatattgattctccctagtcgtttatttttatcctctctgatttctcagagcagtggtttgtaattctccttaaagagttccttcacttcccttgttagttgtattcctaggtattgtattctttctgtagtaattgtgaatgggagttcattcatgatttggctctctgcttgccttttattggtgtataggaatgctagcaatttttgcacattgattttatattctgagactttactgaaattgcttatcagcttacgaagcctttgagctgagccgatggggttttctgggtgtaggatcaatgtcatctgcaaacaaagataatttgactccctctctttttattcaaataccttttattttttcctcttgcctggttgccctgactagaacttccaatactatgttgaataagagtggtgaggaaaggcatcgttgtcttgtgccagttttcagggggaatgtttccagcttttgccctgcagtatgatattgactgtgggtttgtcatatatgactcttactattttgagatatgtttctttaatagctagtttattgagaattttaaacatgaagggatgttgaattttttgaagtacttttctgcatctattgagataatcatgtgatttttgtctttagttctgttaatatgatgtatcacatttattgatttgcatatgttgaaccaaacttgcatcccagtgatgaagccaacttgatcgtggtggataagctttttgatgtgctgccgaattcagtttgtcagtattttattgaggatttttgcatcaatatttatcaagtatattggcctgaatttttctttttttgttgtgtctctgccaggttttggtatctggatgatgctggcctcatagaatgagttagggaggagtccctcctcttcaattttttgaatagtttcagtagaaatgtgtactagctcttctttctacctctggtagaattcagctgtgaatctatctggtcctgggcttttttagttggtaggctattctctactgcctcaatttcagaacgtggtctattcagggattcagtatttttcctggttcaaatttacctttcttataaggaaggcaatcatgttggatttgagtccagtctaatgacctcattttaactttgttaccttggtaaagactctaccttcaaataagttcacaatgtctaactgtgagttaggaatttaacacatgaacccattcaacacatgaacctttgggggcaggacttaatttgacccttaacatgaagtgataaaaatattttttagacttgataattgtagctcttgtttgatggctgaagtatcaagaggattatgagaacagacatgaggctatgaatatgttgaaggattggaattttggatcactcaaatgtgatccaaaacctctggacacccttaccctttctagatatattttttccccttaaagaactcaaaggagaacagagacctggaaaaatatctgtggatatctggaagtaagcactgtactagaggttatcttgtatttgtctctagtttttatgttcgattctcagaggcaggtatttcattgtacaaggtgcaataattatggagtatacattttatttaatcacataggaagtggtttattataaaagagaaagaatactttaactttaaacctgttggacaaaagggttaagtataactttctcaattacttaggcaaatatattcttgaaaataaaaagttagaaaagagggaaagactgagaccctcaatgttaaataacattttataatgatcacatgctgagtcaaaggcaaaagcaatttctaagtcgcctacttaattctctagaccatgcctgctatcttatatttatatcttaataaatgtacatatgctgccttgctgttttggggacaatgggaagtataaatttgatctttcttgaattctccacatttaaagtctccacttgtcacttgaattaacatagtattttagcatttaatttcctggggataccagatgttttattttgtgagtttcttttatttatgttatagttgtggtttaaacaactatatgttcatttaaaatgaaactcaaaaaagaggaaagaatggcacaactcaataaatatgtagtttaataatattcagtgaatacgtatgcacagtgaatggaagtctaaataacgtactccagtgaagaattattagatgttgcccgtctcagctggattttcagttatactattcaagctggtgggaggtttcaggggaagaacaggggagaagacaaagcagaaacagccttaggcagtataaattctgaatacctttaatttgattaacttgttaatactagcaggagagttactttgttgtattctagggattataacatggcatcatttgaaatgatatggttcccactgataaggggaggatgaatagaagcatacactgaatttctctccagggcattgagttcctttggcgacagcactgttggctaaatatgaaaggctgtgagatgaaatggcagcaagagaacagcagaggaaaatgtaaggcaaggatgggaaacacatgagaagtttatacctgaccatctcttttctatcattggcttcctatctcctattcttcttctttgtcaatctctgtagcctccacctttgctcaaattggctcagtgatatgattttaatactaagcccacacccagttggtatgaagacattaagtaattaattaattcaataactatttgctgatctgaacaaagtggacaaaaaaccctgtctctgtggaattttcttccaggcatgaggggcttgggaatgggtaacaagtaagtaaattatgtaacttgtttgacagtgctaagtgctacaaagagaaactaggtagataaaagaaatagggacttgggaggttgaaattttataaaaaaaaaaaaaggtcagagaaaataccacttttctgatgagttaaaaagctatgacctgctaatttttatgtatttattctgtgtccattaaaacttccagaaactttctcttgaagtgacatttgagtctcaagatctggccctggtgattatattgtgacacactgtgatcattacaaaaatttttatcatcatgtataactgtgatgctattttgcttgcagcccagacaatgtgatggatttattaaaacattctgataatcataagacagtgattctaggacatgtattatcaggacctcttctgtacctgtgtttggagttgccatagatgaaagtcatatgataagagaaaagcaatatgataatttgtaagtgagctgcttataataagcaggatatgacagtcaacatttttcctttttacctttccttccatctctacctgttttctttgttatagactttgagttttgtatgtgtcaggtttcattcatttgggaaaccaatgtcacatcaaattaggaaggatgttatgaccctctaattggcctttgcattgtacacaagcctcctatgtttgttcgggatagcaccacgcatccttttaaattggtagtttgactgtcagtttccgtaatgcccttgacagtaaaacaaacacaactctatgtgattctattatgaaacattaatcttctgactgtatggtaaaaggaaggggtgagagtttctctccattcccccaaaggaaggaagagtaagaaagaaattaaaaatgtaaaagcactcccaataacaggtcatcaagtcacagcttttcattgtggccactctttgtcagctgtgtgtgtgacaagaaacaaatcacagctccatgatatttgatagccttgagtaattaaagagtcttcaatgctttttggaaaatgttgtccaatattccagccacatgcagtgctcccttaataactcaataactccacatttctctccctgtgtgtgtttgactattgctatcccttttagagatatttgcatgtaatcaagatagagttcaaagatttaccattttccttactattattctatatttgaatatccctcccacttccatttttttcttccgataggggaaataagttaaccaaaattcaaacaaaaatcagttttaaataaatattcctaataagaattattataactactaccacacatacatttatggtaggaaaatttagaatctgtcctggaaaaaaatacgtccagattatttacaaagatttgctttcagaatccctcttgagataaatagacatgttgggggtgattctgggatggagcaaacatgtagtttgggtcgcagtttaacgatgtagccgtagtgtattaaggctatgcatagcaatttctcttgccctggagtagttagtgtcaaactctttttacccattaaacatttgaagtagatttattagctctaaggattcttggttcttcctgaaaaggaattaagaatctttggacagtggacttcttgaaaatcctatcaaatacccctaagtatgtttctggtagcctctcggttgtgctattcagtgatgaataacacagagcttgattgttctaatttagcggaagaaacacattttttttaatgtggtttttgccattttctattatactttaagttctgtgatacatgtgcagaacatgcaggtttgttacataggtatacatgtgccatggtggtttgctgcactcatgaacctgtcatctacattaggtatttctcctaatgctatccctctgctagccccccactacccaacaggccccagcgtgtgaggttcccctccctgtgtccatgtgttctcattgagaaacacattttttaaatacataaataaatatcacccttttgtcatgtatcttcataagcaattgacccaaccaatggatttgcagtcagtgaaaacaactttggatagatgggtggatggatgaatgaatggatctcatttatttgtgggagctaaaaatttaaacaattgaactcatggagagagagagagtagaaggatggttaccagaggctgggaaggttaaggaacttggagggaaaagtggggacggttcattggtaccaaaaaatagttagaaagaataaataagatttaggatttgatagcctatcagggtgactataatcaataatatcttcattgcacatgtcaaaataactaaaaaagcataattggattgcttgtaataggataaatgcttgaggtgatggctaccccatttaccctgatgtgattattacacatttatgcccatatcaaaatataacttatgccccataaatatgtacacctactatgtacctacaaaaattttaaagaatgtgaatggttgaatagataggcagatagataataaagtaattactatttatttttgatttcagaagattttaacagggcccttgattatcattcatctgagatctacccttgtctgtatggcttatttgggttgtaggtaagagtcattcttgaatgagtgggggtttctgattatttttaaacagccattcaagaccaatgcagatacctaggaggaaaatgtttctgatttttatgaatgtgtatgaaaccggtaaatattcataacatagctaccaatatatgcttctgcaagccaatctaaacaaattgccagtatcaaagattctgttgatgaggaatagacagcctgtgtttgcagtcttgttaaggtggttaacagtggtgtcctgattttttccaaaaccttccagatttgggctgctgagtagatgatgctgacttccgatactgcttgttgttgttgtttaaaccattgagcaggttacgaacctctgaacttaaacgaaagaaatcagtggtttcagctggaataaaaaagtaatactatggtatagcataacggagataatacaatttttgtggttttaaaacagagaaaaaagtccctcttttaatgcaaaatcacctgtaaccttgaatgtatcaaccagtgtgacttagctgataatttaggcctatttcatagagctgttatgagaactaagtaaaatcatgcacatacaaatgattagttacttttaaaaactgtaaaatgcttgctgttattgttgctggattgaagagttcattgtgatggtgccattcaatgactatatgactaagatgatcatcctttgtactctgtctccccatctctcctccctcccttgtttttccatgtggtatgtgttttctctctctctctctcttttttttttttttgagacggatagtttcattcctgtcgcccaggctggagtgcagtggtgcaatctcggctcactgcaacctccccctcccagggttcaagtgattttcctgcctcagcttcctgagtagctggaattacaggtgcccaccaccacgcctggctaatttttgtatttttagtacagacagtgtttcaccatcttgaccaggctggtcttgaacttctgacctcaggtgatccactcgcctccgcctcccaaagtgcttggattacaggcatgagccaccgcgcccggcccgtctctaagttattttctaagctaaaagtcatgctactgcaaccaacggatatccccccttttttggagatacttggtaatgtagaaactatttcagagagtcaaaattctacagatagagtttagaatgcacaaaatctagacatggcattgaggcatctagatattgcctttacctatttcctgtaggaacttgctccagattagtatcttaaagacaaattggcatttatttttcttacacacattgcattgtgccatgtaagaaaattacagattaaatcagcattttcctcctgcttgatgtgaataaaatcaatgctgaaatgggagtcctagttaatctatgtgatagaagttactaggaccagtgtttggtggcttaggtccttaaagaaattggaaagctctttgcaatacagtgtgttaacaacagccttttctttttattcccttccctttgcaactgttcccagcccttctttaaaaatctaagtcagaaatatattgaagggctttatttctatccatttttttctatctgcacatggctgttgatattccttcactgtcttggagctatcaactatcagtcttttgtaaagtagcatacatagtaaagtatcaagaaaacattttctcaagccagactgcctgtgctcaaattgcagctctgctacttactggctgagtgaccttggacacgttatttaacctctctgtgcctagtaaccactacataggagggtattttataaggattaaatctctgtaacacacgtagaaaagtacctgccatatggtaggcacaatatacatttttgttaaataaaatgaagcttagtagtttacctgcattgttcacattatctaacacattaccttccacatcgtaggtacacaatgaatattattagtcatgacttatacatgactaaatgtattcttaaattggagtggtacaaaaaacatatgggtccattccacatttctacaaactagctctgcagtcttgcacatcaaattttagtgtctttggagcttccttctcatctttaaaataaaaatatttgcccaatgtatttcaaagggtaattttaatgatcaaaatgataatgtacttccaatgagttgaaaaaattatttctctatatgaaaggtattataacatttttatttctcaaattactaaatcagttctaggggaaatatgctagtaaaatagttaaggcttgacagatataactggtccagaggtcggtagtcatcatgagtactaagacctagatactaggggtctgtgtttgttcttgagaatacagcaaagtgtttcaaggaaggaggcttctcctttacttaccaggcctgttcagctgtatttggctacttcttgttatggaaggaaacctgagcagaccttgggaatccagtgttcctttatcacattcctcagatctgttaggctggacgccaaggacagtagtttgaaggtgtttgtcttgatgctgatggatgttgcagtctgtaatccacgaactgaaacagggcttctcttcattgcagctggcatatcttgttgtgtttatgagtctgacaggcaaacatatctgaagcatatctcatatgctgatctgtgagggagataagccccttgttttgcttgactggaaacaaaataagcaggtggcagaaaaccctgcattgatttctgcttgggctaaaacacccagaataagatcaagtcccccttgggcacactccagcctctgctatttgatcattgatcatttgacttaagtttgcaaattgttgtagggaagtgtaagtttctttctgctttaacaaagctacttttacttattttaattttataagctattagcactattttgtgatagaaaaaactaaaaatcaaatggtgtcagagcttaaaaatctcttacttcatttgccgtgtaatctttatgcatttgatttttgcttcaggatccttacctataaagcatacccatttcatttgaccactagatttttacagaataaaaatagttcctttctgaagaggaactatgaaagtgtatacatgggttaggagatggagctgaggactccaaagtaatcagtccctgataagaacttgagttttgatgcacacattattgcattttagagattttggtctcccagttagattgtaaacttattgaaggcagtaggacattgacaatgcataaatattagttaggaaaatgaaaaataaagtgttgcttaccaattcagagattcagaagaatgtggataggattttttccctctcacctgaaatttcgactttataaactctttttattactgtccttccttttctgatcccttgatgattattaattggttccagtggtgtatatttcagatatttaattaagtcttcctttctgtccaactctctgccaaaacatatttttcatttttatacctgcaatgctcaaacataagttgatgccaaatgcatgctgtttgattacattccatccagatttacttccaagcaggacgaggcctgtagcatttatttcaagtagctttacaaagagccattcttggccctcaatgtgtgtggcaggcggggaggcaggagaggaaaatgaggtagatgtccttcccataccttaactagtttttgagagaaatggaaaatggcagatcagatgccattggccgtttgcccaattaagccatagcagtgttagctaagatgtgatcaatatggaagacttggtctgcagagccttttttagctgtgctcctgtactagtcaagcacctcctgcaactttgtggtaaattcaagcacctcgtgcaactttgtggtaaaaaccatcctcatgagttagagccttgtcttataagaaggaagaggacagcttctgggtgagacacgtgctggccatcatgctgttgcctaatctgtcacctcaactattgattcccagctcttgattctcattgttcattcatggagttgtttctaaataatggtgactagagaggaggaaatggtgttatattagttctctattgctgcataacaaataactccaaaacgtagcagctcaaaaatcaacaaggcattacctcctaatttttgcaggtcaggaatccagatgtggcttagctgggtgcctctggcttagagtccctccataaggctgcaaccgaggtgacagccagggcttcagtcacctcaacttgggagagatctgcttccaagcccttacctatggctggtggcaggccttagtcattgtggactgttggccacagataatacttcattggcacaagagcctttctacaggacagcttacaacttaatagctgtctttgattgagggttggggagaaggtggaagccattgttgttttcaatctaatcttgaaagtgacatcctgtcacctctactgtattctattcatcacttagaagtgagtcaataagtataggacatttaaggggagggaataatcaagggtatgaataccaggaggctgagacagttgggagccaccttatagactgccttacacaggtgtaaaaagcatgaaatagacattagacaaatgcagggtctgctgagatggcgtgtaaaaagttctatcacagggcttgccacagagtagagaagcattgcatttatttcttgccacccccagcacattgcctggtgcattgtgggcactcaagtacctacatgcccatgaaactgtgtctagtttactaaaaacaaagagtctctctgttccaaaagagattaatgtttggtgttatcctttctggacaattttcttcctatgcttcatttctccagttatcgtcaagggaatggatttaagtctgaaataaaatcactcaaaaataaggaatagctgaagcagacctagaattaccttggtggaattaccttcttaagaacaattagaagtttattctttaggtcaggaatgctgttgccaatcttccacagcaggtgataagaattaaattccctcatgaccgaggaaacgttctttctgctaatctggttccacctggaggttcaacaaatagaagatagagcacacggtgtgtttagtcttaaccacatagcccgaggcactggggaagtgtccacacgatgtttgccttctgtgaacctggaaagcaatttttttctagttttcctttttttcctcttcttttcctattcatctgaattcttctgtagttaaattattaatttctctccctacagaatataataaattactatccttgttaattcttttatcaaagatatgtactaggcttctgcttccacatgggccatttgaaaaacagtgcttcatatgatccctgaactttttggcaattataaagagagatcacaaatgagtaaggttgaaaattaaactataactggaatgaaatgtcctataggactaaacctatcagttgtattgcagatcagccccttataattggtgatgtggtatgagacattttatataactataatatataggccataaattattattatatcagtctgtggtataatattgcaccttagggtagaatttgctccatttacattatattcaggcagaaaaaatgaaaacatctgtcagggagagtatagccctattgatcaggtatatataagtaaggtttacttatataaggctgagaaaaggggctttccatttgatttcagttgttttatagacaagtttctagtttgagggagctatttagaaatgtatgtagccttatgtagaaattccaataaagctttcaaaaaataaagctggtatttatattggttgaaatggcaagataatgagtctaaaagattttcccttctgatgttattttttttgttgttcagaatgacacttgaaagatgcctaggatttctactgctgctcttagaatcacaggatctcagggtaaaatcaaactttagaggtcattaatttcaaccagccataaaggtctttttgtcaaacttatgaccattcaagatactttggtgtcaaagtagctcacaagataaaataaatcactcgcatgttaacccataggaggttaaacttttgacagcagatctgtggtggtagataccatgttttctactgtcctattggaaatgagtgttagaggcccatttccactacaaatactgcctagtggctgacttacatggtaaaaatccatccaaccttgctctgcatacattccagaactctaatgcaaaatgatgcctaaaccattttaactctatccatgcatgaggacactaagtaagatgaagcttgttttgatatatacactttttaaaaaggtagaagaataagaggtggtaaaataagttattcaatttattgactatagtaacaacttggctctgattgttaatgtttgtccctgccatgtgatatatagttgtgtgagattaaaaacccccttgggtataattttatttacaccaacacatatattttgaagagatgaatgaccaattctgggaatagttagaagtaaagaatttgaattttctgcagcactgctgcacgttaggtaaattcctctctttgggcctcacttgcaacaccaataaagagaggaagttatactagatgttctataagccccttccagccctaacatgctattagcccatgattcttgtgtagggataccagaagaagatgaaagagagaacctaactcattttctgtcaccagtccttataattcatggcattgtgtatttctccttgagtcaacattgcttcttttagtgacacaagcaagcctgctttctccagctcctcaggaggcaactctgctactgcagaacaaagatcattctcttcctggcactcttctgattcctggtacctgtattcagtttcacattccctttcttgttgaggatgccattgcctatagaaagatactttaggtgaattaccaggcaaacgttactaaagcaaagataactgataagggggactagaatcttggaatttgtgcaaataaattcctttgtgaaactgcagactgattagaaaactgtcatagtaaaatactttaagcatgtccttttctcattttaaaataacaactggaaggaaaatataaatatatcactgaaataatggtttctccatgaagaaaaagacatttagacaaaccaaaagtgtatattctatggtgtagtaaatcattaccttactatattaggttaatacttgataaaaccttgtagtgagataaatggtgatatggagaacttaaatcttcaaatgtatgttttaagccccattatagctattttttttcaaacttacctactataaagttttgtccagagatattccaaaaaagaataatagattggtattaatgtttctgcctcttttactctttggaagacgtgccaataggcaggtaaagagatcaaaaagaaaaagtcgggcagggtgcagtttctcacacttgtaatcccagcattttgggaggccgaggcgggtggatcacaaggtcaggagttcgagaccagtctgactaacatggagaaaccctgtctctactaaaaatacaaaaattagccgggcgtggtggtgcacacctgtaatcccagctactcaggaggctgaggcaggagaaatgcttgaacctgggaggcagaggttgtggtgagctgagatcatgccattgcactccagcctgggagacagagtgagactccatctcaaaagaaaaagtcaaactagatcaccatttacttaacaaggagctgttagtgtattaagagtattatgccattcagtctgattaaaccacctgaaggaacagtggaacctcttcctaatcattcccatgtgagacttcctgggagacagctgggggcagccagaagcaagtagctagagaggactgtggatttctttgtgaggaaatctgaaactggccactttaaggcccctgggttctactgaggttaagcgtctaaagtgtccttgactcactcaatttcaaagcaaattcaatttgatctcttgcctaataataaacactgggcagaagcagacatggaaggatttggaaaatggtgttaaaagatcaaagagatctaaataaactattttgtttgaactagagttaccaagtagaatagattgttttaccatagatggagactctttgagaaggagttaaaatttgtgggagatccccaaaataatggcagttcccacacacacttttcccccagagtgtatataggggatatataccactttctcacctccttttccacttcttatcattgttagatctctagaaagttcatgtagcttctttctcctttgtcgttatatgtttcagatacctcaccagcttcctttgctttcatttaccatatcatagtggtaatttcctcaattcctatatcctacaagagcttgatgaatgaaaagaaggaagcctgtgacaattattttattcaagcctccaaaacagagttttgccaaatgcttgtcctacttctccgtgcgcttgccatggtctttgttttgcctctttttcttttggcagttaccccaactataactggaatttcctgattgatgaagatttagtggtccaaacacagtcagttgtcttttggccagaaggaaatatacattatataatccggtggtttatcttcttatccctcccccattaacttttttttgttttgttttggtttttgaatctctgcttcccttctccatcccctaagcaaaagcataaccagcacgttttttagcatttagtagatacaagcctagcattgtgctaagtattttgcgtctattatctcactaacttttcagaaccatcaatgaagttagttcctttatcatccttattttgtagataatacaattgagatccagtgaaactatagttagcaagtgtaggtgcacatactaaaaccaaatgaatgacttgaaatcccaagtggttaacatttattccagaatactttcctaatctgtgcctggcactgcactagttaatgaaaacagagtgagaaaagatatgatgtgtccagccaggtgcggtggctcacgcctgtaatcccaactctttgggaggccgaggcgggcagatcatgaggtcaggagaccgagaccatcctgaccaacatggagaaaccgtatctctactaaaatacaaaaaagcagccaggtgtggtggcatgcacctgtagtatcagctactcaggaggctgaggcagaggaatcacttaaaccctgcccagaggcagaggttgcagtgagccaagatcgccactgcactccagcctgggcgacagagtgagactttatctcaaaaaaaaaaaaaaaaaaatgatatgatgtgtccaagctctttgtctaatgaaggagacagatgtcaaaaagataaattactatacggtacaaaaatgctcttatagaggtatgagcaatgttctatggcagacaaaaaattagaaagaagacacccattttcctcatagtaaaccaaaaatgatctaaaatattccatgtttgttaaaaagcaagatctttatggttactgttaggcactgcggtatgcctccctggattgtcaataccaatgccatatagatagaacaaatagtttgaaaagacatgaggacaaaacagtctccctgtctcccaaataatagatccaaagaattctctggatttgaatttaatgttcaagagaggggaaggcataaatatataaacatatatgtttcatacatatgtgtatacatatatatgtttcatacatatatatatacatatatacacatacttatatatacatacataaatatatttatatatccacttaaaacatatacaaaactacctatacatatatacatctatatatcacatgtttcaagaagctgttttctactaacatcttcatgtacgtaaaatttaggtgttttataaatttatttgacagagcacccctaaaccttttatatacacacctcatcagatggaagtaatatataaaggaaaggcactggcttcattcttctatttttaaaaggagtgaaaacatttttgcatttgccaaactcctgtgtatgcaaactaattgtgtgtgtgtgtgtgtgtgtgtgtgtgtagacacagcaccatttttggtgaggatggcacaggggctctcaaaagaaggagttctcagaatcatagcaccaaaacgttgtgagtttgcaataatcagagtcatggtgagcatcatggaaatttagaactaaaagagatgttacagattatctccagtctgagtccctgccacacatgagaaactaaggccaagagatgttaaatggcttgaacacagaatgatcagtggaacaatacctagagcttctgtcttccaaatgagttctttttccaccttatcatgcacgttacatcaggcatgaatactggaaatctttctaatgtagggacatccaagcaaaacaagttgcatacatgtcataaaaaactttaaaaaattcagatttacttctggcaaattcattcaggaattcaaactcagataattaaattaatttcttaatattcaaataaagaccagatacacattgacatcatctctcttgtatattcagagtaccagataaatgggatttttcactagggggacaggattgctacactacaccattgccatttgcattcacaacacgggatggcggaagagacattgatacaacattttttctgcctccttcatttttaaatggatggtgacatgcttcacagcagcatctccaaacaaaagatgacaaattcccatttattttccatcagtggtactgtgtgagatgttgtactaagtctaagcttgttgttcctgaggcacagaagtctttttcctgcagcatatagcattactgtaaaaataaccattccattgccagtcactctgtcaggagtattggcagagtgaagaagacttatttgatttcactaaagctattagtttgaaattctgatctgtaaatctggatgggaaccacacgagggaaaggatccctgccagaagcaatgggtcttgtacattctcaaaaacaaaggtcagatgaaaacactggattgaaaatagagccctagaaatgaagcaagaaggaaggaaacttatattgagcgtttgtaatgttccaagcattctgttaggctgtttacattatgtacttgaaaccgtcaactggattcatcttttccttcctttttccaccattgctggcatgtgtgcaagtgggggacccagggaatagagactacaatgtaaaaaatggtttcgctgttatcgttgtcatgttttcctatgtaaaaaataggataatgtgacttttgctgttgatagatgtttcttcaagatcccagtagagtattttgtgactggaaaatttctagaatcttgaaggcaaaaataagtgaaactgtagagaagtgtaggaaaagtcatcaggggttttacataaaacagtttttattaaatctcctttggaagggagaattacaactatctgagctaagttttgttgtgatatgaacgatagtgactgctaaaaggatagcatgggaaagttttttgtttatttgtttgtttttgagacaggatcttgctctgtcatccaggctggagtgcagtggcaggatcacagcctactgcagcctcgacccccacccctaagctcaagcgatcctcccacctcagcctcctgagtagctgagactacaggcctgtaccaccatgcctggttaatttatttatttttttttttgtagagatgggggcctctatattgcccaggctggtctcaaactcctggccttaagtgttcctcatgcctcagcctcctaaaatgttgggattatagatgtgagtcactgcacttggccagcaagggaaagttttgaggagtgatggaaatgttctatatcctaattgtggtgatggttacataaatctatacatgtgttaaaattcatagaactatacaccagaaggaaaaggaacccttcaatttcactgcatgataatttacaaaaataaaatttcaaaaattccagtagtcaactctaagccaataatatgttggactatgtctaacaaaagggatattatttaaaaatattgccaactgactatcattaaagcctaataaataataaaaaagtactgtcactccccacatgagacaaaattgtcatctttacatttatttcttaaaattattctttcctggcatctgtaatcatctatggcttcttcatttcctatgcccctctgctgtttggaaaatcagaaaatagaaggcattttggcattcagggtgataggtaaatgcccctattgtaccttctaataggtcaaatatggtgactttggttggttcttatttttgttatttctccagtcatcaatcgtattgatttttttaaaaacaaaggtcaagcacatgttcgtaggtgacaccagttgcttcagtgagttggtcccttctgcttactgttctggtttaaaccccttgtggcattttctactgcatggatagtggtaaatggggttgatagtgacatagaaatgaacttagaagtaagtttatagactgttggggaccatctgttaatgtaaatgtttaaggtaaaatgcattaaggcttaagagctgacgagacgttttatttgcctcctgcttttgggattatgcctggcacctgcttgagtctagagggttcctggttaaacttgggaaacctggtttcctcttttatctgcagctgttcgttttctgggatggaatcctaagcacttatttgaattgtatttgttgaagtcactgggttatacagtaaaaataaggagtcatgttggtttttgttcgaagttttaaagtatgtaaattaaatacatttatatggctaattgtcatttatggttacctactgttaaatagttgtttaatttgttgtcttcagcattgaaaagttaagcagtatcccttagcactatcaatgtcagtcaagataacagttcatttatttcatagattactttgattaaaatcactattaaagctatttgaattatattataattttctggtgatgtcataataaagaagtttttgaacgtgcccattttatttttaacgcttcaatgtgtattactggagaagaaattgaagtaacatatttttactgttaatgggaaaatggtcttcttcaaaaaggaaaaatcaaacttacctcctagatataaatcaataattttcatttctagcattaacttagtagtttaatgacttgggcttatggaatgattttttttagaccacatcagacctacccaagggaaaggaagcacaaaaaatagggaatgatacgtagaattagatggcgagaagaaacgaggagagagagggaaaaagtctgaatgcaagactattgaaataagtgagtaacacacttttccagaaaagattcatattggagttttctagaagcctctgagtatgatgaggaaaaagaagtgattaaaatttgaatggtttccctatgggcggataaaactacctgttcagctggaatgattctgatgaccttgcctctgaagcttatcctttgagatcagcaaaaaagttcatgttctcatctctcatttgagctggagttgattgatgcataattaagatccctaaggaacaggtgcaaaagctgcagcgcttctagattcatccatttctctctactttttaaagaccagtctcatgattctaatactataaacacttggtggcttggtattgggggcagagagcttccggtaggatgacatgagataggatgtcatcctgccacagggaataaattcttggatgaaattctacaggtcatttagcccatctcctatattgcacaggatagggagctggggactcctgaggcaaagtcattttctcaaggccgtgtatctggttagaggcagaggtaggaaggaaacccaaatctttctatttttagaccatttgcctctctactaggccatccctcgctttaacttgggatcttaagcttcccttgtaatttcttgagagtaggttttaatcttcctactgtatgctctagaaactatatgctgggggaaagctgaggggatagcatagagtaatatccaatcttgaatcctttctctcattttaaattgtggtgttttaaattagcataggtaacatagagattattactcagttgaccactttgcacttgatctgagggacattgcagagtcatcacagattcttgagttatgaggtcagtatttaatgaaaggatacgtcgaaggcttttccttaactttcaaggacctgtggggatagtttctactcaatgcttctttttattcgctttcctaataaaactaatatttaattataaaattaaaatgaaacaagtttggacttccgtatgaaaagtcttatacttgatctgtaactacaagatgttagatgttcttcatggagatgacaggcaaaggttacttttacagttctatgaaagtaaaaagcttttaaaacatttgaatgggaattggtaaaagaagcagttcttaattatgtcaattgtctgtaagagctcaggtgattatggtaaacacacctgataacaataacttaagagagcaacaataactttacagcagacacacctgaatgttggtgggagttctgagctaaggaacccagaagtggccaacctgaagatcaattccttgtctacgaggaacatctgatcccctggcctgtcccttggaacatgggccatacaaggagttgaggccctttgttttggattaaatgaaggtttccaagcggacgtggttaggaggagggtactaagtgaaaatgtgatgtaaactgcctgccttttgcaagtggttctcctgtctagcctgctacctctggactctctcccctgtatgcaaggccccagtaaaaccccaggtctcatttgctggctctgggtctctccttcagcctcttgaacatgctgccatccccggtggagtcaataggaagtcggcacaacagacaaggaagagctgtcaccttgcctgataaaataatattctaaaggggaaagtacatatttataacaactggcaagccttatgacttaaatgaacagagctctgctctatggaaacacagaaccaacagtgccaggtatgaatagggaaaacttcttggtagtggtgataccttattagagtcttgaagagggcatatttcctggtacagaaaagggggaacactcaagtagaagagtaaagcagaaaatatataactctccattttctcaggaggtctaactcattacagttccatttaacccaatcaaaaccaatgctcccctttccctcacatctttaccgcattcttttaaagaagcatacgcacaactctttgagcaagaaatatcaggcaaccgctgccatcttagctaaaaaatcttttatgtttgagaacttacctggaagagtcctctggagagagaataagaagatgctttcagttgcacttggagagaatgtgagaattaatcgcctgcttgtttgggaaataacaactagttgtttctggttaaagcaacaccagtatttggatgagttggagcaacgtcagaatgattggaaattgctcaaagctcacaatggtacttgaagtaaaaggatgaaccccttcaagaacaatgctaggttctcctttgctacatggagggcaatggcgcatgataggccagggagaaaagaatcaccagatcctttgcctacttctgccaaatctgttgcaatgtttcagataaatcacttgaactatctgagctttgaagtgcttcagcttccactcaataagaaaaattgtttgaacctctctcattctgctcaccatcttacccttctccttgaagatcagcttaaaataaagtgatttgaagccccaggtgaaatgggagccctttactacctcctgctaaaggtggtaaatgactgtgcccaactttgacctcctctagttagcaacatcattctaaacttagcccagacagaaaaggatgacagcaaaggtttgaacacttttaaaggcctctccctttccccagagttcttatatatctatgtatatgtgtataatatgtttgaatattttattataattatcctccttaagaaaaacaaatttcttggattttccctatgacttgggcttaagaagtctcttaacagttcctcagatgtagtacctgcggaagggaaggattaggttagaatatattcaaagtttgtataaaaaagagggtaaactagtcatttaaatgtaaacatataaacacttactttttactgtgttggctttgatattctttaatttctttgttatatcagccctttttttatgtcatgttgaaaatgtgccttcctggttaaaaggatggatatttggaaacaaggcagtttgaatcacagcacaactatttaattttaaaagacacttttttctaacctatataattcttaattgttctggacatgtaggctatttcagtgaaatttagaaagcaaggccatttcctacagctaagccctttaatgataattatgacaccaacccccaaagacatggtttcatggctaacagatcactctcagattttgtggggatagagtgttggtagcaggaagcggcagaggaattcaactccttcttgagcttcttgtgttttataatcctccctatgtcccacctgttttgtctcagaggggataagtcaatagagctgctgctgttcacaaagccatgcaggtaagagacatgtaccccttgcttcaaagtcttagtaaacttatagagaaaatatgatttgattgcctaacaatatatttataatttacataccaaataagtgaaacgtaaggaaaaaactgctttgagctcccgagaatgctagttgatagcaaacaaggaaggtgctttggtaagaaggttgtttgctttgagcttccatggatgagaagaaatcaagtaatcaaagaggaggaagaggaggaataaaaacatagttgagaatggaacagtcagagacatgtgggcactatcttttcagataggaattttatctttcttccttgttcaacagttatttcatacacgaatgagaaaggccaaacatagtcatgaacgtttgcttttttaccttctgcctcttcagtttttcaagaaacactaaactcgcacctaggaatattttgacaagcttagaaactttttcaaaaaataactcttgtatatggcaagatgttactaaaatcagattttttttttcccatggagacgatgactgcagaacttttcattcacaccctcaaactcgtgcagagagaagccaagatctttcttcttctgcacatttttggcatcattcagtggacttgaaagaaacacagaaaattccatggagaaatatcttaaactccagctcacctcttggcttctttcaggaatgcttatttgacctgaattaaaatgatgacttttcatctctcaatctgaagcataaataaagtaggaattttgcattaggattgtgttttttaaataatcataaaactcatattcaagtacttccttgaggcctctaaactaacacattttggattgctataaaaatagaatcagctttcctttgctaacatggataggtatttatatatcaattttatagaggactgactgtactgtaactttggaaacaccttctctttttaataataagaaatgttggctaagggcttgtctttcctggttctagattagctatgataatactcatccccttatgcagaaaagctgcttttagacttctcattgcttcccagttaatataacatagggattattaaagtctctgagtatgcatttctagatgtgtatagcattagatgaaaattccttaggcctttggaaattcttcctttcccttttagagaagaagatattatcctggctatcatacatagcaagttatatgcatataagataagttcccttttgccatgaaatcaatcttccagttacaccctgggtttgttctttcttttctcatcttgttcctttgcttttcacttctctaattttacccatcaagtgatcatgcatctgtttttcaccttgccctacaaacctctcttagttgctttattctccttccccagtgcttctgtcaccatggcttcatatctggccccacccctaccccatcctatgcactattcaaaatcttcattcccagccatccaccaactgtcagcagaagaaagtccaactctccagcctctttagaaagcagactttattccccacactacataatgcatagtaggggctcagtgataccaaatatgcagatcacataattaagtccatagcactgcctaaacatacatggtatttgaaggaaataagtcctgtcatggatgttgactgaaaatttcccagcatttacagcctagaatttttaatggaaacataaagccccaaatttggagataaaggagctacagaaaacagcagatgtcccagagcacacaaaccatgtggccaagagcaaaagggaactcacaaggaggtgtctgtattacgagaactcgtgcccaaattccttttctgtgagaaaacagtaccatataatccttttgtctcagtaaaaaaaaaaaaaaagtggtccaaagcagacagaatggaatatgcattctccctcctttacccctaaaacattctgtcttgatcaatttcatttttttttgtcaggtgcactagatgttataaaagcacttagcttattgcctggtacatagttatttgaaaaactttgaccatggaaaaggctgaagaaagctaagagtattctatataaggtctggaatgtcaagataagaaatttgcattgatctaacaggtaataagaagctccataccatattctttttacctgtatgtaaaaatcaagaggagttaatacaagtagtattttattaccaaaatagaagttgcatctggctcagactcagcctctgattcctcaggaggtttttcccacccctttccctattcctgctttccagctgatttgaccgaaggacagaaggattaagaaatcaagtagcttatctgagaggttccccatggggcgctttgtcccaggtgttcctgcttggagcttacataatcaggggctttctgcatgctgagggtattattgtaaaggtgattgtttaagtcagtgggtgacggtgtcaggataattatagccaggagatatatgatcataaagacctagttagtaccccaggagaccccaagacagggcttctgcccatacttttgcaatcacacattctgaagtaaggtggcaccatttaccaagtaggaacaaaagtgaatgattagggagaactgtttgttccagtgctctggggacaaaaaaaaaatccatgttaatcttttctaaagtgtccacttttgttatgtttatatttttgttgaggttctttgttcacttgcaactaaaccaacacgtagaactgaatgtgatttctactgatctagaaaaaaataaagttattattaaaaaggaaatctaaaggatgataaattagctgcatatttttctgttcgtctattgttttctattttctctatcttaaggttgtttataatagacagttctacatcaaacttgagatgaaattaaagttgtgaaagatttatgatgtgtgttccagttatggccaccagttctaatatgcagggaacacgtttgaaacgggatcacagttgactattaggatacaggactattcttttcagcagaactaaagagaagatcagagacctctctattttttctctccctgcctcttcttttgtaatcacatgattaatacatgctattgaaaaaggtttcaaaatgtaatgaagaatatcaagaaaaacatagaagtcctttctgactatctgcaaccttagtcgcctctcaagtgggaaccactgttaacatttcaatgtgcagatgtcaaaaaccatttgctctgactttacaaacaggaacgtgcatgcacacacacacacacccttgccctaaaagttttagttttaataaatggtgtatacagtcaacatatgtcctggatatctctccctgtctgtacttgtagaaatatgtaagttccatttaaattcaaagtcaaatacaatttgaagttttgctgaagcttctttctcaatacatgcttctagattgtagtgaataagtgactgaaatcagctagccagtttctaccacaacatgatagcttggttttatggctaaatgagccccaggaaggagtgtgagaaactcccaccttgctccattgttcatgaaggacttgcatggtgagagacccttgggtctcctttcatcccagttttatagtaaaaagatcaaagatcttccccaaagtctctgcccaactgggtccccaccctgttaccttctgaggagtctaaccctgagtactgctgggctttgcagatcctagagttgcgggttatgagtgtgtccagagaaccagagtatgtcatctggattcactcactcattcacacattcatttattcacactcaacaaatatttataccattattcatagggcagacagtgaacattaaaaatgtgaaacaataacatacagtccattcattgtcaaaggatactacagatcaaggaaagaggcaacttcaagaaagtatgattagtacattgaccagccaaatgtagaagcttctgtgtcagacttgacagggtgagggaaagcttcctggacaagaagacatctaattggaatatggaaggatgcttagaatctagccaggtgtggggacttaaagggtaaagcaagtgctacccagaaaacgtaagtaaggcagatctctttggcctgaagtcctcatcaaggagtttaagctttattctgagagtcatgggaaacaactgagaaattttaagaagcaaagggacctgatctgtaagatttatacaatggagaacaatatggaaaaggaaaaagacaccattaggatgctgctgcggatgctggggtgagtgatgttgatggctttaactaagggaatggccctgggaccaaagaagtgtgcatgttttcaaaagtcatttcttgctttctgcgagcgagcctactaaactgcctaagcacaccggttaagtgtggcaactttgagaaacagcataaaccatgggtgacattgcaaaactgaaagcacttggtgcagaggttagataaatatctgtttctagggggatatacatgtgtgcattcattgttttgttttcaagagacaattgtgcctgaggctggagcttgctcaccctatcttttggactcagagtatggggcctggtctattttctacatgaccgggctttagttcagaactgacgagtcatatatcattctgattgattttttttttcttttttctttttttcccctctcaaataaaggggttgcaggggtgagatagagattgctatgaaccatcagggcaactcaacccaaatatgcatttatcaggagccccctaagtcaagctctcctgtcctcacttggtttgtctactcagagctgagataaagaaataaagggttaaatgaggtcagttagtgggtaaaggacagagaaaatagatgaacagcccagcttggactgctctgatctctgccggggagaaatggttagaaggggacatggcagagttacaggattaccaatcagtgtcctaagcagtggggtagagctaacccctgaattgcctaccgtggcttaccttgcttctgaattcttgggtttggtttcatctgtatcctctgttttagccttctttttagtgccactccaaaggcaaggaccacaaagcataagcatccatttttattaaagcagaaaggtgaagacttaaaatgtgcttctgtatgtgtgcatttttaaagcaaccctttgtaagaatgagtggatttagcaaagtagatgcgattgaatcacaatggaatacatgcctcttactcggtctaaagtcccttggttctgcaaagttttttattctcttttcaaaccttatgcaattgtgacttcatctaaattattgatacagttctaagggattagtatcttctgacggcagtctgttcaatatatttgtattttttacccttgaaggaatatgggactgttagggttttaaaagaagtctgagtttttgtttgtttgtttgttttgttttgaatgacagtaaatatccattaaaaagctgtagatttgcagccttgatgattagctctctcttagactccagcaagccttactgaatttcctctggagatcaagtattgaggggcaaaatactggggtagagttgaaagcaatagagaagatttgttgacaatatcgatgattaaaaaaatgagcctttttaaacaagaaattcctgctcatacatttggcttctgagagagagaaagagagagagagagagagagagagagagagagtgtgtgtgtgtgtgtgtgtgtgtgtgtgtgaaatggggaaaaatatcaatgcatcaaaatggacaggtcattttgttgaatgtaactgaactcctaagcattcagagattaggagtattcataatttctgactggcatgcattatgctaatgtggctgtcctctgttgtatgcttctgctgagacagccactttactcctgcttaattttctccctaatggtagcagtagggacttgggtatctacagtgagcttttaccaatttaacttgctgccgctataggccgttataaattattattcttatttagcacttgaatctataatttctttctttccctcatgttctataaaatatagacttagacctaagttagctatgcttttcccttcttataaatctaaatctttcatttgcaacgagctaaagttttggatgctcaacaactgtaacccctgcttggcagactagagagttatcaaggaacttcattcattcattcattcattcacacgtgcttgccttcatacatttattcatctctgaatgcaataacatatttacagagcacctactattttttttttttaccaggcaatgctttaggtgttgaagataaaacagttaacaatatcgatttgtgggaagaagtactacctataatgtctagaaaatacatgtgagatttgaagaaaaatagcttctccatactgatattctcaaagtagtttttctccctaattatctgtacacctccactggaattcttgcgaaggttactttgccttctggattttgaaaagttgtctttgattttattactttctccctaatgtcctagggaaaatatttccttccttcctactgattattgttttagaatttgaaaattactggaaacctatatatgagtattttgttataaaaattcatgtgcatttgaacaagcacaagagtacttcctatgctggatgctagattctagaaaattttaaaaattttttaccagtctcccagttgtgatattcccagttagttaattgctttttctgtctctttctgtttcttcctgaggcccctcctccttccctgcctctctcttttttgattttttaattttattctattcttttttttttttgtagagccagaatctccctctgtcacccaggctggagtgcagtggcaccatctcggctcactgcaacctctgcctcccgggttcaagcagttctcctgcctcagcctcccgagtagctgggattacaggcacatgctgccacaacctgctaatttcttttgtattttagtagaggcggggtttcactgtgttgcccaggctggtctctaactcctgagctcaggcaatccgctcaccttggcctcccaaagtgctaggattacaggcatgagccaccgtgcccggcttccgcctctcttttttttaatgagcaatcataagttattatcaactagcatgcaggtaataattttcttatcttgttacttgtgttccaccactaataactatgagactgcaggcagtttttaacttctctgagccatggctccttccctgtagaattatgcagtacttcttgtgaaaattgagataatgtgtaaaaataaaaaaaaaaaactactagcactatatcagccaccatacttggctctcaccagcattctctgtgacccaatcgccagagctctgatacttattccagactcctggcaccatgtttctattgctgctgcccatattcccctcccccaacagatcccaatcacccttcttgcttgagcctattgctcaagctttctgttttgcctttcatacctgtcagttctaaatcttttccaggtattcttgatctctcatgtcgaccccattctgccactgacaaatctagttctgagagtgtgcttcagagaaatttagatttttgagataattttgatatatagtaatgagaatctcagccttatggcagcctttatgctttcagccaaggtggaatcctggccaaaatgattttttttttttttttactttctgccatggtgcctggaatttcttcaatatagactcatttcttagctcttcaaaggcttccaggtttttagattttccttctaagcctcaaatcctgttggtcatcaccctaaataatctatcacttatcacctgcaacatgctcaactgagataggtcttgtagaaatgaagcatagcctgaagttgagaacagaagaaacaggaggagaaaaagcaccagaagcaaatttattctcatatcccagttttgagaaaagctagcctactgtaaccctaggagtttggcggctgctaatatctaaaaatgcgctggctctgtagcttggaagaaaaagaggaacagccattctctttctgctttccaagggtaagcatggccaacctagtatcctgctgtgcaccatgaagcatcatcaggtgcagattaggaaatgaatttacattaagtttcaagaaagaatttctgacaatgtaagctgaattgacaagaacaaagttctgaaggaagaggccaaaccattactgaatgggtgatttgtggctgaactggatgaaccgatagcattccatggctagaatttgtgtcactggttcattctgtgtttcctcttattttccaaattgcattcaatcgatatggcagaaatgaatacccctatatacaattatttcaatatatcttatataagtttagaaggtgaagcctgtatatatttttcatgtaaatgtagtattcccctgcaactcagtgcaataactacccacagtgctgatacataggactctctcaatttgtcccccatgtcagaaatgctgtgcaaaatccccatagctgactgcaaaacctgccctgaagatcaaataaatgatatacatacgaattcctaataagtgctcagcaggttgtttgggcttatattagtctcctacagctgcctctcgggaagggataccccaacaaagtgtttgttaatgcttgccacctttagagaagtctcctgggatgctgcctaaacctacactgtaagcaaagtggaataacaagccctttgaaaagtcacttgggaagatgacaacccataatggtcactttggctaggatttaaaatgctttattattgtcgaattaaagcaccctggccatattgctctggatataccccgtcttagccaatctcaggtttacaatacaagaacaatctcaatctgatttgcttaatgaaaatgtatccctctactttaaaacagggagataccccagttccttaaaaatatatgttttattgcatatgctttaaaaaacctatttacttagcagtttcattttgtttgcagcctcattgcattttcttctctaattagcagatacatgcatcatctcttggagatgaagcaaatatttttcttttcctcattgggtagtttcccaggaaagaagctcacggcctcactctggctccgggtttgctgtgtgctttcccacacattctcaccctaccacacttttcctgtaatgttgctgagttcggctaatttagatcctttctctaatttaagttgctttcatttaacttggcttgagagtgtctgatacttacactcacaaacaaaactatagagttttagaactcagagcagtgcttcccattgagatttctggatgccacaatggtgcctgcaagaggaaactcatcggagtgctttcatcagcaaggaactggaattcctgaccagtgataagacaagatgactgtggcagcttcagatatatttacaatttgacattcaaaggccaaaggggaaaaaagatttttcccctgtatctcactatttttcagggaggaaatttttcagacgcttcctatcccacccaacctccagtagagttctccttaggtctcattggttaaaattggatacatagtcaccctttaatcaatcgattgcacaggaaaattgaatttccatgatgactatagcctaatcatgatgcatgtcctggggctgacccattttcctgagcacagaatttgttcagtgtaaccagtttctgagctaaaggaaaattcacttaacaggtagagaagaatagatgtgagtaggcaaccatacaatagtgtttgttttgaggacaattatgagtaggttttttagatacattgtatgtcacttgcaagtgtataagcagagtttgctatttttttgagatattttttgagtaactgtcatttctttgtgagatttaattctagaccctaattctctcactgcacagagagggagaggcatgggcaaatatatgggattcctgagggaaaatgtaggcagaggggtgtagggtggccatacaatttataacttaaagcaagacacttctgagagtcaaaaggagagctgcgaataactctaccaagtcaacaggtataaattatcctagacaaactaaactgtatggtaaagtcagatttatataagggagtatatttttaaaatgttatggggaagctaaagctaattttttaaagtttttgtaggtggagaaaatgccacctttatttaggatcataaaaaattccaaatttatatgaaactttttcatgtataattttgtttaaatcctaagtcttatgagacatgagacattgactgtaataaaaagtgcaaaaacctctcagatcttataggtattctatgataaatttggaaagtgtaatattagcatctataaaatcaaaatattgcctgttggtttctgttcactggaaaattataaatgttgatcattttgttttacacaatgcctgtgccaagtcttcctattgtcttcctcaaggcctctaacttgccaggttttagctatcagtgatattagtaagaatctttttggtcttggccgtgatggaagtctgaaaaacagcatttggcaagggaatgacccaaacagaataattttctatagacaaaatgtgtttaagttgatgaatgaaagatgtgaatgctcatgctaggagaaggggaaaagcattggtatttcccttaaagagaccataccagggtattttatttcctgcaagtggtttaattttgtacattgcttctctgctcacagaatgttctctgtctgtcataataaaggagagccttttcattgaaatagacctctgaatctgttttagcgactgcagtgacagtctgtatgtatctgaaagaatgagaggcataagacacctacacatgttcacatctagggtagtattttcaaaaaatggagttactttgaatccccgatcgtctctttcttttactcaatttcaagttaatatctaatgtaaaacttttataaatagcaaagagacttatacttctctagctttgcaatatttagtcttgctttttcttgttggcacggtgtgccctttaccaaatgatccatccaggtgattgatactaaaacatctcattgatttcaagtttacgtgtctagatattagatcctagaaatgagttgttaataaatatcagctttacatcaagagtttaacagaaacatattcctgaacaaatttccattgccttctaaaagggttatttcttggtctgcagagctgctaatctgtaggttgcattcagtctaggctatcagaatagggcaccccatgggacttgatgatagtattgtcacttagatggcaaacaaggcatgaaataccttttcatagaactaaacaccctcaaatggggacatgaaaccctgtacctctgggcacagtcaaaagttgctgtattaagtcatgtgtttccggtacttctgggctcattaacccacaggttgtttcttgctcccagggatcattctttttggtccaaaactaaataaaaaaaatagatagatcttatggattgatgtgaatgttgaaacagaagctctactactaaaatagtggttcataattaataatcccttgatctttactttgtttttttcctaaggggcagataagaaagcaagtacaaagcaaacttaacactttggcagaatgtaatgtatctgactttctaaaattctgtatgccagaataactggctgtttcccattccttgctcttgatatacagccaacagcctagccaggagccatgtcgaaaaggaggggaggcactcagggcagtggtttttcatggcctcattctttatagtacaatagttagtgtcccactattgtacttgtggaatgactctgaaattgtcacaccatttatgtgtaagaattgctacttctctttatttctccaattcaagcttaagttttcctgaagtttccccaccttctggagtggcaggaaatttagcaatttccttttctcataatggagctatatatggttccccagctagccacgacagaaaaacgtcgggatgaggatggttcttcagtcatggtggagacatattttctgtgggtcttttggctgtagtgctttgggccatgccctgtgttgtctgtttgaagtactcccactccaggtgtgttcagtgatgtgtggtcagcaacgctccctctgaccacgagacagcttctgcaaacatcttctccatcctgtgtgcggcatgaagccagagcactggactgtgctaccttgatatttgctgtgggttgaattgagtcccccaaaaggatatgtcaaagaagtcctaatcccttgttcctgtgagtgtgaccttatttggaaggaggttctttgcagatgtgattaaaatggaagctaagatggggccattcataagatggagagtattgtgggtcctcaatccaatatgactggtgttctcaaaagaaaagaaggtaaacacagagacaggcacagagaagagagtgccatgagaagatatggacacacacagggaaaaatgccacgtgaaggcagagacagaggctggagtgatgcatctacaagccaagatatgccaaggatcactggcgacatcagaagctaagagaaagtaatggaaccaattctggagctttcagagagagcattgctctgctcatgtcttgatttgagacttctggtctccagaactgtgaaaaataaatttctgttgttttaaaccacccagtttgttatggcaaaccctaggaatataatatagttcccttctgccctggtatagttccttacatctttctcacccaaagacgtgactaggatcatttaacctaattcccctctgttgagtatttgagaacataatgagaaccttcctaggactggagaagataaagaaaatgctacttcaattttatatttttcttgttatctcaccctgctaagcttacattttcaggaggcaagtaggtattgacagttcccaaggtcaaacttcctggcctcctgactttgttcactctggcatattcttcatgtagaatgtctcttagaacacaggcttttcaattattttcagtaaatgtttactgagtacctcccatgtgcaaggcaatgggaaaagatagtctagatagtcttagtcttcaatgagccaacaatccagagcgacatatagagttatgtaaatatatttaccaagtgttagaggagatcggtgaaggtgtgaatagtttttataaggcaaaaggagtggtggtgtcataaaaatctttacctctaagggttattttgaactgtgtcttcaaggatagggaagattatatcaggccaattaggcaaggacatcataggacaagggaatattatgataaattacatggtaggtttgaaaagaggggttggcatgcatgattaaattataggtggggtgaaaaaatggtagtaagtgagaaaaaggtgaattaagatcaaattgtgaaaaatttgtgagtgcctacaatgggccaggtcctcagctaattatttttaatacattgtcttgtcaggtctgagaggtaaatagttgcattacatagtggataaacctgaaaataaaatgacatgagtaatttgttcaagaaattcagatggcaggtagtcaaggccagagttcaagcttggcataagtcccaagcccctgttcttctctgtacaccttgctgcaaaagtaaatggggaatgcttcagggctcttgagaaaggtagtggcaatgggttggcccaggtggaggattcactggactttagaggttatatgcagagggctgtggcaaaacaggaagaaggtgatttgggatttaaaaagaggaatcctgttggaaaggaggggccatatgtacttaggtttgatgatcaattaattgattgatggttgaagggaataagaaaatagtgcaatgactgtaaggttctttgtttgagtaatgatttgaggatggtgccattaccccaaggtgaattagagacaggaacaacacgttcttgggaaaagataatgagttcgtttttagcttctttaagttttaagcgcctggtagaagatgtccagcagaacattctaaattttggcctggagttcgggagggaagttggggccagagatccatttgtgatttatcaacatggtaggacagccagtgacttttactgaaatacaagtctcatttctgacattccattgcccaagttcctgcaatgattacatgaagctattagggaataaaaaaagacccacgttcttaacatgactttgaggtattgtttgatctgggcctgcctgtgtctccagcctcattttgaggtatattctccttctgtatttcagttctcaaatgtatatgtgaaggtcctttctgacccagttgcccgataccagaatgccttcccaacatacatacacatctgtacacaaatgcatgtgttcacaccaacacacatgtgcaaatctgcacacatacatgcacatctgcacaagcaatagacacatgttcatatgtgtacacatgtgcacacatatgaatagattcatgtgtacacatgtgcacataaatacccatgcctgcacatgcacagatgtgcacatttcatccagtaattccaactaattcctcagattctcatctgaaacgtttttgttatcagggaagtcttctgtgacctcacagtcaaacaagtttccctgttccttctatgccatagcacttattaaattgtgttgagtatttagttttctgtcttattagaatggaagttccatgtcaataggacatgtggaaacatccacatatttcccttcctctggcactctacatggcaaaagtgggcagtagtctttgtatactacaggcacacatgaatgaattcatagacgaatggatgaatgagttaatgaggctatgagtatagatgagatatagtaaacaggtagggggaacacagggcacaggaatatcctccccactccacagtggacttccagcccactcgttctcttctatgataaagactatgactctggtaaactttgaagtctttctttctaacttcttgacctctaaaaggaagttggagttttcattaatgccgtgggtcaggctctgtggaaaatacaagaggaaaaccagacagtcctttctattagtgtctgaattatctcattaattgataccaatgttgaggtaatcaacttctcattaagacttctcattagatggctatttctctcttttaccttctggcagggagtttagagcatttaatcatcactttcctatttatcacttaaaggaaattcacctttcccccagttatcacatcctaatttttctggggtttgtaaaattttaatcttatgatagggcttttttttttttcctttgggtaagcctttagcaattgctatatccaacatttcaaagaagctgtgttttagtggactgaggaatttactcatcaagattttattttgccaacactcattcattgtatggaataataattcggcagttttcatgatatttcatgtctgggcccagttgctcctttggccagaatacactgagactgaaatagcagtttatttcttgcttaagtaatatggttttcttgtgaccaaaagcataggaacattttatttcaccccagacagacacttctcaggtttgtgattttaattataacaaaaactggatgaaaagaatgacttgatcatggcatagatatgccaccatcagaaaaaataatccacagacagatcaatagtatcgttttcatttatgaatactattttaatgtcttatgcacaggtattatctctacaaaccatctcaagccaaaaaaagaacttcttcagtcacacgtgaattgtctacctttccataaaaatgttctgtcaagagctttctgcataaaagagtaaaaattttcaaataacttgtaattttttattttacacaaaatatctgggctaaagaaagtacattaaagcaacttgcatctcaaaacaatacatttctctggttgaagttttagtgaaaatcgatttattcctcctctgagttttacccaatgggtaaagttgtctaaatatgggattccttagaatccatcctccttcccaagcatttccccatgtttccttccacccccaaattcttaccccatttcaggcagagctgagcaaacataagccttctctgaagtattgagggaaagtctgctaaacggctaaactacttaaggagctaacagaaaaggttgtatcagagaaacagtggagaaacacaggtttctaattatatctggcactggagagaatgtcaaaggtactgggcctggggcaggttcacaagagtgaaagtaagagatttaaaataggttctcaactcctgataaaaacacgaatatttatttatttagtctagcttttctttcttctcttatcgttatgattattattactactactacttttctgacttttcttttcctaacctactagtgtttaaacctcccgaagacagaggtcagttctgctttgatcaccactatatactcaacaattaacatatattgggtgccgagtaactgcagagagactgttctctatagttttaaacgttttgaattaatctctccctattctgtcttctagcctcttttcttccccttcagtatggtagcatagactgtcttttccatgttcttgaggtcagtacatttcaggattataatctctcagatagtataatatcagctcataatcttccaacaaaatggccttggatgacggtaggtagcaggatgaagagagtctgcttggactgaaacccaattcaagagttggaacccatgttggcagtatagatgttttatcttgataatatttctttctttcaatgaaatgaaaaagaataagccagaagaactgctttacccaagcccagattcttcaaatgtgctttctcttgattcctgtaggaagacactgaacagaattctgcatttctaagaataaaaaagaaaaaaaagttaagtgcattaaaaaaagagcaaaacaaagaaaaaattaccaaactaataaaatagtacagttggactacaccaaagggaattttcatttgattctacataattacttcaccttactctcctctggacacatcatataatttaaatgaacaaattttaaaaagtatctttctaaaatagccattaatttggggactattatataaattttaccataattgattgtgtttagtacttccctatacagaacattcttttaataagatgactgaaaggcttataaaattcaccaaatagaatctctttatgcatgataactggtggtttcaagcaaaagtatataggagtgaatatttaaaatgaaaacaaccagttaatgaagtatattttgctatttatttccaaataaaaacaagccttggtgtctaagacttagttaactaatttgtgattttttaaaaaaagtatagatgaaaaggtagctaggtagaaatagaaatagcttagaaggctagatacacagatggcttccttatgcagatttaggaagcaaagtaaatttatactaactaaagaatatgaaaggtaaatgacaagctctatgtatcatgactgactatgctaattatagcttataatattctgctggacctaagagccctcctcagctaaaaaacaccataaagttcatttaatacaaccttcatattttactgatgagggtactcaggacttgagagagtagagagcagacacacctacttcctaaagccagtagtgtggtcttctttgaggacattgaagttgagacatgaaggctgagaagtggctgatcatgtgatgagtatgtgaactttgagggggattaatgcttggcagagggtgaaagtggcatcaacaaaattggtaaggcaactggccagactgccagcatcgaaggccatagtaagcaattaagatataattccaaaagctatggaaacattggtgggttttaactgagggaatgatgtaatctgatttatattttgaaagggtactctggttgctttatgaaacacggattgtaagggagggagctagagaggaaaagggaagattacttagaaggcttttaatagggaggttaggagaaagtggaaatattggatgtattttttgggtagtgctaacaacatttgccagtggttcttggatagggaggtagagagagaattaatagaaagggaggaattgagggcatctactttctttttgacttgaaaggctgagtagatgatggtagtgtttgccgagatggagaagactggggtagaaacagaaatatgttttaggttagtatttatattttatttgacttgtattgcctaatccaagtaaaaaaagattaatcctcacctagagccaaatatatattttattttagtcaggaccaatataaatgtgccaaaggaaatgattaaatatggttagtatctattccctatatagtaaacaaaataataatttaattttcacagtggtcagaggccatcttaggaactatatgtgaaggtagaatttgtgaacagggaaggagtagtagctacgtgtcactgtgttttatatgataagtgtgtatatgtatattaatgtgtatggggacagaatgtccctatgaacttaggaaagtgaattcccttgggttagaagacaatgtaaggtagccctgtattttcaagggtgatttttagaaaatcctaatcatttttcctgaagtactttgtgtgaatactcatgaaattatagacagaccaattctcttttgcttagaatgaaaatcatctgttatgccttcatcatcagtgaatgttttgggaacttcaagactatatccatcatccagagttttggcacacacacaaaaacatcgtttgtgctagccttggactttgctacctgacaaatatagtaaagcactcaatggagaaccatacattagctggatatgtaggacatcaaacttaaatgttatgtaatagctatgaagggcacagtttctcttatagttttaaacattaaggagtactgtctgaaacttgaaacttaaaattaaaactagtaaatggcactcttaaactgtccacatccatggtaatcacagttcaatacagcatacttttttgaatgccaccaaatggaataaaatttttcctaaaatgaatgaactctctgcttctagtttaatatagcataacaatacatacatactcaaaaataacttgaagggagaaagaaatttttcctttctagaagaaggggaggcaatttgtgatgcacagtagagggaggagaaatgagagaattaaattttttacgctgctgtcagaaaactgggagaaagcttaaagagaactaatggggagatatcattagagaaaacaaaaactcaaactaaatctctaaatggttgagttggacagcattggagcactcatttcccttgtaatcactctaaaaaataggctactgtctacgatagataatatgacaatttctgttcaggtagagcgtactatttcaatgtccaaagacgttattcttttaagtaatagatgttcagtgaatgttacattggtttttaatggactttccccagttggttgcttatttcctgatatttttatgttgtgtattcagaagagtgtggactggcttcagctaatcctcataaattgtctatccattagcagatttaaactggacttggggctgccatgtttgtggattcagaagtagccttatcaatcaattagccttatcttcttgtaagtttgatgattcactaatcaaacttagaagaactagataattctatttctaatgtttttatttgttgtattctgtagacaaatatttcagaataattttctccaaaagcctgagtaaacaaaggaaaaattttcagcaaaggcagaaaagtttaaaaacttggcaaggaataactcagtatgacaatattggtgaaccttccttttattgtcatacatgaaggaaatgaatatttaaacagattttttccaggcttgtggggatttggcaaccccaggctctgtctgtgataagatcttactggcctgagagtcctgcctagattcattaagaatttctttctgtctctctctttcatacattatatatttttcaggtgaccattttagcaattgtacaagctatttttaatattaaattatgtagcctcagctgcttataaggagagtttaaggagaatattagacatatttataagtatcgtttgtcatgcaagggctaattaaccttgaaaataagcattggcctaccttcccagtacctacaataaagcacactaggccaaatctctatgaggcggtagttttctatttaaaaaataataataataaggtataaaaagttactaacaaccatgcacttgttcccctcaacttaaaagttaaaaaaattagaaaagaaaggcaacatggctaataagatatgtaaattaaaaatttcctactcttctttcatttgtcactatgttttgtttgtaggtagattcaaagaataccatacttgtcatagacaattatttgtattatgttatattattttaatttactcagatctgttgcaatgggaaaaaaattcaggaaaaacaataactatcaataataaatataaaagcatgcattttcgtaacagaaaaactgaagagagttaagacacattgtacgttccaagagggttggaagaacacacataagaaactacaaagagcatctgcgagacggcttgtgtgaactgatggtgtgggccaaccttcaaattgcactgtcctctacaggtcctttctagatccattcctttatcatctcaaatgatgtgcagtaataatgctgcttgcagaatgaactgaattatcatctaccaactaggatgtgagttccatgaggacaccactgtcacttttgtctttttattcattgctttgttccaaaagcttagaatggtgcataccatgtagtagaaacttaataaatacttgctaaatagatggatgcatttggcatttgctgttttgatgacaagtaatatggtctatagtttagttaatatgatgcattaaggtcaactgcctggtttggatcattgttctatagttatgtaaatgttaacatgaggaaaagatgaataaagggtcctgggaattcactatttttgcaagtcttctttcaatgagaaattattattttatttatttatttatttatttatttatttatttttttattttttgagacggagtctcgatcagtcgcccaggctggagtgcagtggtgtgatcttggctcactgcaaactgcacctcccaggttcatgccattctcctgcctcagcctcccaaatagctgggactacaggcacccgccaccacacctggctaattttttgttcttttagtagagatggggtttcaccgtgttagccaggatggtcttgatctcctgacctcgtggtctgcccgcctcggcctcccaaagtgctgggagtacaggcgtgagccactgtgcctagccagaaattattttttaaaaagttttttgggaaattgagaatggagaagggaaaaaggagtaaggacatgaaaggctgaggaccattgactctggaatagtgcaggaagacaaggtatgggcaagaaagagctgatgtgagtgctggcaatttgcctctggaaggccaaatagcatttgactactactcaatctttttggaaaatcttgaattaaaatctcaaatactcactgtccactgtgaaatttcaatttcatcagtattcttttacctgtgctgcttttatctatctgctgatggctgctagtgctagctgcacaaagccctgagttctagaccttctctccctgcttaaagtttattaacaagggctgggcacagtggctcatgcctgtaatcccagcaccttgggaggccgaggcgggcagatcacctgaggtcaggagttcaagaccagcctggtcaacatggtgaaaccccatctctactaaaaatacaaaaattagccaggcgtggtgatgcatgatatagtcccagctaatcgggagactgaggcaggagaatctcttaaacctgggaggtggacgttgcagtgagctgagatcgcaccgtggcactccagcctgggtgatagagagactccatctcaaaaaaaaaaaaaaaagtttattagcaagtataaatgtatcagaacttaacaggtcaatttcttgtattattgtgagactaaaaaaaattgggaaaaaaggaaagctttgaagagaaaaaaatgggtagccatcagaatcattttgtgaaaggaacaaatactaataagttaatctattgttctcaacaacctgttatccataataggaaaggaatccagtatgtgcatgactaagttaactactcaaaactttcaaaaccagaagccaaaagaagttatagtttattttaagcaatatccacaaaacctaatatagtccacttctgagtaatcatttaattatggtattctatcattttatttttaaaaaatatgctgagtacataaacatgactaaaatatcaacacattctttcttcctacacataactattaatcttaaatgttccaagagaagatgtttaaaaagtaaccctttgcagaactagcccttctctctggagctgtaggcctctcttcttcccagccccctccttttcttttcttttatcttactcgtcaccttgcagtcatgagtattgtagcatgtaggagtggactgctgagagaagggaagaaggatgcattttgcattcacttgtacatcagccttgaagcctggctggcggcaatattgtggacaatagatctttcaaacaaatagacccttgtctgttccttccttctgtaattgttggcagagttctttgttatgtgtctggtttcttgaaactttgaatgaataaactaggacacgggattaatgtaaagaactggcatctttgctgacttattcaacagactgtgtgtacatagaaaagagaaataagcactttcagaagtgttgtctgcacatgcctgggattttacaaaatttaaacaatgtgaaatgcagtaccttgaaaaaagccaggctagtctctggactctgtagtttactttctaaataaaaaatatcctattgaccataagcaaatgaacaattcacctgttagcatatggaccaaatataggccaagatatgtagtggtagagttacaagtaaattttttgatgtgaagtgtcatagaatttacagccaaatgaagtgagtacctctttgtagcagggtaatgatgaaaaagattaggcaaagtttaaagttgagacgcagttttcctacctggagagaatggacattgttacctaaaattcacattgtacaatggagtgatacatgagttgttcacagtagaccgacctttctcagcctcagctctgttgacattttcaaataacaacttgctgttagggactgttctgcacattgtaggatgtttagcaccattcctatcttatgcctgctagataccagcagcactccccttccaattgtgcaaataaaaaatgtctccagacattgccaaatgtcctctggaagtcaaaaaagcattcctggttgagaatcattgtactagaccaaggaatggatcatattgaccagaaggaagttgtatattattaaaaaaaattatccaactccagaagaagtatactggggcagtctaacttggggaccttttgaatgtctccaccatgggaacaaaggctaagtaaagcagtggcccattgctcagtccaacagcactcctccatcaattaccccctcttgactttttgtgtctttagtctcttaatcggcctcgacttcttttccttgacctttaaattgtctcctttatcctaaagcaaatcaaaattactcctgataatgcaaaggtataaaattactatgatgtcttcacatcactactaacttttttgaaaagtagtcttcattctctacctctacttcctcactgtctactttctggaatacatcccagtttggttttttccccctatgtcactacttaaagtggctgcccaaatgctacaatccaacttctcaatgatcacattaactgaactttttgtgtacttatctttgacttccatgcaacttttgatactcttaatcaatggttctgaaactttttttgtgcatcaggatcactggtgagttattaatagttaaaatacagatttctgaattcaacacccagagttcctaattccgtcgggctaggatgtagactgaggatttgcatttctaacgagttcccagatactgtccacgctgctagtctgggggatcacaaatcaagagccatgccttgattattctcttcttgagtgcttcagttgacttttacaataccatagtttcctgatcttgacgcttaatgacatttgtagtcacattttctggtttcttctaccctttttctctaaaacagggcaatgttgcccctcagagaacattggtcaatgtctggagatgtgtttagttatcacaaataactaggaggaggggaagaaggaagagaagagggtccactgctactgatgtctagtgggtagaggccaggggtgctgctaaacatcctacagggcacaggacagtattattcacaggacaaagtattattcgtctcaatatgtgaatactgccaagatagagaaacactgctctggatgcaggcattctctccaagtagatatatattctttttttttgttatgagacagggtctcactctgtcacctaggctagagtgcagtagcacaatcatagctcactgcagcctccaggaatcgagacctgttgatattttagtcatgtttatgtactcagcatatttttttaaaataatatgataaaataccataattaaatgattactcaaaagtggtctactatattaggttttgtgtatattacttaaaataaactatcacttctttaggcttctggttttgaaagttttgagtagttaacttagtcatgcacatactggattcctttcctattatggataacaggttgttgagaacaacctggtcaatattttggagagatgaggacttgctatgttgctcaggctggaatcaaactcctgggctcaagcgatgctcccacctcagtctcccaaagtgctgagattacaggtgtgagccatggcacccagcaaagaatggcctttttatcttctcttcagtctatacctctctcttgtcgacctcagacatgcccagcacttcaactctcacacgtctctggaaatgactcccagaggtattatctttaaatacgacattactcttgggtctggcctgaatttgcaactgcctgataaatataagcttaatgagccaccggcatcttaagtttaagatgcgcaaactaggccaggcacggtggctcacgcctgtaatcccagcactttgggaggccacagagggcgaatcacctgaggtcaggattttgagaccagcctgaccaacatggagaaaccccgtctctactaaaaatacaaaattagacagacgtggtggcacatgcctgtaatcccagctacttgggaggctgaggcaggagaatcgcttgaacctgggagacggaggctgcggtcagccgagattgcgccattgcactccagcctgggcaagaagaacgaaactctgtctcaaaaaaaaaaaaaaaagaaaaaaagcccaaactaaacatatccttccagtaagagaatcctttattgccagtaatggtaattatttgataaggtgtgtctctacccccttttgaccttcataacttgtaaaaatggtacaagatgattcttttaagaaaagtataaaatcacatgtatggttcagaaataccactctggcaggaatttgaggaggtgacagatattcaagaaaattgaaagagaaactttccattccatgtgagattatctaacttttgattggccagggagaaatgtgtcttattattccaagtgaaagtaaatgtatctgcctgcctagatctcagcctagtattgattggagaaaatactgatctgatgctttatgcttcgagaaagaaagcatattgagtatatgatcttctcacacatatgatcagtcttttcattagatttgttttaccgtgatgtattttgttcctcaatagaatgccatgtatatgattgttactggtactcatagtaaatctaataatatccaccattttcagagcacttactaagtgtcagaacaagtgctttgcatgccatcttatgtatactaagcctatggggtagattttattattgtacccattatgcacccatggaagctaaagactagagagaatgagggatacacgcaaggtcacctagatcacaactggtataattaggatttgaagacaggctgtttgacacctaagctgatacttccaaagactattccaatagcacaaaattcaattgctgtggggacatggttctcagaacctggtcttcttgaatcactagaccgatcctcctcagaatttaagacctgggtggaaagggaaagaccatccagctcaccccatgtgcctctcaggaatggtgggggttgtcctccattactgaaagaagcagtacagccggctaatggatggagacacaggggagagattttctttgtgggagttcattacagaggcatctgcagacctctaactctctcctgcatgccctttctctttcatagcttccatctctaagctgtaatggatgcaaaattactgcagcattttgttctgccgggctgaccccattacgcatacaccacagtcataaagctctggcttagttactgtttgcatgttcaagactactctgaggcagggaggtgtgaagtttggctacattttcaaacagagtggatgccttcttcattttaaaaacaaggaatccagcctcctttcagagtgaatattgttttgattactgctggactaatccatacttatttaccccttaatgatgatgtttctctggtgtgtgaagggtctttaaataaatgttagggcagtgatgccaggaagtcatcatttcacatgcattagttgcagaagtttgggagacttcatttccaccccaacatcctgttgtcttgataatattttattaagacatagcaaaagatatagcagggtcgttagataatggttaataaaatataagagtttggaaaggtagtgattctcaaaagttattctcagtcttccttcttctccatgccttgtcaaagatttctgcaactttcatctcaccacatctggtgagaatacttatcagagaaagtgagcaaactggttttggtaataattgacatacctttatctactaggagattctgattttaattcattcagtaaaaaaatattctgtttgttctatgcacatttctaacacttgagacatattcaagaataagacacacatagtccttgtcctacagcttacattctggtaatatttgtcagaaagcagtcacatgattatgaaaaggttacccaaatttctgtatattctatagtttatcctatatcttcttccactatttcacacatttcataaaagatctcaacatataaatattgcttttagcctgtgatattgtctccatggagggaaggactcagatggaaataaggtatcacagaagggtgcagagtgccttttcttttaaagtaattgcaaaaataggagttatattggttatcagaacatgtttgtatttcattattaagctggtaaaaagaaccatggatatatggacatgttctggatcctagatacttaatagaaatgatcactagctgtccctaaaggatttttattatacttcctaaaagcatggactatctcttctgaggtatgccccccaaaatgtcagtagcaataaatttgtaagaacatttttaaggcagcacagacaagtgtgatcggtagaagtcatggtgagtgggagtgaggaagggctagtagcaaacaagaaaaagaaaagaaaaaaaagcattttcagtctttggcagcacttctgtctcttccagcatttgtcagaatccagttattaacctgtcagcctcagacagattgaaggagacaccacctttcaaggtgagcccttaagaaaagaaaaataagaaacagtcattgttggggttgacagagacatgatcccaccaaggcctgggctatgcttggagaggaaatgatactcaagcctgagtgtgtgcttaggggtcaagagattaggcttaggggagtagggatatggaagtagtgatagcagtgaataaggaaagctatctgtttgaatttgcttgtgcaaagaggcagaaccatttcaaagatacagggtgcagattttagtgaagatgttagagctgacccctgctgggactgtggcatttcagtagaggaatggtgaatcccttcccagtggggaacacacatcatccacatacatgagggaaaaaaaaaaaaaaaaggaatgactctttttatcaacaaaagcatgcccttatctatgattgtggtgtcattttcttttaacaaacaaggatagtttttaaccttagtttgctcacaaaagcttcagcaaaaaacaagggacatcaaatatttctggatttccatgttctgggcacatagtagggctgtgccttctgaaacttcctgtatagaatggagccacatgatcatttgcaatcaatgagctgtgaaggggaatggcatgtgttccttacaggccaagcatttaagtgttgatgtgagagtcctcagagcacttttttttcttttgcctttgtcatggtgccatggctaccagcaactttcagacagtggccattgcatcaacctcaaccctgaagtgaggaaccgtggcaacatgcaggcaagcctcaagcccgcccacagtagacaaacatatacctttattgttataaaccattttggacttgtttgttactgcagcataatctggctcttatagtggacacatttggttagatacaagtgtaagaagttttattttccttgatgaatagtgggaaagtgtgtatataatattgtaaaccttttttagcacccaaattaacacccctatgtacccaaagtcctatatctgggctgcagtatccccaaagacattttgtttgttttattttagtcctgtaagaattaaagtcaactttttaaaaaaatgcagtgctaagagagacacgacaaaattgagacaatttattagcggattctttcttttctgaggggtctttttgcatgtaggagcagtcattaccatctgtaaggtgtctaaagctcaatttatttaaatcatatatctgaagaccaaaacttttaaaacccaaattttgtttttaaaactttataaaagatggtaaattcctcttcaaaatttaaacttcaactccaaatttagtatgggtgatttctcataacatttcaaataccttttaaaatacataccttttatacttaaacttaaatctatagtaaattatgagtttggttcattttatcattatatctctatgtgtttttgtattttctgaggattatattagattaataccaatgaatctattaaatagttgttgcttctctaatatgaatcaaatctaagctgctgatcaggctgaggtgttgtttttaaatcattaaatttatttattgtgtcaagacataattgcctttcccaaaaagtctaaatgttttcctataatttgctgtctctccacaagtaatacatttttaaaagccatacttggtgagattatatgatccttgttcattattaaatattgccttttatttaacactattaaaaagatatattcttataaacagcttatttaaagtcaggaaccatctggaagtttcatctcccaaaagatgagatgaatccaaatagttctttctctttctagcatgtcaaactaatgtgtcatcctagaatgcatctctgagccccatttcactaggttattaggtgtgaagcccagatctagaccaagcctgtctgctcttggtaagcctctttctttttttcattttttctaatactgtttgatgtatttcctgttatttttatttactgttttctacttatccaatagtaacatggccatgcctatactttattactttgtaaacaagtacctaagtaacagctaaactaaaacatacatgttcatatattttagcattcccctaatcattgaaatcaataacaattcaatatactctattgtattcatatttattttatattaccactatgttttatgtaataatattctgtatattaacttttctgagcatcactatgactttttcacaaacttagcttgttttaatcaacagtaaaaatgaagagtgatgttgttgttagcaatcttatttagtgttcaaattattatcaaatggccagcgagatctcttttaaatgggctccttattctttcagcactttatttgatatttgtggccacatacttgtattttgcaataaaaaaaaatttagattctttgcaattattttcttccgctaagcagaaaatcaacaaaattccagagaaccttgtgcaaatgagtgttgattgtggccatggtgcacctgcactttaagtaataacaaagctgaaaaatatatttcttttagaggtcatgagttcacactgagaagtgtgaactcctcatgagttccatgagaagggcataactttaggtaatttcttgtaagctcattgccactatgtaaaccagcttatgattcttatctagttggtcagtatactataaatatcagtgaatattcagaatagaagctgatagaaaaatcaaaccatagaaaagcagggagagtgtgagaatatattcaccatgtgtacatatatgcccctaaacaaaagcctgaaagtatctactctaaaattgatttatcctcctcactatcctttttaaattttttatattattcaccttttcttctttgaacatattttatttttgtaatgagaatgcaaagatgttaaattttttaaataactaaagaaaccgttccagcaggaaatagcactatgtgttgttcaacatacatagtgaatcttgcatacacagcatattaataaaatctcaaaaattgcttactctttacaagtaggagatattttgctttttgtgtccatactttccctttagaatgaggaggattctaagtaatcttattgtatcacatttctacttcattgcattgctctctaggggggaaattaacagcagaagacttgtcacttgagttctattcatgaccactctactctgagcattacagatggaatgcagcaaagaggagatacaattctaggggaatatgggcccatagatctttcaaaacaaagaagaaaagctttctcacaattgctatagcaaataatgctttccactgctttagagtcatcactgtaagaacatttgatccacaagtgaagaacaggactatattccatgtggcttttcaaggcgactgagagcacctgctccctagaatccttcagccacattgatatgtgtgtcataaaactgtgagatcatgatcccattgatgtgatatgaatcaagaaagccatatgctctttgctggtataaatgatagctgcatgagggcttaccaataagtgaggaatgaaatttgaattttggaaagaagtttgtagctacatgaataccttgcagcctctcttttcaatagtctcaacatttttactgccatgcgatttcttctatagctccatttatatccaacttaaatttcactctaaacattttcattttttattttttattagacaattctcttttgattatctcgttttataaaatggcacatgggtttatcacttggagacaaagaagcaataccctatatgctgtgtgtgaactgagcaatacgttcagtgaccattaactgacagacttcacaagaactcatgagattggtcaatgatcacgaagtgcatctgtaattcatgtagctaatgtggactgaagaactaagagcaaaacatacacttcgtgcaaatacccacagttaatatagcatagaaacagaaatttaagctctgttgttagaaggctggagttatgaaccaaaccatagtaactaaaattcatgcatattacaaccaagcaaaatgcagactacctgtgtgtatatgtacatttagtatttttttgtttgtttgtttttaactttgtagcttcagcacaccatgccacaaactttgtgccttataataccttggctgaatatcttctcagaggatgatcattcacttttacctttgtttgccaacttattccactgcggctctttttgtcttgcaatgcattctgtgtactggtgaagaagttttgaccacgaatagctgacaaatatgtgcaggtggtcatgcacagaagcagaaagaaaattcctctgtggttgttaacgtgaaggttttccaggggcttggggcactggttaaggaaacagattaatgagcagcaaacaggaattgatgggagtcctctgacattttgaggatatccctacacatcactgcaggctgagggaagcttggctgaaagaaactggccagaggcatgttctgactttggctgacttggaaagaatggcagtgctattaacaatgtacacatagtgggagaatttcctctcagtggaatgatgctttaatggtcccatataatgctaatgccattagcactctcatttccagatactacatgggatacataagtagaagagttaggaatcgttttctgaaaagacattctaatattatttggatattaaataaaaataaatacctctgttaagatattcagacccagtattagtgtaagtgggtacagtagaaagaggccttaacttggaatatgtagtgattaggtttaactcacagccctgccaattattagctgtgtttgcccattcatttattcatacatttgtatacattcttttattttcttacaaatctttaccaagtgcctattacgtgccagatcccacaccaggctttacgcagtcagggtcaaatcacttcacctcttcaagtttctcacctgtaaaattctgagacttttttgaaatctattttttaaaaaatacatacttgattcaaacagcagctttataatttgaaaacctctattttactcctgtttttctttggaggccaaaggtgactctaaataatttcatgaaagtaatgaaaatataatctttagtgattaacttcagaattaagagagtaaaaagtatttttcaattcatcttcagcttatgccatcacctcagcaagaacaatgagtgtgcaacaattcactgttttgtaggatgctaattagagggtagactcctcatggaaaaagcccaagcctctggttgactcctgtccatccagatggagctacaatgaaatgattttctatggctgtgtgtgcgtgtgtgtgtgcgcgcgtgtgtgcgtgcgcgcacacacacacacaagcctgggaaggaagagccccccactctgtccattattcaactcaatgtttactgtcaagatgagttttccaatttccattgtttcccctaaattgagtctctcacatagagtttagagctggtatgtctgctaggaaatagctatataataaaacatccatataatagcactataattcatccagttattcattccttccctgaaaaataggacctaaaatgcatcattgtgtgtaggtttcaattaaattcagaggacagttattgactgactactgcatgcaagctggctggactgagagtattgagatggataagaaactgtcccctctcaaggagcttaaaatctagaggaaagagaggtgtataaaatatataattgaaaatgtttgctgtaatttctaagagaacacacctggggatgtgaaaatggacagaagggaggatttagctctatcttggaggctgggatataagtcagggaaagcatttcagtggagattacgcttaaagtgggagtactgtatacatgaataagcagagcaggccaggtaagcaaagttgtggttggggaaagatgcattccagacagccagaatgttttgcctcattggaagattgtttttctcacccttagcaccctctgcttattcgtctctttgtttttaaccatttctaagttgtatcttaagactctaatcaatgtaatgggatggctgtatccctccccactccatcccatatcacaccaccgaatgagcaacaaatcttggcgtctgaaaaatgtagcacctgacgccaatcaaaacttctgctcacagctctaatgtaggtctgggggcttttctgtgttacttgaaactagtattgattgcatcagcgctcaatataatgccccagtagtcatccttgctgctttagctgaggaacaaaaggtaaaatcaagctaaatgaaatgaggtaaatgtaggaccagaaaaaccagaagtcttcattgcctgctctcaggcatcatcaaaacaaaaggctctctggctggcaaggtcagtaagggagacgagagaggataggaatactcagagacaatatgttgccctgctaagagcaggtcatggtccttaatgtaagccatgtcatttgcttacagtctttattatttaatctctgacagatggaaattggttgagaacaggtaatggtacagagtcttctgtgtgtgcttgcatgccagtgagatctactgggagaattaacttctactctcccagcacaatcggtggtcattttgagtgaccacatcatttatctccaaaccaggacaccttggagaacacaagaggatactgttaaataaacgtgagtgtataataaacacacagtgggacttccccaggcaaacagggactcttaggggatgtatgatcaccttaacatgttttctgtctggagggaaatttccaaggagaaatataagtaatacctggaacatgactctagaggtaggctaagactgcagggtattaatcaatgtataagtttataagtttataagcatgtgaaaacttcaaatttcagcaatgattctctaaattttttgctgagacagataaaatagctgtttttttttctcacacagagtacattctcataggaatatctgaattacatgcagttcctagaaagcaagctataattacattattcaagaaaacactgcagttcaggctaatgtttttgtatatttgttttgtacattttgtacatgtttttgtaatgtgtttatacatatgtacatagaaggctttacatttggtgatcagcatttaaattatttacgtacttaaactattacaaatacactacttggcacactctttccccagatcttcatctggctgtcccttttcatcttctagatctcgactcaacatctccttcttaggccatttctgaccactataactgatccctgtcacgttctatcataatgtccttttgccattttcttagcacttattagtgtataaaattatcttctgtatttagctgtgagctttcctcactagaatgaaagaaattatggacaatagttccacctaccttgttcagtagtacacctccagcactttgaaacctgtggggaaacaacaggtactcaacagatagttgttcattggatggactgatgggaaataggccatcttgtctttattgaacaacaacttttgcaggaagcattctcctcccttcatgatttttgtgcataggtaagcacctgcttagacaactccagttcctgctctcacacttcaccactggattgttgcaatgcagtcttaaatagccctcgaatatggactcaaccacatcttgcaacaagattgtcatcagcacccctttcactatgcttggcctctatatactttactcttagccttctcctgaattagtcttagcccagtaacatcttgtgctgatgtcagtcttctggttgaccaagtaaacgtattttttcatttcctctttttttgctcgtctttttcatctctcgctgatgattgtcaactgcaatgacaccgtacttttatacactgcatgatgtatacttactcagaatttttcttattgccaaataaattatttcatacgcttatgcaactcctttcgttaaaagcatgttttctactttgttctcattattaacagaactattttttcagttatcttactcattgcttttgcactgattggacatcacagcattcaaaatgttcacaaagtacctaaaaaattgaacacagaggcctctgtggttagggtgactgaaaaacttaactggatttttaagtcagtctaattttaattaacttaaactttttttttccatagttcagagcatttatttatttttttaaatttattattattatactttaagttttagggtacatgtgcacaatgtgcaggttagttacctatgtatacatgtgccgtgctggtgcgctgcacccactaactcgtcatctagcattaggtatatctcccaatgctatccctcccccccgccccaccccacgaccgtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtgttccatggtctatgtgtgccacattttcttaatccagtctatcattgttggacatttgggttggttccaagtctttgctgttgtgaataatgccgcaataaacatacgtgtgcatgtgtctttatagcagcatgatttatagtcctttgggtatatacccagtaatgggatggctgggtcaaatggtatttctagttctggatccctgaggaatcgccacactgacttccacaatggttgaactagtttacagtcccaccaacagtgtaaaagtcttcctatttctccacatcctctccagcacctgttgtttcctgactttttaatgattgccattgtaactggtgtgagatggtatctcattgtggttttgatttgcatttctctgttggccagtgatggtgagcattttttcatgtgttttttggctgcataaatgtcttcttttgagaagtgtctgttcatgtcctttgcccactttttgatgggattgtttgtttttttcttgtaaatttgtttgagttcattgtagattctggatattagccctttgtcagatgagtaggttgcgaaaattttctcccattttgtgggttgcccgttcactctgatcgtagtttcttttgctgtgcagaagctctttagtttaattagatcccatttgtcaattttggctttggttgccattgcttttggtgttttagacatgaagtcctcacccatgcctatgtcctgaatggtaatacctaggttttcttctagggtttttatggttttagttctaacgtttaagtctttaatccatcttgaattgatttttgtataaggtgtaaggaagggatccagtttcagctttctacatatggctagccagttttcccagcaccatttattaaacagggaatcctttccccattgcttgtttttctcaggtttgtcaaaaatcagatagttgtagatatgcggcgttatttctgagggctctgttctgttccattgatctataactctgttttggtaccagtaccatgctgttttggttaccttaggcttgtagtatagtttgaagtcaggtagtgtgatgcctccagctttgttcttttggcttaggattgacttggcgatgcaggctcttttttggttccatatgaactttaaagtagttttttccaattctgtgaagaaagtcattggtagctttatggggatggtattgaatctgtaaattaccttgggcagtatggccattttcacgatattgattcttcctaccgatgagcatggaatgttcttccatttgtttgtatcctcttttatttccttgagcagtggtttgtagttctccttgaagaggtccttcacatcccttgtaagttggattcctaagtattttattctctttgaagcaattgtgaatgggagttcactcatgatttggctctctgtttgtctgttgttggtgtataagaatgcttgtgatttttgtacattgattttgtatcctgagactttgctgaagttgcttatcagctgaaggagattttgggctgagacagtggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgtgtatattgaaccagccttgtatcccagggatgaagcccacttgatcatggtggataagctttttgatgtgctgctggattcggtttgccagtattttattgaggatttttgcatcaatgttcatcaaggatattggtctaaaattctcttttttgattgtgtctctgctgggctttggtatcaggatgatgctggcctcataaaatgagttagggaggattccctctttttctattgattggaatagtttcagaaggaatggtaccaattcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatttatccatttcttctagattttctagtttatttgcatagaagtgtttgtagtattctctgatggtagtttgtatttctgtgggatcggtggagatatcccctttatcattttttattgcgtctatttgattcttctctctttttttctttattaatcttgctagcagtctatcaattttgttgatcctttcaaaaaacgagctcctggattcattaattttttggagggttttttgtgtctctatttccttcagttctgctctgattttagttatttcttgccttcttctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatgtttatttctgccttcatttcgttatgtacccagtagtcattcaggagcagattgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtctattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatttttgttggtttaaagtctgttttatcagagactaggattgcaacccctgcctttttttgttttccatttgcttggtagatcttccttcatcctattattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctcgttattttgttcattagttgatgcagtttcttcctagtctcgatggtctttacattttggcatgattttgcagcggctggtatcagttgttcctttccatgtttagcacttccttcaggagctcttttagggcaggcctggtggtgacaaaatctctcagcatttgcttgtctgtaacgtattttatttctccttcacttatgaagcttagtttggctggatatgaaattctgggttgaaaattcttttctttaagaatgttgaatattggcccccactctcttctggcttgtagagtttctgccgagagatcagctgttagtctgatgggcttccctttgtgggtaacccgacctttctctctggctgcccttaacattttttccatcatttcaactttggtgaatctgacaattatgtgtcttggagttgctcttctcgaggagtacctttgtggcgttctctgtatttcctgaatctgaacgttgggctgccttgctagattggggaagttttcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcgcttcatttcattcacttcatcttccatcgctgataccctttcttccagttgatcgcatcggctcctgaggcttctgcattcttcacgtagttctcgagccttggctttcagctccatcagctcctttaaaaacttctctgtaatggttattctagttatatattcttctaaactttttcaaggttttcaacttctttgcctttggtttgaatttcctcccgtagctcagagtaatttgatcgtctgaagccttcttctctcagctcatcaaagtcattctccgtccagctttgttccattgctggtgaggaactgcgttcctttggaggaggagaggtgctctgctttttagagtttccagtttttctgctctgttttttccccatctttgtggttttatctacttttggtctttgatgatggtgatgtacagatgggtttttcgtgtggatgtcctttctgtttgttagttttccttctaacagacaggaccctcagctgcaggtctgttggagtacccagccgtgtgaggtgtcagtctgcccctgctggggggtgcctcccagttaggctgcttgggggtcaggggtcagggacccatttgagggggcagtctgcccgttttcagatctctagctgcatgctgggagaaccactgctctcttccaagctgtcagacagggtcatttaagtctgcagaggttactgctgtctttttgtttgtctgtgccctgcccccagaggtggagcctacagaggcaggcaggcctccttgagctgtggttggctccacccagttggagcttcctggctgctttgtttacctaagcaagcctgggcaatggcgagtgcccctcccccagccttgctgccaccttgcagtttgatctcagactgctgtgctagcaatcagagagactccgtgggcgtaggaccctctgagccaggtgtgggatataatctcctggtgtgccgttttttaagcctgtcggaaaaacacagtattcgggtgggagtgacccgattttccaggtgctgtctgtcacccctttctttgactaggaaagggaactccctgaccccttgcgcttcccgagtgaggcaatgcctcgccctgcttcagctcacgcacggtgcgtgcacccactgacctgcgcgcactgtctggcactccctagtgagatgaacctggtacctcagatggaaatgcagaaattacccgtcttctgcgttgctcacgctgggagctgtagaccagagctgttcctattccgccatcttggctcctccaacttaaacttaactttaaaaattgatattcaattcagtcactggaagacataagtatgtgtgaaactactcggatatatgaattactttttcagttgtaagttttgtgaaatgtatatacagataaaatatttctagtaaaaacagtgtcagaattgagatgtgctgtaagtataaaatacacatcaaattttgaagacttcatatgggaaataggatgtaaaatagcacatttacaattttaaattttgatcacattttgaagtaatattttgaatatattgggttaagttaaatatattattaaagttaattatacctatttctccttttttggggtggctgctagaaaatttaaaattatatatttgctttgcattatattcctcttggactgtgttggcctagatcgtttattagcttaggcaacataatgcaaatttacattaactttatttggtcttcatcatattaataataaaagcaaaacaaaacaagaaaccaccaggtgctaatagtcacaggctgagttccctaggaacagactctgagattgagtttagcatgccacataatttttaaggagttccctggggaaggaagtaggattgagcagagagaagttgagctgcgatgcaggcccaacaatgggctcagctaaccccacgaggagctctgacactaacatgacctttcagtttgtcctgagttgggccaagatggcaaagtctttctaccccatcatcaacaggtcattgaatgcgggtcactctgggaagagcatgatcttaggcaagatggtgctctgtgtctgaggccaaccctgaaggcgctggcagctgaaggctgtctatggacagcactctttgcagctcaggtcaggcagtaagtctttagttgcagggtgagctgggcagcacattacagtgtctactatactaacattttttgttgaagatttcccatgaagatattgattattgtctttttcagtttttaatcagatgcattggctaatacctgtttgtagctgaagctaagtctgtcctcttaggccatggtgtgaattgtgtgtttccctttcttccttcatctctggcttagctcctttcattaccttcatggcccctctagaagtttatgttaggtttttaaggccagaccagactgacttgagcccagccgtaattggagaccagattcaaggctctctcttggtggcaggtgacattagtcagactttattcttatctatgaaagttcataagtaagtgagcttttgtgtttttctgcttaactctcattactacctgttatctctttgaagacaagggatatgtaaaggtacatatatgtgtatagattgtgtatgtgtttgagtatgtatgtatgctttaagccttgttccaagattggtttatattagaaactaaacaaatacagcccagcacggtggctcatgcctgtaatcccagcactttgggaggccgaggcgggtggatcacgaggtcaggggatcgagactatcctggctaacatggtgaaatcctgtctctactaaaaatacaaaaaaaaaattaggtgggcgtggtggtgggcgcctgtagtcccagctactcgggaggctgaggcaggagaatggcgtgaacccaggaggtggagcttgcagtgagcagagatcgtgctgctgcactccagcttgggcgacagagcaagattccatctcaaaaaaaagaaaaaaaaaaaaaaggaaagaaaaaagaaactgaacaaatacgttatttactgaaggagtaaatatgtgtgacaaccagtggtgtcctcattccgtatctccatcttcagagaatgcttgtgtgccttcaaatttatgacattttcctctcaccccttagtggtgaagaaactgaaatattgaccccatccccaaaaattaataagttaagtgtaagtggtacctgtggtccatttgaaagggaatatctgaatggaatgggaggacagccacctattctcagcaggcagaaagggtacttgtcaacaggtaatatgggaaagctaagaaagattaagactttatttttccctatagtctgcctttctgtgttcccaattctttacactgctgtgtaatgttatggaatatgattctcaattaggaaacttgaacgaagacaaaaaaaatggtaagagactatcttctaaatatatccttagttcttcaggcagcaatttaatttcagttaaaagaaagaacaaaggcatgtcaatgttttggactgaggctaaccgaggactttcactggcactctttttagagctagaccattggggaagttgcagtgttacataatgctatgcttctcattgccatagagaagcagcagctgctttgagactttagaaaatcagcagcgacttgaactctgtgttgcttgtgtccagaaaattccaggcactttgtcaatttttttcttcattttcaaattatccttttgaggaaaatataaaggagtaatcccattatctctattttagagataattcagctgagtttcaagaggtttgttgtcttgcttcaagttgtccattagcagaacgaagaacaaaatcttgctttctgtctttcccagactgattctctattgtagcttctctttggctgttgatataatatcaaatattttgtatgtatgtgaaaaatttgaaatttcatttatttcactagtttaccaaatccctgcctttcactgctgaccaaggttagaactaatataaaactatttcctttagaatgcttagtgaatattttttgccactaaggctaaaacaccactgataatttttactctctcttgtatatgtttaaataacagaatagaaaggaatatgggaggtacatgatatggaatgagacacatcttgactaaaatattttagtttagagcaaattttctctgatcatagttattcaaaggatctgtttatttgtatgtggcatgatggtgtgtgtaacctcacaaacaaatgcagagcctgggaataagaaagatgacttatggtttcacctccaagattttgactctgaaaaagtcatagaacctctccctttcatagtttctctccctctctctttcatataaatatatatatttcacaataattacttgaataaatcctaggtacctctcctaaagagttttgaaaaataaacacatagatatgaagaaagatggcccaatataaaccaacagtggtcctactatccctgtcctctatgggcttgctaagcaataccccaaggtaactttcaagctgactttgatgtgaatgcccaggttcacgtataggagtaacatagaccactaagaggggtttcttgacaatccacagtatctctctcccccttacaaaagatagtttttaacatcaagaggacagttgttgactctcatttgaattattaaaccaaataagtggctgttaaaggagcaaagatctgaataataatcagttatcatttgcagagataattcaaatgatagctaattattgggcaggcactctacataaattatttcttttcattcctatgagatgggtactttatgaggaaagagagaggttcagagaaggcatgtcagttttctaagatcacacagctcattgttgactgagccttgacatgaaactacagctatgtttaaaaccagtgctatttctagtgtactatcctgcttccttgtaattatccaacacttttcttctttttctcctttttaaaaatcaggtagtatctgattgactttgtctttcttttttgccaagggtacactcaccaactgctgtccagagttaaatttatagtcacaaagcaagagaaaagtctttgtttccaagccaatgggctgggtttccagaggcataaatcctaggaattagtaatatcccatataaaatcactgaaggttggtgcctatggttatgtcagtggcctctatgatactccctaaaggcgtaatttattccacagtccctagacacattcgttcatgttctttgaaacagggcacacttgcctttcccagaaatttttcaaccaaacaggactaggacatagatcaaggtctgtcagcctatgctcaaagtgtcctctgcagactttgttgccactaaactagaaataatccatagtttctcctgtttccttttccgttaatgaccaactttatatacactcaaaatgaataagtgatacggtttgttcttctcctctacttctctgtttcccaaagtaatttgcaagttagaagaggaaatccattaggagaagctgaatggattaaaagataataggatttggagaacaggacccagtgaatcacaaattcattacattcacagctgacaattgctaagtcccggcctgctcctctcacaatggggccaaggtctgtgcagcatgctggtgtgcctggtgaaaggagaaaatgagcttcataaatacaaacgttagagtcaatcttatgttccccagggactgccagtactttacttggcaagaatagaaaaggaattcttaaggatataaaggcaaaaacgaacactgtaaaacacaaaccacaacaatggaaaactatagagccttgcttccaaagcttagtcatccatacttttctgaaatgccaggaattgggatatggaaaagagctcagaaaactacaggaggcatccatggaacaaccacagaattctcattctggaaagctttggcagggctatgttctcatcatttcactttaatcaccttttaccccttggggccatttgaggaccatgaaattctaagaatgggtagaaaatactcccccaaccaaataagaaataagattcttttgtttctatatgtcctggattctgcatgctgcctgctcggagaggagagccttacactggagtttgcaggcatttgctgctgtctcaataggtagatcttcagttaggtcccagcttcatgccatctgttatttctaaagtattttggccttcagctggaggaaggtgacaggagagtgttctgttcctgcagaaaatttgcttgtcatcagagtaactgtgtactgttgaaacagctactgcctacatttcactgcctcttgaaagctagcattttggtgtgaatcaattatgaaaagtgatgcacactgccccaacacgcacacatacacatacaccccgcctaaaaacctgagacataaacaatgtctagaattgtgggcaatcatgcagagcccttcaaacaatattaaaatccagccacttgtaaagagtgagtaataaaataagtttagggttatataaattgagtctaataaaataattcagattcctatggtacattacagttttatagtagtgcctttattttctcttgttcttctacaaatgcctttttgaatatttattcattacccatttcctggataaagatagtaaggcttagaccttttaccaggatatcatagcttaaaaaatgacagagctatttaattcatatttaaaatcatattttttcttttgcatttttctacttcctggcatatgtttttttctctgatattagggtataggacaggacgaggaataattaaagtccctccaaagattaggtcagaaagggaccataaaagcttttccattaggaagctggctttggcgtttcattgtcattggagaaggcccatctgtacctatggcacgtgttatgctaggaaaatacctcctgaatccttttgtagaaagcaataagatagcatttctcagaaagaaaatgctttgctaagcaaatactttgaaaaaaacaataaatgattttttaaatggcattacaatgttctttgaataggacatgggaacaggaatcaaacttggatatattgtattttcatcttattttatttcatttttattagtgacagggttttgctctgtcacccaggctgaagtatagtagcatgataatagctcactgcagccttgaccttccaggctcatgatccttacgcctcatcctcctgagtagctgggaccacaggcatgtgccaccatgcctggctaatgccttttaagtttggtatggacaaggtctcactgtattgcccagactgctttctaactcttgggcacaagtgatccctccaccttggcttcccaaagtgctaggatgagaggtgttattgcatatttttacaagtatcagacatgtatgttctgaaaggcactagaatcattgaaaataagtcactgtgaagtgcaatgactcttgaagataggggatagcagaagtgtgaaactttgtaggctaatcattatggccaatgcctaattaggatttatagtaccaaggcctgaccaaagtcataaattatcagacaaaattattggacagaaagtgaatgactgcatatcttgttaaaatcactagggaacttaggcagaaggtaatgactgaaatgagaacttgcctgaaacatcaggctaaaaatagttcttgatatatgaagatgatctgaaaaatgagccaaaatttgtgttgcaaaacagcaattcaagaattcaatcttaaaacattgcctatttttttcttcagaaaacaggatacaaaagtcagtgtgaatgagcaaagccattgagttgctcccaaagcagaagaaattagacaaagctattatggaggagatggggatggatttccacaagagagggcaacctctatgtgaggggtaatttaatgaaaaatttgcaggtgatgcacctgtcttttcaaagttcttttcatccctgcaatttcatactttttcaccttcaaggccaatggctttgtcagtgctgcctgaattgtgcctttgaatgagtaatgacagatttgaaataagaacattggagcattttaagtgtccagtaatatttgctcctggatctactttgaatggtgggtgtgtgatgactggtctccatgaatgggatcatctaatgccttttaaaaattaaagacatagtgtcatttggactttttatgatgcagtactatcttgtcacagaagacttcaggatttctcttggttagcaagtcaacagagacctgtgtatctaggcctgcatatatgcatgcatgttgttacttgatatattcggttataagaaaaggaagtcagtcctagtaaataacaccatccatatgagatttatgggtttcacttataaatattaaattaataaataaaatattatcctatcatacttagtaacaaaggtataaggctacaatattacacctgtcctgtaacttcacagatatctaatgaatatctagaaaacatctctgacttgctgcgagtgtgtcactaaagccctacattgaccatatatgtctttattctctatctgataatgttgcaactttcacattatttttgaaagttcttaattggtgattaaattcctgagaatttccagtaatgcataccaaatgtcctgagactttttagacataaatctgactcaccttcaaaatcaaaacaaaaaatcagtattactatgatttcaagtcataatctgaatttaactccacctttaaaattaaatgctgccaggatcacatgctcaaaggctttcttggaaatatggcttatacaaatggcatatgcatatatatatatatatatcatatacatggcatatatacatatatatgagatatatatgtatataatgtatatgtatatataaaactggcaacagaaacacaggaaatgatatgaaaaaattattttgttcatttggaacgctgtatttgttgtcatttttgaagacaataaaattgtcattcgaaccaaacccatttgtttcattatctattaatttctatctcttcacactgcttggattggagatagcaaacaggccatgaaaacaccttgggaaaataattcttgcacattctctaacaaaactggaaaaattactgatagattcttggtttggtcatatggtgcttacatgaactggagaactttgatttgagctagttcaaattttaacacactatccttacatacctacgtttgagagactgttatatgggatttgagagattttgaaaacatggcctttttcttgccgtttgtgagcaaggagagatgtaagctgtttacctctgtacccagcaaaataccttccaatgaggttagaatcactaggacttttcttaatgttggttcacccccattatacctcctgagtataagtggataatgatttttttaaatcataagagcgccatgttgcaattgttattatcaccccacctcactgtgtgtgtgtgtgtgtgtgtgtgtgtgtgtgtgtgtgaagttaaatgatctttaatagtggtttgttaccaaaaaatccatgtaagctcaagtcacctaaataaaaactactgtataagaaggaggcacaagtatggaaaacatataggaatacaagaaatgtttacttttggcccttttcctcttttaggccatttccttcctttccctctaccttggacagctagtttcaataaacaaaaccttgtccttattactaccacttttagaatgccttaacttgcccttaatgcctagcctttcaacaggtggattcttgtgtgtcctgaataaacatacaaacacatagaaacacacatacacaatacaaatgtatatatattttgtatagtatatctgtatatatttaggtacatattttaaaaacaaacacattcaagtaagagaaacattgagtggtaaaagaaaaattagcaaactgatataaggtgtagcagtcttacttatcaaatggaacaggtgtctttttcaaatttagttggtgcctttaattggccatttattcctgagtgtgttgggcgtagtaataaatgatatgacaacacagctcatgccagtggtggacttctacaaccagtggaatagtcaagaaaggtcaagctgtctccattgatttgaaagtagattgtacctacttatcacaagcaccttagttttcctttccttcttttctatgaaggattgtccccttgtccatatcacatgttatctatcatccttaatgtcactaataaattagattattcatggaatgtgcttagccctgtgtctggctccttgtaagcagttgataaatgtaagctgctatagttatcacactttgatccttaccacgtttccttgatatattgagggcaaataattgaatctgcattttattaaaagaacactgagactaatggaggtgaagaggttacctgacttctctttggctcaggatcagtgaacaatattataggtacttgaactaagaactccagtcttttaggccagtgattgctcctcagtatcaacatttaaaagtagttagttattcttgttttctgaaaccatcctgagaaaataaaggagataccacttctgtcttgtctcttctccctggttttaaacctgtgccttgtcataatgcaaaggccatgtatttatttaaaaattataaacacattttacctgaagtgacagctgaactgtggttctaaatagcctctgttggtggcctcaaacttctgtatatattcggtatattccattaagtgcaattttatgaaaatgtcataaacaaatcaatcactcttgacttaattttcagccaccatcagcttctattgagaatctcagccatcaaaatatccataagaccatatgatgaagtacatataaagtactgtgtgagcacaatgaaaaagcaatgagattcttttggggggttcacggaaagcccccaagtgagggtgccatttgaattgagtataaaatgatgaatagagatttgtccattgaaaagggcagacaggccaggcacggtggctcacgcttgtaattccaacactttaggaagccgaggtggacgggtcacaaagtcgggatacaagaccagcctggccaacatggtgaaacctcatctctactaaaaatacaaaaagtagccaggtgtggtggcgggcacctgtattcccagctagtccggaggctgaggcaggagaattgcttgaacccgggaggcagacgttgcagtgagccgagatggcgccactgcaccccagcctgggagacatagtgagactccgtttcaaaaaaaaaaaagtaaagggcagacagaagctggagatagagtgacccctgtcagactgagggggacatttgagcaaagatatgaatattaaaaaaacaatgatccaatatggttgaattgggtgagtggcaagagtggctgttggcaacctgtgaagtggcatgcatgccaggttaagaagttggagataatttggtagcatttgagctgcaatagatcgtgtcagagagaactatgccatgaccagatgtatgacttagataaccctgacagccatggggtggacaaatggctagggttgagactgcagccaaactcttcacaatttcaggagagaaatgatgaggaatgagattgaagaagtggccatggaggtggggaaaagagagcaaattccagaaaaatattgtggatttgctcagtggaacttggcactggatgaaatatacagaataagtgcaagggaggaggcagaagattaacttggatagatgggttgataactgtagccataactaagggaaatatattaagctcctcttctcaataaagattagatttaattacgaaaatatcatctatttatttgccatcttgttttacaataatatatcttgtatcttcatataaaagcagttacggcagccctctgcactgtattttcatagggttctgtttttatcttacttaactgtaaggtccttgagggcaaaaacagtcaagcctttctcattcatcctttgcaaacccagcaccctgattcccaacagggtagaactcagcacatatttgatgaattagattgaatttaaatctatatatagttataggaataaatgcttggaggattttcctatctctgtttcaattctttgttttagctcagtctttttatgttggctcctgtaagctttttgcagtgctgcaaacacttctagctgacaagagagaaaaagaaagtcagtgaaaaggaggagggggcattgcagcatctagattgaactctccaggcttgcctgtctcataattttcacctttggtggggaactgtcccagatttcatccaccaggctaaggttctgacatggtaccttcttaaatcaagcttgaagggaaattgattgaaaagaaaacaccattatgggaaaacaattcattttcttccccatgacagaaggtagacttttgtctatactgcagaataaatatgatctggctgattgctttaagatctggaagctcagaggagtcataatggctttgctcactctttagagggaaattaccttccattttggagacatttgatacaaaggttttggttagctttcaaaaagtaatattttttctccctgtgtgattatttatattagctagatataggtgcatgaaaacttgcaaatatttctgtgtgcagttgtgtgtttctactgaagtaccctccagacagggagtaagcagattttttttaaaacttttctataagccccttaaatattacagtcgtcccatgctttctgtgttgaaagaaaacaaatttaaactcataaaggtggagtgaaggcaaaaagatagaataatgtttacctgatgtttatagtagtagaaaacacttcattgttagaaatagccaagaaggcacttacgttgtgggacactcatccgtcccgttgacaaaagttggattcattttatcttgcagaaattgcaaactagcatcccctcagacaaaatctagccctgataatacgtatttggacaacatagaaattatgttggcaagtcttttctacttcaacacagtccccaccatgcccattgtacaatggctggccaaattcacacatttaagttcctagctcccaaaagacttgaggttgaatgccttgctaaaggtttttagtgcaactctgctttgctagaagatgaattcctaccttgcaaaaaactcggatgcatgtctcctgagattggaatggacaaggaacaaatgtacttgtttgtagtacttctagaatgtctccctaaatcatcttagaagcagaaatcttacccaaaatatgatgcttgccaatatattgtttaccacccatcatgctctgaaccatcatgcctcttgtctgggtagccttgctctatgaggcaatttgtggtataaagatttttcattaagttttggccagtgaagatgttgtcaatgtacaaagtcagtaatgcttcttgtgaaatggtcgcctctcatgccaatcttggaagcgtaacattttcttgaccactttagttctaatgacttcacgtttatcctgaactagaaatatggtatcttcttggttgtttattctctttcttcttccctctttatatctctccatccttctttcttccttcttttttcttccctctatttcttccttctttccatcattctctcctctttctttctctcattctgtttcttcctcttttttttgaaaatcttagcaagagttaatggacttatgatctaaaaattaggttattagaaatttttgtcataaaacctggagaattgatgtttgaattctccttggctagagtcaatcctttatcctttttaggtaaatgaattaagtctcatgcaatttcctgtgtgggagactctttagatgaatcatttaaatggaaagccctgtctgctcatcaaggggcgcgattttagagttttcctgagtattatgtgcacgcttagtacagtcattgagatacataaggcaaccatgtgccttaatctgtatgaagtctcagttcatatgtgattatttaggtaaagtatataactgaaattttacatcttttgatctctttgcaaaatttccctgagccacttaaaaataacctttctttactcctttttgtcttgaaacatttttattggaagacttcagacctaactttagtaccagagaccgaaagtcatatctcacttagttctacaatctctagtccacttttgatactcagaatagatagtaaaggtgctatttttttaccccagagtgacagactgttataaatgttgggatcctatgaagtactgtggagagtatttaatgagccgttgtagagcctacacagatacatttatataagatattgtttttataccagcctcaaatgctcctaggagcagccagacaggtcttcctcaaaaggataatctggaatctttacctttgcaattgttctatgatacttctctttcaatgcacaactcccaattaattccttggtactccttgcaataagagaaaattaaaagggactcatttgatattagatgggatcacacttatatacctattgcattgtataataagtaagcatgagtatcattctgttgtatagtcccaaacttttccttgaaataattggcaagaggatagaggaaagacatccaagatttattaataccttcatggttctagttacctctataaactagtgaaaccttttccaaatattgtagataaagaaattgaggcacagaggtgttacttaactgattcaagttcacacagctaataaacaacagaggcacaattccaaaccagctcttcatggctctaaaatctgtgttttttccataataagctgcctaatttattgcgcttttattgtggtaattattttacaagcattattgcatttaatcctcatagccttgttatgtaagtcccaatagtccccatttttgctgatgaaggaagtaggattcagagaaatcaagtagctctcatgttgtctcacagtgaataagcaatagattcaagatgaactccagagcctgtgctcttaaccactacagaaaattatgaaattacaaggcatggtcctgccttgtggctctagcatcaagttggtaagacaacacaacaccaaggctcttaaggaatcctctggacttgagtgtatgtatgggaggagaagagggtgttctaggtaggatagtaacatgacaaattcaaggatatgagaatggaatgttcagctttattttcattttagataaagttataatatctgataagatagcatggaaggaaggaacttcactctcctggagtgtagagttgtcaggagtggacttgaaaaaaagagtgacaaccatgaggtctgataggctttagaacgcaggtcttaaagagcctggagaaaagagcgtgcatcacaaatcctacatagacagcaaaaccactgcccaggtaaaccaaggccgcagtctaatcttggaaggagagagtaatttaggacagcaaagcagaatccatctccttgggcaaagcttcaggaaagccctgtctgaatctaagagggagctctcggaaggaaaggagaaggacatttgcagaaggaagagaggcagccttggcccttatgaactctgggggaggttcctccccctactcttaactgaatgtggccataagttgaacaccagtgaacaccagcaactgctgagactgaggagagcagcaacaactgagcaattaacctttggtgatgggcttgaagttctaattaagagcagagtctcttctatcaggtgggagggggaacagcagaaagatgtatgagggggatgaaaaagaccagcatgttagcaggtcagatttaaaagacatccaaatgggtgtaagagggtgagagaaaagaaggagatcactgaccaattaatttttctgtttcccagtcaaagtttcttctcctttctcttaaccctgcagtgactgctgtgtgcagaagccagcagctccggggagagctgacgttgaatgcttatgctcctctctgttgtaaattcctttcttcatttgctgagtatcattggtaatttctatgtaaattttctcagagtagcaatttagcagcttttctgttgacaaatgaggaataacttaatagtcaagtgactgcatgtcatgtttcgcaaggaggtggaagtagcgccttgtagatcgcagggatggatgctggaagtgggcgatcttgggaaagcctcattgcctcagtgccctatttaatttcgcccatttaagataggagagaataagcttctatacttgaggaacctagtttcttgtgaagagtgattgttaggaatcttttctcttttagcacttagttaacgaatacctttcaaaccaaatcaagaggcaagaccccctccaactttgtccagaagccttcacaagcagaggcatattttgttttgtatcaaatgcttctcattgtccatattcaggaggcaggcaacagtggggtcctttttgaagtgaccagggatggatgcaggcagcaaggcatcgttgctttccagatgccacctttactataagaatcgaagtcctttaaagtggactctgagaaacttcacctaaatcatttcccaaggtgacagctctctatgcagttttttctcctaactagaaagcttcctcttgccactgcgctgaaaatgggaaaagtaggtggatggggaggtcttttttaaagcccagatttctggaatttgtggtccttctactttcctgtctccagcagtgaccttctcctcatttattcatgacagaatcatacgtataaaaattcatgtattctggtcaccgttctaaattctggatggtgaaaaaaaatatgcagggcccctccttttatggaactttcattttaggaaggaggaaacagtaagcaagtgaacagataagttagtggtataaaattgtttaagagtgactggatgggaggagggtttactggaagctcagagggttcatggtagcccactctgcagagatgagagttaaacagtgttgtgaatgattgaaaagagccaaccattcacagatctagggaggcatgctcccagaagctgagacagctagagcaaaggcctgaggtgggaaagaacttagcttgctgataaatcagatacagagccaagctgctgttgtattgtaagattatttcagactcgggagtagggatgtgtttgcacttctagctctataggccctcatgagcctgttggacacattgttaaattgatgccaagtagctcaaagcagaacccagtcccttgtccctcatcttctttctgctgacttcataagaacatggttcactttcactgccttcctttgtggacatactcagcctgcgaattaaaaacagaactgattttctcatctcccttggatcctggggaaattaaggcctgcctaggcctcagttctttccctagattgagattaaaatagctttccttgcaatcatccagatgccaatttaataaacattctctggccccttccacatataacccctggactgccttactaatttcttagcattcttctccttttctccacaaatcctccctttaaagagtgtttttttcccatgcctttcttattcttttttgtggaaagcccaaattagtttgtttatttttgcccttaaagtccaccatatccaaatgagaagtacagaagctattaccttaaaagtaagcagtgagaatcctaacatctttttttccatccccacattctcctcaatatgttccctgtcctttgatgcataagagggtgaaaacctcacatgagtattttatgcactaccattttacaagtgtttcagtaaatattacttcatgtaattctcataaaaatcttgggagatcagcaacacaagaactggtaggaaactctgtaagggggaatgtggggatgcgagggaagccagatcatttccaaagtccaaaggtcagatcttcacgttgaaacccagtctgcactgacctttgacctggcatcaccattccatagctatttgttggtgtcagcatcctggatagggggatttttttttttttcaaattgtaattcaaaggctaacagaaaagagaaggtaggcttgagaaagcactagttttcttgggactctgacttattatttggaagaaaattgattgaaagcataggtgattatttgttccttgtatctttcagaaaaaatcaagtgctctatgacattactgagtatatacccaaaggaatataaatcattctgttataaagagacatgcatgcgtatattcattgtggcactattcacaatagtaaagacatggaatcaacccaaatgcccatcaatgatagactggacaaagaaaatgtggtacatatacaccatggaatactatacagacataaaaaggaatgagatcatgtcctttgcagggacgtggaaggagctggaagccattatcctcagcaaaccaacgcaggaacagaaaaccaaataccacatgttcttacttgtaagtgggagctgaacaatgagaacacatgggcacagggaggggaataacaaacagtggggccagtcatggggaggggaggaggagagcatcaggaaaaatagctaatgcatgctgggcttaatacctaggtgatgggttgataggtgcagcaaaccaccatggcacacgttcacctgtgtaacaaacctgcacatcctgcacatgtaccgtggaacttaaaataaaatgacacattactttccccactgtttttttttaagcaaaagtgttctcacacagaacacaggcaagcatgtctaacatgttccattctaagtcttgcccttgcatgtggttgaaaatgactatggactatccacatcacaaattatgggttccagtgtgtatatggacacttctgaattcactcaaaatttttcttactgatccctattgccagatgggggagatcagcttctatattaagcaaggatgtgtccaacttttgaaatggaatgaatagttaaaattgtgcatttctcactctggtggttgcctatagctgtctccgcccccacccccacctctcttccccaccaccttcaccagcagtagaaaagtatgtcatatgtgtgtggggtgggtacagatagagaaacttggcagaaatagggtgagagatgtgactaacaccctcagctaatttctgtgcatgttcccaaacagagatctgcagagaaaggagcaagagttccttgcattctaacccaagccaccccttcacacttccagctttagttcacttctccaccttccatgcatggttgccatctgacctggctactgagaagatcagacctcccagtaggagatccaccacataagctaaaaataagagctgctacttctctgcagataccattaacccaattagataaataaaaaaaaaaaaagaaaaagaaattacagcttcattaagtaacaccagaataaactccaagaaggcaaaccaaatcagttatacaatttaaaactttactcaaaaatcaaaatgatttgaaaccaatggtcacttaaatgaaggcagaagctgcatggcagccattattggagccagcaattcagcagaagtccaaaggtccagtgcagcagtacatgtgacaggtgatgttgcctgcatacacaaaattaaatggaactagttttcgagggtcttcttgtctccatgaaaagagaatgtatccttctgaaagtccttttgtttaaaaatatgatcaggctctgaaagaattttaggtcttgatactaactaacagaagacatgcatttattaaaaattgtatcacaaaggggtgaactggggcctgattgattgatgttgaaatttgatttatccccagtagaaagtgccaggatattaagcctctattactccacaagggataccattttgcctttggtgggtgaggtaaatcttcagattagaaatggtaaagcctcaagacttccaaaaacatacaggctcctattgtatacttgctgaagttcctataattatttacaattccctgcaaagaacattcttgggggtgagtcccagaacagaggtgagcctccagctgcaaaaaccatagcaagtatggcagggagcatctttgattcagaacagaacgccactcatcgttccatcagaacaggggcaggaggttcctgccaatactgattgatgccacgaatcaactggagttgttccatgatccacatggtccttggacttggtgctgtcctggaaactggattcattgctcaaggagctgagataaaagaaagcagcctaaccaatggccagctcaaattaggagctcaaatgaacagggcctcaaggaagtcagcctctgagaatctgagatttccagactctgataatgggaatctcacctatttgtccacttttggggtagatctagacaccgtgatgtgtcagcagcctcttagttgctgagacaattgtcccagagtgcacagactaaatctaaatccctacaatatgttttcaatgaatttatgccacactaattttctaatttgcaatttttaagtcaatatactttattttcttttaaaaatagtgttttatattttcatactataacatatttccatgatattaaaattggcaagtaaagaaaataaaatatgtaaagtcattactgtcatcctcccagaagtgatgtgctaacaattagacatatttcatccccagtttttttctacagacacttttgctttaccatattgtgtacttgggtctattttcaactctgagccacttgctatattgaacagtgtttctacagacaccgtgctgtttcttctttccttctttcactcaacaatcatttactgagcattttgagaagaactgggaggacagcgatagaatgcttttgcattttatctgcagtcaactagttagaaaccagaaacaactatcttgcatctcactatcttgttatttgcacctttaaaatccctttgcagaataggtgcatagtattaatttgataactaaatgaaaacaaaatggagttcatcaaagtggatttgttttgaattggcttggagttactggcagtctatgatgacatacgctactccccaccattgacacatgcattcaaatgcagatgctatattagtctgttctcacactgctaataaagacatatccaaaactcggtaatttataaaggaaagaggtttaattaactcacagttccatgtggctggggaggcctcttaatcatggcagaaggtggaggagaagcaagacatgtcttacatagcagcaggcaagagagcttgtgtaggggaactgctgtttataaaaccatcagatatcttgagacttattcactatcatgagattggtatgggggaaatcactcccacaattaagttatctcaccctgaccccacccttgacatgtaaggattattacaattcaaggtgagatttgggtgaagacacagccaaaccatatcagaggcacacacaattttatgtgtttgtgaagaaaaggcaattgtggaaactttacttaaaaagtgtaatgtcaatctcatgagttgaggacagttaggagaccctgaaatgacacctgtgggcttgcattttattcttggtcactgctaaaccatttttcacttccctctgtttcagtaacctaaaaatctagggttcacaaaacaatgagattaaggaagccaactgataactattgtaataggataggaaatgtttcctgatttgggaaggatgggcaaggaggtggagaatgagcttccaaggcagttttgattttccggaaaaactcatcttaaaactgattatctccccaacatgagacctaccaactgacctgtatcagcctaactgcaatgtatctgtctaaagctgttaaacacagctattttcaaaacatttatccattttcataaaagatttcttaaaattcaagctaggttttcttcctttatttgaaaagggaatatggtaattttaggaatatgattatatatgcatatgtggaagagaagcagaatacttaaaagacaagcatttcctctttttatttgagagagagaaagagagagaaagaaactcctaggcaatcagagcagaacattcctaaccttacatttgatccacccattgagctactgaataaatgcttaatatgtcagtgagcccacaagtttcttgtcctgggccctttaaactgatatatctcaatcacctttactgaaatgttatcctgagaagaccgtaaacccagggctgctcaccactgagtcttcttttatgaaggtttctcaggagaacatacagctaaagatctctaacatttttcctgagtagacctcttttttctcttcatgaggatatcataataaatgactcgttggtaatttatcagagcttgttccttccccaacccattctccttaatgcattttttaaatttatccagtatttgaaatgcagaagtccaggcttggtaggaacccagaagagaagaaggtgaaagaacaaaatgactgtgaagctaagaaatccagatttggaaggagtagcatcctcacagatgctcacagaagtccatatgacactccttgcattgcctggggctttatggaagaagcagggtcacgcaggattagtcattgcccaaagagcgaagagcatggaactcgccaatagcctgcaaactctttccttttggcttttctagcacttactactcttttatgacttttactttacttaattttcttatataccaggaatataaccaaccagggtagttgggggccattgtgtattgagcactgcccaactcaattcacttagcttgcaatgtgaatggcttctctcttctagaggtgctcaaggtgcaacccacataatcacacctgatagccatgttgtcaatgcccaatcacattttaaacacttggagggcagagactatgacatagagaaagatttgaatagctattcacagaattcagttgagctgaaaaagtcagaagaggagactagtttcactgactacaagaaagagtgatttggttttctgagagtgaaatcttcccccacaaacatgtactgtttggcaacatgtttttttaagcctttagaattgtaatgctttttgctgggtcatatgttctcaaattttgcctcaagccccatcattccctgttttattatggtaagcttattcacacatttatatacctgccaggctattgtaggtattttgatatgtggcttggcctttctgggcctcatttaacctctctagactgcagttttctcaactgaaaaaattcccatcatatctgccctgcctatatcatgagactttgtgacgattcaaaggagcaattcaggcacaagctgtgtaaaggttacagaacacaatatagactacattatcattaaactacttgatagtcttatgactatttttatggtaatgaaacgtaatccaatgcaacttcgtatatgtaagtaaaacttcttaattcttgtcttgtaaaactgaatcttcatcctttgactgatcaactgaccagcttaaaccttggagaatcttaaacttctgaacacattttacttctctctttatgttcccctgtggatctcttatgagtatacagagattgagagtccaccatacaggttacctttcactcaagaggttgtggcatcctattcattgtcaactactggactttttcctccccgtcgtggaaaattggtgtcacattgccacatggagcatcccttcttcactcttgacccttccttcatcaatggtggagcatcctcctgaagctggagaagagaaatataaagctatgtgtttcagaatgaaaggaccaatcacaagaaactctcaagccttaaaatacatttagcttttggatataatacatcacatctgtatttgttagtaacatattaaacaaaatgatagataaaatgtagattatataagaacctatgtaattgacatgatttagatactcattcaaagatgagtcatgaaaaaggtacggtattgtcattgcacagtatttcctatccctgtgacatatgaataccaccttcaccgtttttgtagtattcactcatcacttgcactgttatttacttaatagtcttctttaagttgatttattttacttaaatatatttattttgaaagcaaaatatataattctaaagtaaatgaaaagtcggtattacttctcataaataaaaataattgtaaaaataaaagctttaagaacaaattatgttgttatattttagctatgtattatagcctgacaaaagacaagaattagtcctcatttaaaaaaaataaaggagattggcagattttaaaaaggcttttaaagatatataagtgcttattttctctctgaggaaataaagagcaaaagaaaacttaaaagttaataattttgcataagtataatttggaatgattcagtgtattttttcattatgacttcaaatcatttaatgtatcaaaaacatagtcataaacattggggtcatcatctattttgattgtagagattttacttttatacatagatgttttcaacaatataacctaaatttctgggaagttatatcttttacatttattttaaaaatctctctcttccctcacttcttcattgaagtaataagggacttaacttctttaaaccaaagtttccattatagataataaaacaaccatcacaacaagaaactactaaatgattatttattcagatcccagaagaagtgctttacacggatactctacttcaaccctcacaactgctccataaagtaaatgctattagagtaaccgttttacagatgtgaaaaataagtcttagagcaatttcttagtttgctgtgatcacacagctagcatgtcaggcaatctgatctggcacctgcaatcttaacctttcctgaaataatcttattacttaaaaaagtattactaataatgataagaggctatatttcattattttttgaaaagtatgtttatggtctatgtcacaaattaagagtgacaatcagaaactcctgtaccattggaaaatgaaattttacaatttggattgctgttcaggaagcaaggttaaacaaataaacaaaaataaacaatgacaaaagccttttaatgaccattctggatttttttttcattttaaaaatgaatgctcaatgtttcttcctcctagtgtattgctttacttccttaacagaatcctattttattaagaagactgtgaagacaaattttagactgaggttctgagagatgtcttagagccagagaaaaatgaaaaattccagaagtctacagaatccaagtaaagaagactttgtttggaattggcagcaatgacttccactagtagcttaccatgctagtgtaattaatctcactcccatttctacttctttttatggcagaatttcttaacctcagcactgctgacatagtgggtcatatacttcttcattgtgaatggctgtcctctgcatggtagaatgtatagcagcattcttgggctctatccactaaatgcccagagcatcccccaagttgtgacaataaaaggtatttccagactttgtaacattactctggttaaccacagctagagattacctcaacttgtgatacttttctgcttattttggtgttaattggtatctgccattgttgctggtggtcatgttattgttgttgctttgtcctttagtaaaggttccttctctgcttagagacaggacatgcttagaaccctttgggtcttaataaaacctcttttaatattcaaggtatagcagtgagatataaaaatgattgcatattgacatatatctaaatattttcactttgatttcagcattgaatcaacatctctatcagcttgtcttcctggagaaggatattttttggaggttctggtcaagctcagtggttactgaagctgtcgggagtcttaccaccttggggtcactgtggaaaccagaaaataaatggacaaagctgggattgctttttggctagtataatatttccagaatccctgaggcttgcttttaaatcagcataagctggttttgtgtctcacttttgtgttgtacaattacagaaagcagcaaatacttatcttggcatgtcctgtcatgacatgagccaaaagctgtcatcctcatagattccctgtctaagggaatagttgccctatcagcatttgaaagaaacactcctgaaaccttttggagactctaaagttatgtactgtcatttgatggataagtgactcaaaattcatattgatcacatcatttcaaattcttacctgttagactggtgagagaactctaggtactttgttgggaaggatgatggagaagagagaagtgaaaatatgaaggattacttataacaaaagacttgagaaatattttaggcttgagaagcattttataagggaaagatatttgtgatggggactagtaagtaccacttttcacctattgccatttgaaaattgactgtttgcatattgtttttttctgaaatgccgctatgcagtcagggatgagaaggggattgtgattgagtaaagatctttcttagaatcatgtcctcatttgtaaattgtgattttctgtccattaagaagataataatttctttttcctgacatggccttgtatttttaacttcttgctccacccatactcaaatgcaggttgatttattctcctttatgctaggtgacttccccctgtgtatactctctttcagaagtatttctttctatctccctaaaatcaaaaccaatgttcaccttaggttgtgtagaaaagtctctgctaaggcacctcacacctttctaaatcacataagttataacttatttatatatttactttgaagtaccattcctgaatatctaatagtgagattaatgagttggttaatgtggtatcaatttagggcagaaatcattttgaggaactcataaatacctactattatgatgtatgaagcttcaggtttttatggctgccactcaaacaaagaaatattatttggaagatgtgatttgatgttagtatttaatcaaatgtacttatttcacctacttgctgaataagcacccttctttactaccatcactggttttcatattgaggtatgtggatttatcctttatcattgctcacctttgaagatggtggcataattaaagaattacaaggggatttcagaaagttgtagataaattgaactaaaagataaaaatagaaaaaatttatttctcaacataagctccatcgggttcaagacatttttgtaagctatgataccagtgatttagtccatccttaaagaactgaaggtcctgaaaatataaccatactaatgcattctttttgacattattacctgaagaaaactgggtgccctttaaagaggttttaagattaggaaacaaagttaggaggagcaaaatcagggctgcaagatggttgcctaattatttcccatcaaaactctcacaaaattgctcgtgtttgatgagaagaatgagcaggagcactgttgtagtggatgaggactctctggtaaagctctcctgagtggttttgtgtttttgtttgtggtttgcaaaagctttggctttctcaaaatactctcataataagcaggtgttattgttctttggccctccataaagtcaatgagcaaaatgtcttgaacatcccccaaaactgttgccatgacctttgttcttgactaatctgcttttgctttgatttgaccacttctacctcttggtagccattgctttgattgtgctttgtttttagaatcatagtgatgaagccatgtttcatctcctgttacaatttttcaaagacatgcttcaggatgttgatctcacttgtttaaaattttcatttaaagctctggtcttgtcttcagcttatctgagcacagtggtcttgacactgattgagtgaaaagtttgctcaactttaatttttcagtaagcattgttagtgaaccaattgaggtgtctatggcgttggctattgttcatgctgctaattgatagtcctctccaattagggtacaaaaagattatttttttcttcagaaattgagtggatggtctgctgctgtaggtttcattctcaacatcattttatcccttcctaaaaatatccatttttaaactgctgatttattttggccatcgtccccacaaactttttgtaaagcatcagtgattttaccattctctcacccaagcttcaccataaatttcatgtctgtccttgtttcaattttagcagaatttgtattgctctgataggagcacttttaaaacaaatgccttttctcttactccctcaaactagatcatgttcagacatgttataacaagttagtacaagtttattttgctacaaagccaaatagaaatttatgcatttttttcttatatgcgttttccacgaacttttggaagacccctcatatatccatctacatatatggccagtgctaaatctcaatggaaattgaagacacagcattactcattggaatgaaatggcttgcaggaaattcccaaagctggctagaaagagttgaggtaacctcttccctcttcatggttccagtatcacccaaagcttttcctcctcagcactaaatctttgctgcaatactccttcttcagaggtgcttatgaaatggcctcatttcaaagaatgaaagttaggttgtagcaggaattttgaagcccagaactttaacataaatagttgaaaagaagaaaaataaaaactctttatacaaattcttaatcttagtttactctgtgtgttaaattgtcattgccataatgattttagtcctttctctgacctggattctcccactccccagcttttaaatttagtccattctatgtagtgcctcttgtaatttagcacattgtaggtgccccattagttttgttgctttattcacctgcatcctcacacatcgtgtgattgtgcttgcagagcacactgaactacaacacattctctcactctgaaatctgtcaccataaagcataaagcaaaatccttccctcctttactgaatggatggctgggtggatagctgttctttgcacatgttcgtgttgagtaggtgctgtataaaatcacttgttctttttttaacgtgactcacgaaaaaattatcccagctttcagtaatctcaaggaaaaaaaaacacttgccatctgcaatttactgcttttaacctgaaaaataggatctaaaatgatactcagatacttaagaggcttcacgtgttgtaggcagaagctgacagatggcacatggtggtaggctgttgcctcataaggagggaaggcagaagcaagtagacagtggtatggaaagcttcttgggaagaggtcatgacaacgcttcaaccagagataattaattatttgctatattctgtaactagcctgtttatacaaatagctggtgtgctcagtacaacatagcagtgaatctatggaaaaggaatctgtaaataataatgcaagggaacttctcttacgtctattgctaaggggattatcatagcattcaattttaagccatgtaacctggaatgcttactaaatgtgtaattcttgttcttcctcttcatataatgcacagacttgaattcctatattgagagaataacttacctcttttaaataataccataatttgccttgaaggtagggaagaaagagagtgaagtggggaaaatttcaaaattctgtcttccagggagcatattcctactcatctgtgacgtctaatgtaatagattttgaagaattatttgtaagatagatacttggagaagtttatactcacttcctaatcccagactatagaaacttctgcattctagaatttcagagaatgtgtctctgtcaattgtattctgaagataagatacatttgacatttgattgcttcaatcaacattctccaatgcagatcactaggcagaaacatcttgacacggcatatatttgatacacaatgattatttgcattgacttttaacaaagtcccatttagaaagattgaaagaaaaggcaaatgtgattggatgtatgctaaagcgtgttcagtatgtgttttgaaatatctttgaaagttcccaggatgtggcacgtatcattcacttgaagctgaaaatctctcagttgagcaaaaacaagtatttgctttgttccatgatgcactccacgtgtgactaaaatggcaaagtgaagcctctagtttgtagatacttgctttgggagacagggagctgtccgtcgtcctgaacgggtcatgctttaatgaggatagacacagggtgcaaaggaaagtgactgggatcccctgcctgcactgactttaacaataaagatactggaataatgagatcccatggaatttagcaaaatacgagtagaaacaagtggtaaagacagcccagactgtagttcaaagtctaagaacatctaagctgcgggttcaggtataaaattagggccctgtggcttatctcaagacagtaactttcaaaggggggtttgaatagtctttccaactgtagctacattacctgaggcaattagtttacttattttttgtttttgttttttttttttgtggttagcttttctttttttttaatttattattattatactttaagttttagggtacatgtgcacaatgtgcaggttagttacatatgtatacatgtgccatgctggtgcgctgcacccactaactcgtcatctagcattaggtatatctcccaatgctatcccgcccccctcccctcaccccacaacagtccccagagtgtgatgttccccttcctgtgtccatgtgttctcattgttcaattaccacctgtgagtgagaatatgcggtgtttggttttttgttcttgcgatagtttactgagaatgatgatttccagtttcatccatgtccctacaaaggacgtgaactcatcattttttatggctgcatagtattccatggtgtatatgtgcatccatcaaaaagtgggcgaaggacatgaacagacacttctcaaaagaagacatttatgcagccaaaaaacacatgaaaaaatgctcaccatcactggccatcagagaaatgcaagtcaaaaccacaatgagataccatctcacaccagttagaatggcaatcattaaaaagtcaggaaacaacaggtgctggagaagatgtggagaaatagtttacttattttttaaggcaagcaaggtgggcctgattgttacatgaattaccaaatctaatgacaaagccaggtgccctggtactgaggctgtgtctcctctactccccatttcctcccctttccatcactattttctccaccctgcctatcctcatttctctttgctcctcctctttttccttctactctcttctatcctcccattcttttatttctcctctcttacatcccttccactccctttccttctcttcctttttttcttctctctgtctctctgcatgtgtctgaattaactcttgagtcagcatttaaatttggtaattgaatgttatgggtctttatgggcttcactttgggagaactgcttttcaaacagagaacctgataagtggtggaccttagggttactttgacatgtttacaaaaataaacttatcagtagttttagagactgccattggagcaattatagtctatgctcacagaggcttggtaggcttaccacaatccaacctcactctcccatcattgattctctgctctgtgaaacaagtactgtactcttcttcaagcccaggtgaataaggcttttctaggaaattctttgggattataataaaataattccttctatgagaaaggagaaaatggtggcttttggtcttaagtagattatttaccatctctctcaagagagataaaccataattcttaacaaaaccatattctaatgaagtcattggtcacagtgtcttctatcccaagagagatgcaaattactaaattcctgtcctggtacaaatataagaaatccagtcatggcctgacaagtttgaattccttcttgtccttgatatactctgtttacccccattgtaatttatctcttccttattcctccatattatttaatttagtaagcaaatgtcccctggtataagctgtgtgaatattataactgaattactgtctgtttgcttaactcattacagaaaactatgataaggtttttaattacaaaattagccctgccaaatgaatttctttcattcaatgaactgcaaaaggtggtacagtgaggataaaaatcatgtcctttcccatgttatttatagtacttttttctaaaaataattgttataataaaaaataatgccaacaacaacaacaataatattttcttcctcgtctgtttttgtgtgattcctttaaactgttaattcatgctgaacttgttcaaccaagattccataaagtaatcctcttcaacctacattttattctcagccttgtcttgaacatcttactctgacctcactagctcttcacttaccaatttgtttctcatcttctccttaataaccttatgaataagttttctatgtagtcccttgtattgctctttagacctgtcacttatcacttcttcttcttaggatactcttctccactgtaattcttatgtctactctaactatatatctttgaattctttagcatacataaacatatctgataaagcaggatcaagcacaaagatgctgtatcttgcctgcatccaacagactgggattattctgagctctcaagcaaaacatggttaaatcctgacaacaaaatgaagtgacatttatgcttacatatatccttccttgttttctgcattttcatttgaaaagtaaacatctagtccattttgtttatgtgtctaataatcattttattttactttaatttctttggtaaaagctatggactatggccattgcagaattatcataatttccatggagaaacttctgacatattttaccaaatatttttgaaatgctacactcacagttaaacctagagaggattaatttgggaaaagggactactttatgaaaatgtgggaaattatttctattctttcccttttgtcatgcctatttccctaaaattagattatttatactatacaagtaattaaacttatttcaaaatctaaagttaagagaaattaacaggtcattgctcagaaaaatgcatagtaattgtgagttttctaagactgtcacaacatttgaccaacagtctccttactgaaattttatggtttctttctctagacaaggccacatgcatatgaaagcagacttaaaatatttttacctatagctggaaaatcaaatcataaatggcaaactatgtattacttatgttataattttggagctataattttggagctataaatccaggatatcagacttttttcccactaatattgtagtattaataaaaaattctcttaatgtgtttgcaactaaattggcattaatttaatgaattctttctttgaacattcctcatttttagccagcggttggtggttgagttgcaaatggttattgcctagtaagagatggcctatgaagaataatctatttcactggatcccttggttaggaatgtagcatatgcttgcccaggtccacttctaaggaccaggtctgtttctccttgctactgcctgaaatagcataataattaattcaaaagttggctgcttttcactagaagtctttaggacattgtaagacaattaagtctgtagaagaatgagaaggaatcttttatttgaggtctagaggtgtcataactgtgaatcacaaagttgtggcacaatgcattcacctcagaaaattttcttcatgaaattaaagtttcattttgtcttaaagaaaaggttccactctcatgcgattttgtgtgttctcatcaaagcaagaatctaacttcctgatctggttactgggaatctatgcagacacacacaatccaacctctggggcctgttttgcaaacagtctttatgtcatgatttagaatactgcataagaaatttctccttgaagagagatgactgcttttgacagttggcttttcccagtgcagtcattagactgcacatgactgatgtgtgtgcatggacagggaggggtcttcattccctggaactataatgtcaggtttcatattgtctgagatcagcatctcttcagaaacaaccatgtactcctttctccccaaaccaccttccctcctgaccataactggttatataatcttgcatcttctattaccctgactgctgatccgtgcctgatggctatgccaggtctcacaacaccacgagcttttgattgctgcactctaagctgcttaataagacaattaaaaatgatttacaaatggccatcacaatgcaactggggatcaggaagagaatgttctatttgctccaatattaaaaacgcatgcccttctacagttccttctgcagctgcctttgatttcagtactggtttactccctttttagaaattatttttttgatgaatatcatgttaaaatagttcctcctaaataatgtatagctggaaataattcaagggatgtgttacacatgctaggtggtctgaaatcttcttccctttggtggggtaaacactgcctagaattctggagtagttaaaaagtagtacaaatgatctttcatcatgccggctccttctcagtttgagggtcaaacctaatttaatcactgacacatccatcttgagcatttcctctttcctcctattgttgcattgattaaaatgggcaaatctcccaaagattccattgtgagtcacacaaacgttcatctataaaaagtggaaatttatcagaaatgatgaccttgatattttgaatgtaataactgagaaattcaagtagaatctcatctagtatgtgttgaaaatgctcattttttgtttaattttgtttagtttttttttcttgtccagaggaatgaaaattgatattggcccaaatattaagaagattctctatttttagtgctgagacccaaggattagtaagatgggcattggcagggttaccataacttttcttaggaaggatgtgtggaatagattttttaaaaagaaccatctttgaagccagatatccctgtattttattcttgcctttgttacttagtaaagtgtaggactttgagcaagatgctacatctatctgagattccattttctcatctgcaaagtgaatacactaatcttaacattcagatttgctatgagaattgcatatggttatctttgtaaataaagtgcctggcacacagtaggtgctcagaaaacattgatttcttttaatcctctcattcaagagcacagatgataaaatatttatcactgttagtggtgttatccctggtatatcctggcaaatgcagtgagatactaagaagtttgatgctgaaattactttttcagcactagattattacatttttatgacaatttgaaaattaacctatcctatgtgtatcaatagcccagttttgtgctattttcaagtaatatgaatgttacagtgatggtggccacatgatatgttatgaaggaattttatttacatcaaacttcccacaatagcctgtttattgaattatccctgaaataaaaccaataaacctgtctttggaaaccagtgaccactgacccacttacatgttatggatggtttcttttctgattgccagttagtgtgattggggtaaggaggaggtaactagtgtgactttcttcagggctccccttatactctatgtgtcttctctccctagctgtctaaagttctcttcaccttgaagagcctcccatatttaacagtttatgatggatgaccagcccacattagggcactgttcaaatttcagatactcaggaaggccaatcctcagagtgtttctgatcaaaacattctttcttatctgttctgcttttttaaaattgcttttacttttcttcctttttttgttattcctaccaggttttgttgttattttttttcttcaatgatgtctaattgcaggttaccatttcatctgctactttattttttatgcctcaacatttggtcttctcacctctggttcacttctcatgggattttcttcacctaaagttacaacttattcttccttgtcagtcccacctctctggagctgccaaaagctccctcttgcccctacctgcttcagccagcattatctgcagatatatcaggtaccatctgggtcctacccttctcatatagatccaccccaaatctacctgccttttcttttctttctttctttccttgttttttttttttttttaccttcaggacttatgattctcagagaaaagagatggagaaaccagcccataacttatctatctgagctgaaacagaatcaatgacaatagtggcataagtatccaatgattttgagctaggccttgtgagtctctgactgtaaggtcaccctccttatctcaccagtgtgctgagccttacccaatcctcagcatatcacacccatgtactgagtcactctgcatcaatcccacgttggggaagagagcaaatctattggcaggggataatacaggatggaattagcacaaaggctcttctagtactacaaaatggctttcttgccatctacttgacccagcaaaactgttgtgtgataatatttaccttaaagttggttgttagagggagatagttgatattcacatattagatctcaatagaaaaaatagatagtataggggaatattttttactccataccaaacttaataatttaccattttctatgaaagtgtcttacattctacttctgtattttaataacatgttaaaattatgataattatatgatgtttttaaattttttaggtgcttttctttttctaccatgacaatgctaagtttctcttcctgattattcttgataatattctcccccacaaggccaatgttatctcctgtttcttccctccactctacctaggctggtttcctccctgttgactgtcctatcatgcgtgttcatctttgtattcttcttgaagcctgtgatgactttcactacattctctaccttcgcaaatgcagcatttccttcaaaagtcagttccaagtctttcctggacacaaaaatcaccacttatgtttctgtatgtgaaatttatcatgaaatgtaatacctaaatttatagtatgtggtatcgtttcctgtgctactaagtgcattactttgcctccttcattagagtacaaattcctccaagttaagggaacatggagactatgggcacttctctgattcatgtgatgttctcacaatattgaacatagcacatgaaagaatatgtgattatcagttggttagtggctggcttgctttggatagtcattcattcattccttaataatggttttctagactgtgggttacagatgctcccttccatcctcagtcacccttgaaaatatgttgaattacatcttacactttgccttagattagcgtttgttactatgaaagaaagaaagattttctgcctttcacagcctggatcctactcactgagactataggctgtcagaatgctacatgctcccagccctttaactcttttcactctgctatggccacaactggaatacaccttttcctcaattacaaaagccacacaagattctacctgcagcctcagtacacttcaacaattctcttattagtccttttgtaaacttactacctaagattttgcagtccctttgatgtctatatatcttgccaatctatcacttgaaggtgcctgttttactccaatgacaaaaaaaatccaatctaatattttttcaccttttctttctctgcctcagagttgataatacttacctttgtcactttcgtctcacctaggtccaggcatgagcatagccctgcttcatttcaacttagcctatctttatggccttcaggtctcctctcatctggaattgagttctgtagattttgtcctgtatgcccataatccactaaatagtgttcccattgttttcaaatataattcacaggggtaaagatagaaaatgtattttttagggctttttctaacaattatattttccatggaatgctgaagtcccacaaggaattctgaggcccaggtaaggaagaagaattagggaagacacaccagtgggaggttgcctagggcacaccaaaccattgcaaaagtatagtaaatccaggccaatccacaggtgagattgagactacagaatacattgttctttggttagaattggcttaacaacaagtcaatgacctaagctagggtaggcataagctggcgtgtcttatctcttatgcaaaattgtaagttctccgagaatagtcttccacacttagcatattacttctattacacattttaaaagataattttgattgtatgggttaagttaaatgtactccatgctcaacgttaattgatgaacacatatctattaagcactattgtggaaaatctatttggtgaggatacacaggaactccaaggaagggtaagacctttattctgcattctaggagtctgtaacatagctgaggagaagaaacacccagtaaaaatgtgtcactgaaacttaaacaaattatttaacttccttaaaaagtagtttttaatatgaaaaatgggagattaaagttggtcttctaggttccttagaattctagaactccaagtaaactagatatacatgtgtccatacttatgtcagatgggtgctatccacagtaggtgctacagttatgcagaaaataaagagatatctggaaactggggtagatatacattcatggaggtgttggagtttgaactgagccttaaaggaatagtcttggaaggaaaaattattatccatcactgaataacgtgggcaaaagtacagggaaaatacatctctacttttttttgttgttgttggggcaggcttcagccaaaagagcatttggaattgtctcgacttttccctgctctagacttctcctgtctctgcacatttgtttctgcattttcagaatctagctattttagtgtaccaaatctcttaaaaggacctgtattcattgtgatacaacccctataggaacttgagataatcagaatttcaagagaaaattatagtttcttggtgcctgaactgacccaacctcatgggtttaggatactaatcagtggttccctggatcagttatctgatcctgtcaccaatcaaggacaggactgtcacgtctcaaaatactactttttcaaggggaagaatatttctcctttagtatgtctcagcggaggtggaaaatgcaaataacctttttaggagccctttaaacacatagactcctcacttagggcccaattagtaggaacaaccaacctactctacaaggttttactcttcccttgaaattacacttcaaaaaaacatgcactgactccccccaggcatagaagcaggatccgtgttttaattctaaccttaattaaatctttacacaaactcactatttggctgtccaatgaagaagggcaagtagaaggaaggaagtgaagagcatttgctcttcctctgtcttccgtgagggttatatacccaaaactctctgtcttaatttggaatagggggaattagattttgtcataaagtcataagagttgtgttataagagtacgtgtatacagtagttgaaatgagtgcccagaaatcttcctagtttcttccccacctgtcatggagtttcattgtattaccttgcacttaacaaagccaaatcattgaaagatacagtccctccatgaacaacaatcaattctgtaactgatccttacccatctatttcaataccatgcataatgacactatcctttggaatgcagggaaaaaaattccaaatgacaatttgtcttaaatgtagacagtgctttaaaatatatgcctgatcataagagtggatatagtatttaagtgtgtcagaactttcttgctcttctaccttcctcctttttggttattgttgaaaatatatggggaaaaaatggcaaaagaaataggccctacatctgaattttaagttcctgttttttgagagaaagaaatattttgtttattttatttgttttttttttctttcccattagtaaaataattccaactaaggtaaagtttagtggaactaaacttttactgtgtgcaactctgactttcaagagtaaaaggaaagtaaatgtaataccccagtacacctaaaaccaggattaatgttttactttatcttgcaacagtactaaaattaaaagcaaaacaagacacattttagatatgatacagtgagcactagagaaaacctcttttattgatgggagcatattttaaaatatcttctcacctttagtctttgggttagtctcagtccctctgcatagggagcaaacaatacatgaagaactatttgggggaaattgctataaagaaacaataacttgctagggaaaaaaaaaacaattaactgtgaagcatgtatccctgaatctgaatcatggccataatacttattagtcccccaaatttgagcttccattgccttacttgtagaatggagaaaaaaaattcctcttgaggtgtcagtaaaagaagatgaatgtatccctcatgtttattctgatcagattatttttattttttgccttatggcatttacctttaacaattttgaatatctctgaaagaaagggagaaaggatggaaggtacgaaggagggtgaaaaggaaggaaggaaggaaaggtctttgttttccttacctggcacagctaaatattggcaaatcacaatagatagcaaaaatctaaaatacctaggagtacatttaacaagaatttatatttttaaactataaaaatgaataaatactatctaaatcaaagactatggttttgagtggtgacaatttaatatcaaagtaattccccactacatttctaagtaaaatctccctctggtgtctttttcttaatttcccagtgttcttaaaattcctatggaagaataaatatctgaggatagccaaggaaaatataagtaagaagactttgagtaagaactatgctttataattctaatataaaaccattgtaataaaaaataatgtatgaacctggcatgaaaagtgggcaaatagattaaaggacaagaattgtagctcagaaattttccccagcatacatggaaatttaatcacttccaaagctgttatcacaatttagtggagagatggaaagtgtttttttggcaaatggtagaaagataaccaaccatccatatagaagaaaataatgttggtgcctatctcacatcataaacagaaataaattccaagtgaattgaagacttaaagtttaaaaaattattaaaaatattggaagaaaatttggactagagatacaatctagtgattggttgaaacattgctaaccaaaacaagaatcctatatgctataatcttaagagaaaaaaggtcaacatataaaaagtttaagagaaatttaggccaggcacggtggctcaatcctgtaatctcagcactttgtaaggccaatgtgggaggatcacttgagcccaggagttggagaccagcctgggcgacatgatgagaccctatctttacacaggcacacacgcacatagctgggcatggtagtgtgtgcctgtagtctcagctattcagaagactgaggtaggagggctgcttgagccaggaggtaaaggctacagtgggccgtgttcatgcccctgcactccagcctaggtgacagagcaagaccttgtctcaaaaaaaaaaaaaaaaaaaaaaattacaataaaagatatcattgccaaattcaatatgtaaattatatatttggaaatgtaataaaatgtgtccatgagaattacaagtagttataaccaaaaacccaagtaactgtggcttggacaaattaggtgtcttaatttttgacatgtaataagaagttggaaggtaggcaatccagacctcatacaatgactccatgtggtaatcacaaactgagctcattctacctgtctccttagctgtcctgactatataggctttcatcctcatatttgtcacttcatgttcactgaatggcttctccaccttaaggcaggaaataaaagaaaacaggaaggtgaaagcaaaaaatgtatatgtgggctaagtttgtatcttttaaaagaagagacccagaagtctcttctagtaaattatggttatatatctttatccataaatgtgtctatcccagttgcaaggacaactggttaatatgatttgttttgtaattgtttttgtttctctaatctgggcatatttgcaactttagcattagagttattttactatggggagaagggcaatattaattccagaaaggtggctagcagtgcctgccacacaaatgaaggtagcgttaatgtctagactctacctaaaatttttgcaaattgataactgaggaaaacaacccaatagaaaaattggtgataaatatgaataaacaattcacagaagaaaaaattcagattatccttaaaccaatgaaaagatgcccaacctccttcatcgtcagacaatttcaaatttaagtaacaatgagatgttttgtattcatatgattggcatgaatttaaaagtgtggtaactcctattgccgtttgagatgtagaaaaattttaaattgttacagcttttttttaaaaaagattaacttttgaatggcagtttctattgaaagttttatatatatatatatatacacacacatatatatgctttgatcagaaatcctaattatgagactctcatagaaataaaaataccagtatctagctatacatacccaatattgcatcatattttgcggtggtttaaaaaaaaaaaaagaggaaagattaagtaaatgttcactaatagaaaaatggaattaagtaaattatagtaaatccctatcagggactattatgcagtcattttgcagaatggacttgatctgtcttcatctaaagcagatgacttagaaatatttccacaatgtattgttaagtgaggaaatgagatagtaatggagaaagataagaatgatgcaggttattaatctgggtggccagcgcttggagagaggaaggggagcaataggggaatatggaatggggaaagcaaaagaaatcaaattttagatatgtacacaagtaaaataacttagaattcagatttcctttttttttttttttttctgaggcggagtctctctctgttgcccaggctggagtgcagtggtgccatctcggctcactgcaagctccgtctcccgggttcacgccattctcctgcctcagcctcccgagtagctgggactacaggcgcccaccaccatatgcggctaattttttgtatttgtactagagacagggtttcactgtgttagccaggatgctctcgatctcctgacctcgtgatccgcctgcctcggcctcccaaagtgctgggattacaggcatgagccaccgtgcccagcccagatttcttttttaaaagacctgaaataaggaagagaaatcatagcataaactaagtttaacaagatcagtgtgggataaagaacagaagattgagaatttttttggagctgttcctgattagatgttagaagattttggttatcaccaatccttttcagagaaaaattttataaacttacaagtatccattgcacgtgctttacatttgttttatatcaatatgactgtaaactttatagagatctttttaatacatgaataggacatcttatttttaaggcaggtaaatgtgctttttctcacttcaaacaaattatgtccacaagctgaataatgagaagggtacttcatagtgtatcacactgccgaattacacgttcactgttttcatccttgaaaaccgtgggctgcttcagagtgggaaacagtcttcactgcttataactgagttccagaattttcccagccatctgattcccaagcccagagcttcggcttctgggttctgttgctggcagtgaggaagtgggatagcacattgtttaaatcacagcacttctctgtttcctggctaagttacaaaacagtgttgtagtcgtgaaactgaatatcatcagcacacatttgtggcatgcacagagcatgcacgactctgtagtagcgctctaggcaagcttatgatggcttttaaaagaggtgttgttgcttcctttaggaagtttatgaactaaaggaagacaaaaaccaaaccaaaccaaacagaaagcaatgcattggactttccatcacagcaattacatgtctgattctgggctttgtgcctattaatactcagtaatatccattgaatatgtgaacgaaccaaccacgttaacaggaactgtactgttatagcaattcttaactggaagttttgtcttctgcctcactccactagaatctatctccatccagttgaatgcaaatctgataatatttttttcctatggtttccagatagctttaggaatcagaaagaggcactgattgtaaacctgaaagtgtgctttgtggagcctgcatgatgttttaaataattgaattagaatgccttttaatgagcggcacactctctagttttcccacagaaaacctctagcctatggtgttgaataggtgatcccccagctacaggataaaatcccaactcctcagtgatgtacagactcttcccactttatcccttgcttattatttcagtcttgagtcccaccattttgctatatgcaaccggcactctagccatgctggattgtttgctgtttcctgaatatgctgtgctcgttcagtcctctgcaaatgtacttatgctacttctttctcctgaattgcttattctgtctcattaacctagtgtactccctcctacccattcatgttcaattaaaatattactgccctcataatatcatttttaactgacctagaaaaacaagttagatattcacatcttcaatattccatctatttatcaattgttgcactttttatattgatacttatctgactcttcacccatcagaaagatggagttctctctttgtacaccttgcacctatcactggcttcatcacaggatccctatcacagtctttttgatgaagcattgttggatggatagatggatgcatggactaggtgataaatgaatgatgaaccattaagtgaaataaggagtgtggtatagacttggaaaagaaaagttactgttgaaatagctctagagaaaaatattttttaagagttgtataggataagatgaaggtgaggatgacttatctataattttatctttggaaattgtgagttaacatttgtaaacagggtggatattttggagagaaggtgctacataactacagcacaattatttattatcctctaaaatagtccctttctttggcatgtttaaaacctaaagtctggttggcgttataaatatgcatgagctgttgggggaagagagcataaagtgtgaatcacacttcaaacagacccacccgctcactcccgacttcaagtttttcagaagtgtgaaatgaaaatgctttaaaattagaaaatgtgccatcagaacttttatcagccctcggagaaaataaataatctctaaatgtggggaatgctggggatatttatttagttagtttcacagctaagatgctttgataaatttttgtgtcataaaatgcacaaattaattttaatgaatgtggaaacaaataacttctaaaacagcctgagtacccaaggctgcaatctagggtttctgagggattattgaaacctaatctatggacaaattgtctcaatggggaaaagaaactcttacaggtgtctttccctctgatacatttgcatttgaagggtgatcttgtagcatttgaggagtgggtgaatttctggaaagagacacttggatcttaaattgctaaatggtaacgaaaatgagagaaaatagtacagttagctgtttgctttcgagtttgtggaaagtgattttctaatcaatgttactcttgatttcttaagcataacaagattaaaatgagtgtgaatataaaagatcatgataaaagataaaggatgatgacctgagatcttctttattttttattactaatttgtttgaagaatagtccatcatttccagtaactttttgaccaaaaaaatggctatgtggttgttgccatcaaggccagtaatagagaagagggacaaagagagaggtgctccattggtatcctcaacctgtgtgtagtacataggcatcactgggtgggctggagctagcccagatggctgggctccacccaggtttcctgatgcagtatgcctggggttgggcagcctgagttgcatttgtcataccctcccaggtgatactgatgcacactttgagaaacactgctctgttccaatacttacatgcaatttttttaaaaaaattatgtaatgaccatctgtggttaaatgctgagctcattttataaaccttaagcgtcttggcaagtgtctctgtcttttttttaattgtctgataatttaaaataccattttattagcctactattgtggaagttgaaactctattatattcactctgttattgttaaccacctcacattttctgtggtatcgtagaacagaaattgttctaaaggaatggaaaaacaacatttactttcatcaaattgttgtctagcctcttgattgagttatagctattgttactaatttattgctagtttttacaacatgcccatgatttttttctgtttcagactgaaagtaaatctgaatagatgaaatctaatttaagtacatgctgttaggttctgtgttttgggggatagattaaaaatacaagagaaagcacaagacaacatgatctctcacatgtatacatatgttcaactgcatgtcttttgttgataatctccaaaacatacatattttgacttcagtaccataccagatactggaaaccaagtgataagatgactttactctgggatgtgaatgtcattgagtcagcagctttctaccaaatcattaatctctgcccaggtccaaattgcttcagtgattttcctaccactcagcattttccttggtgaaggacccttccaatacaagtcttctggcttttctttctactagagggaaggctttctctcagcagctatttctaaaatgaggctgatgatgagagtgatagatgaaaaaactcatctctgaggtttgtcttcttcttgcatctgctgatagcactcacttctcagctcctctttatacctaaaagatgtgcttctctattatttcaataattctgatgctgctcattctttacttattttcagagatgtttatgagatttcaagctccttaactagacatatacaaagagcaagaaaacaacaacaacaaaaaattctccctggtcttttctggaactaacaatagaatacttgaccaagaaccaagattgcagactatctcagtgttagtggaaccatttcacttctcgatgttttcttataaaacacacagtttgagctgtattgttaatctacttggaaagatattatcattttttaaaacaaatatctgctgggtgagtgttaggcaatggctctcaaagtgtagtcccaggaccagcagcattagcaaattcccagttcccacctcaaacctgctgagtctgaaactctaggggaggaacccagcaatttgcgtttcaacaagccctcccagatgattctgatgttatagcaattcttaacttgcttaagaatttggaaagtcttacaaataagggcaggactgggtggagaaaatggagaggtctgattatctttcatgtaatccccacataatttggtgtctgcaggagacacttttatttgtttgctataaataactgggagcttgccagtggtgaagaagatatccagagaacattgtgaatatatacttagtttctccaacctggacagaccaggagcctttatgtcaagatcctgcacggataattcccctcaggtggagagctggtggtttttccaagcacccagccacaactgccactgcattctatttctttaatgctcaatcagtgcccctggccatttgatgatcattcctccctaatgttgtgaggtatttagtccaaatagtacaatccatgtttgctttctttctcttctagtaaaatgtataggttgctgtaatagcctgtgtctgccccagaccacaatcataaaaataataataaattacctcgctgtctctgggttttctttcaggctcaacatgtggtttgtggcttatggggtattgattgtgcattatcagtttagctcacacactgacaattacatgtagcgccaaggtagccgtgacaatgtagtccagttgccatagcaatgaaagaaggcctattgctgctacctgcaacctgctttatagtgataaacgtgctgcttatttcattttaattgaaatttgaaatcatagtctctagcaagaaataaatggactcattccccatttttcccccttggccacacaaaaacaagtattagtaggaaatatctgagcatttttaaaaagtaaatatcaaatttttgacagtatgttttccagtagtttcactggtactagaaacagatgaagagtgatactttgctgaataaaaattgaattagctctcatgtttttgcattcttaattaactgctattttttatttccctaagtccctcatcttaacagcttaccctgcatggtgtactttatataacagagactttaatggatttacttgctgagtttagttcatatctaaaaactcacagcagatatcataaggtacttgaaaattagaatcacagggcgctgtggaagcttttacataattgaaaaaattgataataataataaatatttagccatgtacggtttcacttctatgccagtgcctcatctatgcctcagacctaataatctttatgtgacgtcattactacgtactacagtcatatacaatctatagtgctatatgtagccaagagagagagatactgtgaaatatggtcaggaatgaagagattctatgtcagtcagtccaaaaaagatagaaatttagtacagaaaaccaaccaactatggaaatgaatagtaagatagtaactaaatatgtatagatgtgtgtatatgtatgtgtctgtgtgcatatatatatatatatatatatatatgcacacacacataggcatgaagtgccaaactatttttaaaagtatgaacttggtctataaagattctaaataggtcagtggaagactgggtcaaatctgagattccactttgaccttttgatctttatctgaaagaagtcagatgatttcccttttctggtacaagcctgtaagttagcacaacattttatttccctggactatgtgaagtatatagtagatatttaggacagagagaaacctatggtggggagtaaaatttaactagggtaatataaaatataggatctccccttaaagagcttatgatgacatgtggctgggcacggtggctcacgcctgtaatcccagcactttgggaggccaaggcaggcggatcgcttgaagacaggagttcaagacaagcctggccaacatgatgaaaacccgtctctactaaaaacacaaaaattagccgggcggatgagggttcctataatcccagctacttgggaggctgaaacacgagaatcgcttgaacccaggaggcggaggatgcaatcagccaagatcgcgtcactgcattccagtcctgggcaacagagtgtgaccctgtctcaaaaaaaaaaaaaaaaaaaatcttatgataacatgaaaacttatttttttataaagtgacctcagaaaatgtgcacagggtggggcatctcatgtgaaaagcatctcaatcattgattccagccacatgccatcataagcgctttaaggagagatcctatattttatattaccctcattaaatcttactccccaccataggtttctctctgtcctaaatatctgcttttagaaggagtaaacatgacttgggaattagatggctcccatctgtgaaaatggattcttaccagtggtgttttttgggtggttgggttataataaaaaggaaaatattatttcccttatattttagtctttcttcttactcctagttataatcatggtcctccaaataattatgatgataataaaatgatcaatatcatgtttaatttattttatgtccttattaatacttactgagtacctagcatgtgtgaagacgatattctaagtcagcagtccccaaccttttggcaccagggaccagtttcaccgaagataatttttccatggactggggttgggggatggtttggggatgattcaagtacattacatttattgtgtaatttatttctattattactatactgtaattatataatgaaataattatacaactcaccataatgttgaatgagtcggagccctgagcttgttttcctgcaactagatagtcccatatggtggtgatgacagacagtgacagatcatcaggtattaggttctcatgaggaacgtgcaacctagatccctagtatgcacagttcacaatagggttcacgcttctgtgagaatctaatgctgccactgatctgacaggaggcagagctcaggcagtaatgcgaggagtggggagcggctgtaaatacagatgaagctttgcttgctcacctgctgctcacctcctgctgtgtggccccagtttctaacgggccacagaccagtactggcctttggccacgggtttggagaccccttttctaagtgttaagacaagacttggaccttcatggaacctatattctagtaggattaagacaggcattaaacaagtaattacacaataaattacttaagttcaattataatgaaaaatactagattctacaagaaattataaaatctactataaaattctttagtgttgttagcagataatttactcaccatttaaaaattatatcattgattaaatcaattttaaaatgggaagtgactttgagaaacagacttactacaaacagacacataaagaaaaatctggtacatgttaaagagaaatattgctataaaatcagaatacattatatgaagtctacatttgaattatgccatgtgtcaagtttgttaagcatataggtaagatgtaattattattttgctcttgatctacttttattttttatacccttaattctaaacctttggattgtattgaactttaaaatacatatatttgattcatttaattttaaataattgaaattattatcaaaacctcattgctctgcttgaagcagtagctctacttccctatacttcagtttttcatgtgttatagcaagatctgtactagaattagccagttcaacccaaccacatctttctgtttcgtccttgccttgactgttaattagctcagtggatttttatgtcatgaatgcatttgttttctaatacatcttcattttaatgtaagatggttgaaaagaaggaccaagtcctctgagaaccccatagtacaaagtaaaatgcctcacatctgacaaatgctcagtaaacatgagtagtgggaaatcttgattatatgctcattaaaaatatatctatgtatttaaagtagtaagtctggtgttcaaaaggtaaaaccttcaaaattctaacacagttcttgtttggattaactctagtctataatcacaactcttctgtttccttgtctgcactgtgctcacataatggctatgtctcttaccgccaaagcccggctcactgcttacaacggcatcctgtttcttcacctgtttttcttttgcttacctgacaagctcttgcattcataaaagtcgaaaggattccagcttaacgtttcaatcccacaaagttgacttccatagcgtagcctggaacaccttgtctgtgaatagatatggaatcctcaaatggttttgaagccactaccagcaacaggtctgagatcataggacccaagaagaaaattgaggctggggaaccacagagagtctttccacaattcaaagtaataacaaagcagccacaacagcagaggtggggagagatgtaggcatcagattgcctagagctctaacaacctaccctccacatagaagctgctctctgcttcaggcttcagatccttaaatatgggtggggtccttcatttagtgtcaaagaattgattagaaagctcctgcaatgtaagctcattaatgaaaccattttggcaggccagatgatataattagcccaaacaagatatgaaatctacagtgttttgggcaactgttcagtaatttttaattttgtaataaaaaagacaaggaaaggaaacagcaagagaagatgattcatgcttattggtgaaaaagaataagatataaagaaaaagattccaagataacatttgctagatgtggatagtaccttcaggtttccatcatccttctgaagacagtagcatttacaaaaactgtatcatctctacctttacaaaagtaggtgctatgtcaatagtgtgtttataggatgcatggatattcttcaaaccaaagtataatcacaaattctggtctcgtcacagacattcatttaaggaacatctccctcccctgcccccatgctaacctgagctttctggaggatgataaaggcgacctgaataatgaagtacccaagtctcactactgaggcgagtcaggggtaaagagtttagcactgagtggctgaggatacgtatcaagggaaaatgtcatccttgggacttctctttaaataccagaatatgttttgttttgttttgatttgttttcctatcagggatgtgtctttattggcaatccctaatggaaattgctctctaattttcctctagtcttcttatttgtattgtttgtatatgaaaagatgagatgaatagttaagggtactgcacaaatactttgcttggtcctataggctctcaggtttttttgatatcatgtggcatttgtgtcaaattgagttgtgctgtaattttattaacaagcttcacatctcagaatattttacagagatgcacctaacacagttgacatgttgtctattaaaagttacatcatcttaagaagttattagtccttttaaacatcattttcattctaataagctattttttatttctaataagctatttcttatttctaataaactattttttatttctaataagctcgtgtcttgagcagaaacactaatacccaggaaattttctgaggactggctcacttaaaatgaagggaagtcactccacgctctgagttgtcttctctcatcttcttcatgtgaaatcctggacacttgcagattcatgacaattcagagattattaatccaattgcttttaataaagactgtcctgaaagatacacatggtgaaacattctaattgtaaaagattcatagagcaaacaattctgtaacatctatttccatatgatttgagcaatttcacacttgggaatttttttttttttttttagatggagtcttgcactgttgcccaggctggagtgcagtggcacaatcttggctcactgcaagctccagctcctgggttcacgccattctcctgcctcagcctcccgagtagctgggactacaggcgcccgccaccacgcccggctaattttttgtatttttagtagagacagggtttcaccatgttagccaggatggtctcgatctcctgacctcgtgatccgcccaccttggcctcccaaaatgctgggattacaggcgtgagccaccaccgtacccggcccatacttgggaatttttactacagctgactgaaattttttatttgaatcctattttatatatgaggatactatttcttctttacagcattaaattttctagattaaaaaatactcatttccccccaagattttataaaataatttctggcacttctctaggttttctagctgtatgctattttgagatgacttggagtcaaactgtctgggttgaatcaaggctgtccccaccagttactgtctgtctgaccttgagaagttatttaacctctcagtgtggagatgttcatggtacatatctcatagggtttctgagtggataaaatgttctgatacatgcaaaatagttagaatagtatttgcctggcataccttaagcactcagtaaattatagccattctattttattccattccatgttaatggttcaacatgaaatagaattgcatccaaacaaatcgtgacgtcaagggtgttacctgaaaaaaaaaggtgtttcttacttaaatatattaagtaaatatagggttgtgtacaaattttaaaattttgctttactgtgggacttttagaccttttcatatataaatatgtattgtgtatatccaacgtggctaacatgccatgtctctctcttttttatgaatcacccactaacatctccagtgaatcaaatttggaaacaatgggcagtcacaataagatacatgtctgaaaacccaaagttgattttttcatgctttcagtaattacattgaagttgtcccaaaggcagaagaaagaaaaagaaatcaagtctccaaaatttctctatcctttagaaagaaactccaccttaatttttggtgaggagtaacagatctcacttgggtggtagttacattttgtgatgtgagggtgtcagctttttctccaaggatgacctcccaagaagggcagggtcactcacttctgctacacttcccagctgtctcttttggctttgcacattcctgtctcatgactctacagggaaatccatgatgtagattttcctgtattcaagcaggcaaagatacgggtcaaacatttaaggccgttaacaagaagttaaatcagcaacaacatttatatagaggcattaattcagggtgaacgcaaaatgtgttgcagcatcgattctggcatttttctctgctcctaatagctctgagcatttgatctatatgttatatggacctaaatgaagggaaataaacatctggacagattccttccaatcgagtttccttcttaccatttttctgctgtgatagttaaccaaggccatgggcttcgttcacctagaaccagcctaaaattaaggatgctggccagagtacccaagtgtgatgcttgtagcatttaagcatacagataaattctttttgaaaaatttcaaacaagtgtaccatgagcggagtcagagcccctcttgaaagcaggttggtaaatttccagaaccacttagcagttttcataggtggcaaggcattgtattgttatttttattattgttaggagctaacatttgtttccaggaactgggctaaatggttcaaattcattatctcatttaatctttacaatatttctgtgaggtagaaagtattgttatctccattttagagatagcagttatagaagaggcatctggagctaaaacagattaaatgaccttttccctcaggttcagagtaagtgtcatattgcaccccagaataattctgtgctcaccataatgatttacccttctaaaaggtaatataatgcaatttcagaaattaatgattcttaaaaatgtgtaagcatgcagtgagccgagattgcgccactgcactccagcctgggcgacagagcgagactccgtctcaaaaaaaaaaaaaaaaaaaaaaaaaaatgtgtaagcataagaaaaaatagcgaatgtccttttctagcatcacactagattttacgggtgattacaggaagacccttttgagattttcagcaatggacttttcttggatgagacggaagatgctctcagctggtgtgactaaattgtttgcgacttgaggacatgggtcatgccctctgtgtgtaccactcactatatcctcatcacagttcctgcataaagcagagattcagaagggtcagtcgagaacatggatgacaacccaacactgtaacccagcagcttgtgtcttggtgtaacattggtaggttttgtttgcctttacatttttaccataagaggtcaactagagtttctatcttgttacaagttcattacacaggtatcccttattccttcattcaacattgcaaagaaaacatctgtaacatgctttgagtcattaagagacattgcatacagtcaaaaaatagcatgaatttattaaattcagtactttggctgataaattgagaggaaacctttattgcaatttggtggtgatagtggagagtctctttccaaatataagacctagcattaagaagtatttccaagtctcctattttaggaatctcaaatctctaaattcgagatatgtggaaaaaataggcaattttcaagaaaatttgtgttgctgctagccctttggcttgtacaatacatatttttttttttagaatatactggaaagatgaaatctctaataggtatctttctggagaacagtctttatagcaaggttttctttacacagagcaaccatgcacatgtagttaatggatctccagacaaaggccatttcttccctaaaacaaagccaacaaggcaattgagccaagtaacttcaaactccccagaggggacagcagccattcttaaatccaccatacttttgaatagctatcattggtcattatcttccaaatggctttgtaagtgtctaggcataatgtgattgctttggaaattctccatttttcagggtgctgggaaggacatgaacagacacttctcaaaagaagacatttatgcagccaaaaaacacatgaaaaagtgctcaccatcactggccatcagagaaatgcaaatcaaaaccacaatgagataccatctcacaccagttagaatggcaatcattaaaaagtcaggaaacaacaggtgatggagaggatgtggagaaataggaacacttttacactgtcggtgggactgtaaactagttcaacccttgtggaagtcagtgtggcgattcttcagggatctagaactagaaataccatttgacccagccatcccattactgggtatatacccaaaggactataaatcacgctgctataaagacacacgcacacatatgtttattgcggcactattcacaatagcaaagacttggaaccaacccaaatgtccaacaatgatagactggattaagaaaatgtggcacatatacaccatggaatactatgcagccataaaaaatgatgagttcacgtcctttgtagggacatggatgaaactggaaatcatcattctcagtaaactatcacaagaacaaaaaaccaaacaccatgtattctcactcataggtggtaattgaacaatgagaacacatgaacacaggaaggggaacatcacactctggggactgttgtggggtggggggaggggggagggatagctttaggagatatacctaatgctaaatggcgagttaatgggtgcagcacaccagcatggcacatggttacatgtgtaactaacctgcacattgtgcacatgtaccctagaacttgaagtataatttaaaaaaaaaaaagtccctttcttctttatctcttcctccctgcccctttcactgttctgcccaacacaaagttcaagtcgtctagagacgaatatggcttttgcttttgtagggactttttcctgagtcccttcctagcagggtacatgcaatataggcctgtgagaataactttctgcggtgacacagaacagtgaaaactgtaagtcagtctatggtgagtgcaatcctacattatttcatgcataaaaaagtcatacatctgtatacatatataacctatttcacagtaacaataaaaacatatttatcgattcatcagaggatagacagatttgtgtgtctatccaaatgtattacactgtgatttttttcttccttgagaaagatttccctgaagacaatatttatggcagggcaggaatttatattacacttgaatatatgttctgacaaagaagcacattgcattttggaattgggtgatattggacattcttcaaaaaatcttctaaagggaaagaatgtttcatctactcatttgttcagatttccctataatttttagccagcagtcctttatggatcagatattgcatcaaaaaagaaggggaaaatattcttgtcatggagacattttcagattaagttgaaaaggtccataatccttacggaaattttttttttaatcatcatcaggctattcttgacagtcagtaaaatatcaggtctttctcatttaactgacagatttcttctttttgctttctttcttccctctctgtatctatatctactctctttccagggctcacggcatatagtaagtattgaaaaaatgaatttaagtctaacttatacatacttgtgaaacctcattccttatgataaagaccttaagcttttctaaatgcagaatcagccactggtcatttttaatggacacgtagtggttgctattttctggagtgcaggattcattagggtcattgctggcatttggctatgttcagttgccccggtgtgctactgaaggcaagtgtccaaacgccaataatgtttggtttctctcgatattccgaggttatatatcaaaagaagccgtgtgtatggcttccagttacccatccagagaattcctgaaaaaagcaaattattcttaagatcccctggaattatgaatctcttggtggagatgcatggtagggaaaagggaaacttgatctggtttattctgaaccctttcttctcatcttatccttctactaagtcacttgaaaactgttaagaaggagaacatataggcattatgaaagaaactatgttgtagcagaattcttcaaggtctcaggatttacccttataaaaactgtacataatctaaagcataatagccaaaacaattcagtatgaatcagacgtacacatacataattgtctcattgagtttcccatctccactaagtcatggtcactgttttgccttggttatggtaactaaaagccaatggagattaacggaaagccccccaggagaaaatactcttttgcggtctttggatgaaggcctgagtatcagcaggactggagttctaaagaaactgctatgcccattgcatgagacacatgaagtaatgaactatagacaagtcatcataccagtatttcagaaagtgaaactgatataagaacacaggccagacaccaactcaaacaaactatggaagcagggagagcaaactgaaatacaaaggcatggccagtagccagagcaggagtgcctcagaaattgatgatagatgaagacaatttatgtagcagttcgtctaatggcagttctgcagggaggcatccttttgaaggtgatggctcaggttggcctacatgttcctgcccaattttaaaggtgtcataagccagtgtaattggggatctgtctggcttctgacttcttgcataactatgttcccacttacattggggtcttggcataatttgtctcctgacaaagagaaaatagaaaatatccaaatattccagccttatagcatagatgggtaaatataagacctttccttttagcattgatgacagtaaacacaattaatagctttctatttgccaggcatgtgacatacgactctgaaatcttgcaacaacccagttagaacgacttactaagacttgaagttaagtttgcctaaatgtatacagcaggtgattaaaatatggatttaactgctgatttgttcatatttaagatccttgacctttccactgttataatagtacatattgatattccactggcgatgagtaagcatgccttaccacttcacaaatagataaggtggcttctaagaaaatctcaaatagaggtggtcaggaagccacaggaccaaccaagaacccagaaacgacagtgcttactagatgctgcttgcattctaccatgtggatacaatgagtaaaacttgggtactaaagtcaaagtgcctgccaccacacctggctaatatttgtatttttagcagagatggggtttcaccatattggccaggctggcctggaactcctgaccttgtgatctgcccacctcggcctcccaaagtgctgggattacagatcccaactggattgggatcttagcacttacttgctgtataacttctccaggttactgatcatctctaagtctttgattcttgttctgtaaaatatgataatagtaggaataataatagtgccttctttagagatagttgtcaagattaaagtgcttagctcagtgcttgacatagggtaaatattcaacctatagtcaatcatcttaagtactcttgtctcaccgaggaaccatcaggaggtgtaggtaatatgcaaccttgaattagatgtaataaaatggaccccacaggaagtatttggggatattttaggcatattttccagtacacatatgcaatattagataatattttccaaaccaatgctatttaacctcaaatccagcacagtgaaaaaacattgaaaggtaaaagaaaaagtcacttcacttccatagttctcagaattaccatgtagatatcaaaaggtctcttccaactctgaaagtctgtgactaattttgttaaacccctactgtgtgcaaagtttgtcactgggacgaataaggttgacactctcagagaagcaatatgtaaaaagacatgtacaattctcttaatttttttttttttttttttttttgagacagagtctcgctctgtcacccaagctggagtgcagtggcatgatctcagctcactgcaaactccacctcccgggttcaagagattctcctgccccagcctcctgagtagctgggagtacaggcacctgccaccacacctggctagtatttgtatttttagtagagacagggtttcaccatattggccaggctggtctcaaactcctgaccttgtaatctgcctgcctcggcctcccaaagtgctgggattacaggcgtgagccaccacgcctggctatgtacaattcttaaaataagctaaagtgataaacttaccctatggctttgtcatagaagggttttaaagacaaaaaaaaaaattgaaaaaaattgaacttctgagaagaatggtgatattatagatatgctatagcctctaaataagaatagtgatgtttaaaggaatataaattaaagagaacactaaagggaaaagagagatggattttaccctctggatctgactttggttttaaattgcataggcaagagattggttagagagatttatttcaacctttagtagtgtattagcagtgtcacagaacaagggatatggttaaaagaaagaaggtgagaaatgcgaacaaacaagatagtgtcttggaatctgatttatttaaatttagattatattgctgttgcattaatctttgtataaatcatagttctaagcacattaaacttacgttgcagtcaatttttaattttgcaaaccttaaccgatgtttattattataagctgtgaacatttttttaatcattgagaaggcccctctcaagtgaaattttggttccaaatggccaaagtaactaatgggcagggaaaaaaatctgcttaaactctcatttcaatcacagttatgtggaaacatcttgaagacaacagtaaaggaaagagaaagaaatcaggtggatggagaagatacactagaggaatgagatctcctacatgagtaaagtgttttctaatgtgtttttcttgaatgatagcatcttgaatttcctacaaagtatggaatagtttacctctgactagcgctgccctacagaacaatgtcaatttattctaagactgcaatgttcagaatgcagatatgatcagttcaacccagatgagacaatcctataaatgtaataatagaaataactatttgaaacttgaaaatcagaagtgttttaactttcttcaaacacttagactataacaacatttttagtctaatgtaattagcgcaattttcagaggatatgtttatatcaagaatattcctgtgggagaaatagaaacttttaaggagaggtttctaggattcttagacaactaaaactttcgtttgactcagaccctgatattacattttcccaggattcctctcacttgtgctgttttcagtgattgctcaggttatttcgaatgatggcatacatatatcttctctgacatgcaaaaatgccagaaccttctttttcctccctctgttcccagaaagaactaagaacggtctagctttgagctaaattgtacagctgactgtttgttttgggaacttccaaatgaacatatttggtgttgcactggtgcatcccaggaacagaactgtctgaccagaagagcaattctgcttctggaaatttctagcacataagaagatagctggagggtatgtttgtctgtatagtttagaggctggctggtgctataaaggaaagtaagaaaaaggcaaagatatccttcagaggattcccccagaagaaagtagcagttatgaagttttattcctgaggtaggacaggcagtcagacccaagaggtctcagtgtctctccctgtgttggatgtaattgcttttcattgtcaatactgaaagaaggcacacaagagacaaatgaaatgtgtgtgtataaacctggctttggttttcagagacagtcttcttacaccttcagatctcctagatgagctgggccttacagaaaatacaagtcttgagctctatttgtttacagttttcaaattctcagcttctgcctgtaagatatctcatgtgattaactgatttttctaatttaagggagttattttctgtggaggaagaggctataaagtcacatttttatcttattttcttttttttttctctgatatttcttctctgttttccacattccttgtcactgtcaaaactggtaattaatcaagagttagtcatggatggctccttttccctccccttcttatccttcattttcctgcctgagtgataacgaatgatgtctcttgtcctgtacccctggcttcctctcctcagagcattcaagccagaccccatgacaagatgctcccagtgaagggagaaaactgggaatgacaaatgtgagtctgggaacccaggcatcaaggggtggacttcctgatctctaccacttgccatcatctatctctccatgtcaggaggcctttgggaaaagcagaaacaaaagagaaaggaaaagttctcatcccagcattttagcatcatgagaaacctggaagtacctttgcaatagcactaaaatatgatgagtcttgagtctttcccaaggttttgatacccaccagcccacgagtatacatgtaggcatacttttactctctactttctccagcttaatgtttttccaagtgtctggaggaaaataagagcaaacatctttgtaaaattggacacatctcttctttcattatatgattggtttatgtgtctgaacaccttaggactcagtctttactcttatttaactgaagagattaggggaaatacttcctcacccaccacagagtctgaaattctgctattagagactcatgcctttaggtgaaaatgttgcatctccaagaagacccatgaaaacagaagtgattctaggtagaatgaagatacaatataagctaatcgatgatatcctcctataaattcctttggcagatctatttactatggagatccctagtggagaggatggccttaaggaattgggaaataaaatagttaacttgagataggttgaaagagaaaataattcctgagaaaggaacacaatactgcttgaaaatagtactaatgtatttttacagattagtttttgctggttcctgaaccaaatgactagctgggacttcttattctcagatttgcctcacacccacttaagaaaaataccagattgacatcctcaagttataatctaaaatcccagggagggagcacactagtcaggggtgagattaaatgaggcaaaagtgactgcatcacatttcactgtctatagaggctattggcagatttatgcaggctgagttaagtgaatgacttgatagcctggatcacatctatatgtgtttttcacaggcatcatgtcttagttagttttatgttgccataacagaatgccccagactgggtaactcaaaatgaacagaaatttatttggctcacagttctggaggctgggaagtcttagtgcatgaaactgacatctgacatgggcctttgtgctacatgatcccatggtgaaagttatcacatggcaagagagcatgggagagagccaaactcaattttataaccaactcacttctgtaataatgacactgatccattcatgagaacagagccctcatgacctaatcaccttttaaaggtcccattgttcaacactgttgcattgggaattaactttccaacacatgcactctgggggacacattcgaaccataccaaacatccactctgtagaatgttgcccttaatatgctgtgattgatatagatagatagatatagatatagatttttttttccttttcagtgtgttttagtatattagttgggtctcatttgcttgcttaaactgttgtatgaaaaaaaagaaatgtgctgcaaagatacagaggtatattgtgcagctcaaattaggtcaggaatgttattaatttaattagttatccatgcaatatgctgcataacaaacaaccacaatatctccagcagcacaggacaataaacacttatttcttatggagctgtgggttgcttgagggtcagctattgcagcttgagactggctaaatggctccactaatctcagctgggctcactcaagggtctgggggtcagttgaggttcaggttatataggctttgctcaggtgggctaggtcagctctattacacatctcttatcctatttctgggtccagcctgctagcttgggcaaattcttttctgtttctacaggttaattttggctggttactggaccaaatgtctctgtggaaattctccttctcaggtttgccttatatccacttaagaaaaatgccagattgacatcctcaagtcccagtctaaaaacttgggtaggtgcatggtagtcaggggatgaggtcaaattaggcaaatgtgacttcatagccctgctgtaaccagctggaaaataagagaatgaacagacaaaaatagacttgtaccacattaatgacatactgattatttgaattagttaattttgctaggagtagagataataagagtgtggttctcagttgctgcttaccccgaacaagagtcttagtaaattgaccagctgagtcatttgaacttgattcttggtaggaagacttttgcgtggcttatctactgttttttcttctctttttcttttcttactgtatctgtaatttctttttttttttaattccatgatttactggaaatctcaaaggatgtttgaatgaactctaattatccgttgtctttgttgtcgctgactccactgtcaaaaacccaagccaggcatccgcttggtttggtgaccttaaccacaatttgaaggctgctgactgatcagggcagtggttgcggaaggttggggtggcaaacaacaaagatgtttcccgcaaggaatttgagtcttcctttcatgaaagacttctttgtagcatgcgatgctatttgatagcattttacccactgtaggacagctttcaaaattgtagtcaatcctctcaaaccctgccattgctttttcaactaagtttatgtaatattctaaatcatttgttgtgatttcaacaatgttcacaacatcttcaccaggagtagattccatctgaagaaactactctttgctcatctataagaagcagctcctcatctgtttaagttttattatgagattgcagtaattcagtcccagtcccatcttcaggttccacttctgattccactctgccacacatttctctgtgagtctgttaaaatatggataatccaaataacttctttctaatgtgatttatatgaaatggaagcatgttctccttcccccttatgtgctcttgttttgaattgcaaatattcagttttgcatatatttaaaagttattttgacagtatgtaatgtagatttaaaacattctgaagttggctgttttcccttgatcaattcttcttttagaagaaacactgtaaataaaccaacaagtgtcagagcatacagtatagggaacagccaaggacaatctgttatgatattctgtgtattaaaaaccagtttgtttataccactaggagaatttcattttttagtatttggatttgatggatttagtgagaacgatatgatttgcttcattagacagctatgccacagctgaacgatgtgcattactcttaatgctaaagggagataaatgtaatgatagaaaaagttaagggaaccaaagaggcaatattcctagaataagcagatgaaaatttaactatgatgcacagaagttaaatgtcagtaattccattcaactaggtcagtggaattggggcaggaactttcttcattgtagcagtgaagctgttagctggtttacttagaaaccttgaatctgaggaatcatctccagagaacacctgatataagctacagttttcttgactcatattccaaaatggggattgaactgtgagaaagactacaagtaatttctgagttactgaacttagaaaaagcaaaactggccaggtgcggtggctcacgcctgtaatccagcactttgggaggccgagaaaggcggatcacgaagtcaggagatggagaccatcctggctaacatggtgaaaccctctctctactaaaaatacaaaaaaattatctgggcttggtgacatgcgcctgtagtcccagctactctagagactgaggcaggagaatcgcttgaaccctggaggcagaggttgcggtgagccaagatggcgccactgcgctccagcctgggcgacagtgagactgcgtctaaaaaaaaaaaaaagcaaaaccttgggacttctttctttcccttcttattttcacctttccttctcttccttcttctctttctacttcccttcttgtctctctatttttaccttattcatttcctctcgtgcctttccattttttatatcaggaattaaataccctctagagtgaaacgatgaataaaatctactagtcctgtgagaaggacaaaattaaatgtgttgggttgtgtttgtgattgtgctgatgacagcaaaagaagccacactgaggattgaagatgagaaaaaacaaactacaatgttcactaacgtaatttttaagggagaagatataaagattaccagagttcacactttcaaattgtttgcaatcaattgaaagtcgaaaaaagttatatgttgaacaacatatgagaaaaaagcaagtgaccatttaaggtgatatgtgttaagagcaaatcaactgatagagatagaaatgtggatgaggaagaccaccactattccctggggtagtcaaaggaaagttggcctggtactggattttggataacactgaataagattcaaacagacaaaccatggttggggcccagcttgagcaaaggatcagaagcagcagtattccagacatgtgagaatataaatttggttcaagtagaaaggtttcaaatggcagatgactgtggaaaaataatttggtgaaaacttataaaaggcccggaatgctgagatagaaccttgggttctattcagtatatattttgagaaccactgatggtcactatggagaagaaagacgtgtgctatataatagaacaagaattgagaggtcattgactgggggagtttcctagacccagagaagggtaagaagggatacattttgaaggctggtacataaagagaattaagatatcaatgagacatattttaaaagccaagagaaggagaggaaagtggtcattttcagttctgaaggtgagagttttgaggtttggatgactatgaaataacccagtgagaatacccatttatcagtgggaaatcctgaactagagtttgagagagtctgctaagctaaagttgtggatttgcacgttagcctcctgaagaggatggttgaattcataaatatggatgatactctacagaaaagaagtttgcttagaggatttggcatatccatgatgagagtataccggggaagcaaggaaacactgaagagagaaggggtggtcagaagaactgtagaagtggggcaatatgtggaatagtgagggtctcagaacagacagaggacctgggccttgaaggccagctgcgtcatctggagatgaagatggaaggaaatggggatcattgaggatgaagaagaaaaggagccctaaaggtctcttacagtcatcactttgtccgtagaaacacatctctgggaaggaatgagttaggtttttcttattctttcttcattaataaaaatagaaaaacaggtggtgaaacaaattggaaaacaatgtacacacaactaatactcttgaagaaagagatttcacactgtgtcctgctaacctgttctgatattcaatggcacttgttacccaggagttcttttttaaatcactatctgaaatccctattgctctcctgtgagctgtattttttttttttttttttttttttttttggctttcctctgtttatcctcaggggacagaaagaacatatggcaactatctctcaagtaataatccttcaattttggaaatacgtattatataagatttttcctctctagccttttattctttgagctaaataatactaagaaatttaggctttctttatggtcatttcttcccaggacaatggcacagactgagtcaaattcagttcctaggacttggataaaatttatattgaagccactgctttgaatcagcgagcagtactgatgtcaagtttgcctattaggtagaaattcaagaatgaaatgatgatgacccttttgggaacaactctgtgcatcctttgtatcctgagagcacttatcaaaactaatagatgagtaataaatctttcaaaacaaagaaaaccgatggacaaagtggtgaaaatatagcatttgtctcttattgccaatgcgtggcacataccaactcaattcatatttgcatgaatttatgaaagcaaggatgaaaaaatatgtactaagatataaaattagcaatattatttttaaaaggttgttaaaagtcaaggccttttgggccaggctgttgggctgtttcttaaggatatgatattttatttattttaacatattcagaaacacctagtggtattaaaacctctgagattggcagcatttggccttttagagaatgttgactctactttctttctctagaatttattctatcattttttatgacagtcttaataaagatgattgaaagactctgggtattaattcatcaaccagtatttgttgcaggccaactaagagtttggcactgtgttccaaggggaagttaagtaagcacaaaaatcacaaactattaaagttgataaagctgctgatttaagccaaaatagtaattctcttgacaacataagagtgaatgtttacatagcattgaccttttgccaggcactgttcaagcactttctacgtcactacatatttcttttaatttttacaacaactcattaaacaggtactattactatccttattgtacaggcgaggaagcacgtgagaattggctaaagccatatagttagtaagccatagagttaggatttaaacttgggtccaaatcctgtatgcttaaccattactgcaccagagaggtcctccaggcttcccttgagtaatctgaggaatgaggtgtgtgttatcttttttttttttttcctcaatcaattgaggttttattgagctagagcttgagggtgtgcccaagataaacaagagtcacagaaatcctctgtggcttatgttctccctgaagaggttttcaggaggctcagttttatacatttccttgggggaaaaatgtgtgtaggaagagttggggggtaggcagaagaatgattgctctcatattgtctttgttccatacctgagaaaataaggattattagtgtgaagtataataggcatatccttgttttgtgggagaatatacaccttttttaaggtattaagattatttttttctgtaagttattgggggtacaggtggcattcggttacatgagtaagttctttagttgtggtttgtgagattttggtgcacccattccccaagcagtatacactgtaccatatttgtagtcttttatccctcaccctcctacgactcttcccccaaagtccccaaagcccactgtgtcactgtaatacctttgcgtcctcatagcttagttcccacatatcagtgagaacatacgatgtttggttttccaacctgagttacgtcatttagaataatagtctccaaactcatccaggtcacttcaaatgctgtgaattcattcctttttatggctgagtagtattccatcatatatatataccacagtttctttatccactcattgattaatgggcatttgggttggttccacaatttttgcaattgtgagttgtactgctataaacatgtgtgtgcaagaatctttttcatataatgacttcttttgctccgggtagatacccagtagtggcattgctgggtcaaaatgttgttctacttttaattctttaaggaatctccacactagtatacattccctccagcagtgtagaacttccccctgttcaccgcatccatgccaacatctactgttttttgattttttgattatggccattctggtgtccattatcttttaccagaaaactcctcctgttgaaatggaatctttcttcccatacctttcctttattggtctaatttcactgcctggaggaagatggagattattttctacagagcagactctggatctgaagacagccttcaaactcctccagaaattgtttcttcaggattaatattctctccttaaattgctacatatgacatttttcatttgtttagctttgcaaaacttgcctattcaaaaaaggatattagatagttcacagagatatacacaacagacaagcaagataatatatatacctccaggttttgtggcatcaatagatttgataaacatactttgtgtcttcattagagcagtagataaatgaattagggctgtacagagtataaatccctgcggcacacccctacatatgccccatctagaatttctcaaatatccaggccacatctttctgtcctagttacaatgttaattgccaattagcatgtttatgtcaagatttcctgtgatagcatttttctctgggatctaataacccagtaaccttggacaccagcattatatagtgatatggaggtggattttggattcaaaatgtgtgctaaagctttgcaataatagacaacttaatttctgagcttcagtctccttgtctagcagagataacaacaggtaccgtgcaccttcttaaggctagttgtatggattaaatactatatacatgtaaaattattagcagatagtaggtgcttaattataattgtagacatttgtcaagaatgactcatttggccaatggagtgttggcaaatgtttacttaataattaattggctttctgagagaaaaagctctggtttggagcatttgatgatttccctggtataaacactcccaccaaagcttttgagctaccatcatggcatcatgaaaggcagagttgggtagcgatatatgcagtcaaatggctcttgggagacagtgccagccagtgccaacatccccctgtgtgtggcccatgctacactcatactcccactcacaagtaagattgcagcattaatatgtgagtaaaaagatacaaagaaaaaagatttccattacaaagagctcccgtcaggtgctgatagtgcttgaaaaagagatggttattttagttacatttataattgtgaagcttcttctgcttgctctggtatatggaagtgccagttattctttccaaatgtgcttggttttgtctttctttacctctttctccctcaccctccctcttccaacaaatgcctcatatggtaacagttaccaagcaaagtaagggattttatgaaaaattccaaggtttgagtaaaaaaatgaacaccaaaatacccattttattagtataggtagcatccagttaagagttgggtataaaaagaaacatttgcctacccaaagaaagcagcatcagaatcttggcataagaaaaatagcattgtttagtatttgggtgtttacatattccttgtgagggtgaatgtctgaatatgctcattttcatattttaagtcatcatcaattaaacatttgtgggtgtatttcttgtgggctgactccagtggctgtcagtgaaaccaagcagctgttgggtagatatggaacaaaaacaccctgaatgttacactcctgattgcttcccctggcacaggtagaggtacttatgcacagggaaggaaatgaagggcatgcatccaggttcctttctagctgtctccttagaaatcactgctttttggacagtactgaaagtatgacacagctgagacttggtgtatgtacacacacagtatcatatttgattgtgttggttgcttccttctggcaatcctttggcaggtggtatcacattcttccctctaaagagcattaccaactgagatttccctttgtgcttagtaaatatttaggcattgtagattgtgtcagcaatgattccttttatgtttcaaaggctggaaaatttttcttccttgacacttcactgttgttgatttggggaagaggtatgagccaaatggacattggacaaggaattaaaatttataattgccgcgaatagtaacttttccttagctgctgcttcgtacttgaaaatggaatgccctgtagcttgggaaccgaattttatggtggctctgcttttgtgatatttcattcaatccatttaacagttagttgtatttttcaattctaattaacattggtgtttttaatatatatcttaaaactataatttttgagctaagaagccttacaacagatacaccagcaaagatgactagaggtctacaagagtgcatcataagtagagcaatttagatggacttccttctgaactgctgcctaaaaagtttgttactcaatcttatcaccatagttcagcacaaagttaatgaaaatagggctgtataattttgttgtaaaacatcaagtacctgataattatcatcaccatccatctttatccaccatcatcaatcaccattattgtatttttattgcttggattaattcagtcctaatagagcataatggtatggaaattatttaattacattataagtacacactctatcaagtcagaaatcatttagtcctatgacagaaatccagcaacaccacctcctggtaggattagctatatatgcctttaagatatataacttaagcatgcagagggatatatagattgactgacagctgacttttcttctatttctccatgttgctacacttaattttgcctctatttcaaggaacttcaaacacagtgtttaaaagaatcatttaggctctccctgaatatacaaattttggtacctcatcattgtagttctctgataaggctcttggaatccctatttttgacaagcatgccagatgcttctaataacttgtctggaagaacatgcatggaggaacacaccattctgccctcataaaagtcattcatttttctgtctgtttttgttatatcactgcccaaatggaatgtgactatcaatacataataatttcagttactaatatataaattattagcattaatttgcatcaagttatactcatcattggtaattaataatgatgatgaatgatagcagatgtatatatggtgcctactatgccagacattcttaaaggatttgcacgtattaatccttacaagggccttcggaggcaggtaatattatatccccattctctagaggagaaaactcagctgaaggaggctggtcactgaatcacagaaggaagagagcaggctgtagaatcagatggcatgggctctatgtctgcctgtgccacttactggctgtgtgtcagtgacaagggtccatcatctcttcttgactataaagaaaaactggggatacagctgctgttaactccagagacaggtggtgagaattccatgagctgaagtatacaagtatttaaaggctagcctgaagagtaggcatgctctagaaatgttaactgttatcaccttttcttgtgacaaccctgcctttccaataccttttctaatgagttattgtcaataacatcccagtgctgctttctgaactgtgactatctttagctagtaaggagtgtttggtgtctcttttttagaatttttcttttctttttgaacattgaagagcgttcaatttttaattaatcttaataggcacacataccaatattaggcataattaataaccttattatctcattagaaaggcagaacacaatgcacataaccaggaaactaacgtacaagtcttagtgttcattactgctatgatattcattcacatgtttagtagaaaagaaaaaaaacaaaaacattgagccccttttcctaccggatcaagttacagatgttagcctgttcacaaactttcccacatccaggggcgatgtcccccagcacaccatccctccccagctgcttcctggccctcttgcctctgaggcatgctcacaaaaacctgtgagttttgaaagtattttcacctgccagcatcaatgagaaatcttctgcaagtcccctccccatgttcatttctgtcagttccttgggttacggttctcagtacataagtgtcattagcttcacctgggattttttaataaacgcaaattcctgaatactaaattcggattcagtaggtctgcaatggatctcaggaatctgagaacccccaccccgccccaagcgaacatgacacttctcttcgaaaaacactagcttcaattgtagagaaaaccaaaagtgcacatgaatggaaatctgggacatagtaagacaaaagagactgaagtaggaatagcaagcatttcaaaggaaaatgaggctgtcccttctgaggatttcatattaacaactggtgcaaggaaagggaatttgcagcagagttcagaataggggcagtgaggaagtggagttgaatctgagaacatgaataaggaaaccactctgaagatgagcatgtggcataagggaaattgccaccggaatgtaccctctctacttccctaactcctctctttacttctttggcccgttctttctgccacaacctaccactaaagatcctgctttgaatgaaccaaggtcccaggggattgttgcataggcataagggttgttcttggaagcctctgggtttgttgatacagaggatccctatggctccttgatgataattcagttgtgaaggtatagtattgagaaactggtctaaagtttttatggtatatatattttaaattttatttaataaatatataaaaagcactgttctatgtgttttaaaaatactaacacattgaatcttcttaagtactttgtggagtaggtaacgttattattccaatattacagatgaggaaactaagaagttaagtaacttgcccagagggtataaagaggaagggacaaggtgattgttccatactttaaaggaaccagattatcatatttgtagaaagaaagactacattttgagtctatcccaaagagtgttatttgaagtaattagactgtgtagctctgaaagaattggaacccgcaattcaaaacaatttaaactgttctggagacaaagctaactctctggtggggtttctttcttctgatgataaatttgggggtcacttaatccaggacagttcctgcatttatggaaaatgagcatatcgaggtaggattaaagaagtgaattcattcattaggctctatgccatcatggttcatttttttctaaagctgagccaagaacatctgtaccccaattttttattttcttggccaaaaggggacaaataacatctcacactaagaacattaaaatatttaccaaaggtcttcttttagcaaagaatatttcttcattgcaatgcctctgaacatcttcctgaatcaattaatattcatctaaacttttattttctatgactaagtaacagtaatattcataatagcaactgacattcagtgagctcttattctgtggtcactgtttcaggtgttttacctatattctattgtatgaaatagcacaacttactctgattaactcaattttattggatataacagttatttttcaatttctattatgacaaaaaatgttttattaatcatatctatagctaaactatgtaaaaatgtttgtaattatatccttagaatcaattttcagaagcagaattgccagtgtaagagtatactttaagaaaaaaattcagcacattttaccagttttcctgccaagaatgttataccaatctatattcccaccaacaatgtagcaagacttttgtgaaaagtttttttgtttttttgttttgagatggagtcttgctctgtcacccaggctggagtgcagtggtgtgatcttgcctcactgcaacctccacctcttgggttcaaacgattctcctgcctcagcctcccgagtagctgggactataggcacgtgccaccacacctggctaattttttgtgtttttagtagagatggggtttcaccatgttagccaggatggtctggatctcctgacctcgtgatctacctgactctgcctcccaaagtgctgggattataggcgtgagccactgcgcccggtgtgaaaagtttttaaagtaatgaattgctagttagcaacctctgagttttttaaggtgttgtctagcagtctttattaaaaaaaaaaaacagaggtccaatcacctatttccttagaagagggaatcaagggtatatttcagtctgtctataatgcactgctatgtaattactagggaaacttctccaaaagtcacaatgggtaaagtgttataaattctgagtcataagtaaagtttctactatgtgagagactctcattccctgttgtcactgagatcattaaggtctcagttcacatgttacctttgagagaagtttttcctattatcttatctaaaatagtcttcccaaggtctattccattactctgtcttgttttcatagcacttactaattatctttgtttattactttattgcttgtctccccattataacgtatgcttctgggagtcaggagctctttcttataccagcgattttatcacaagacctaaaagagtgcttggcacatgaaagatgtctatatatgatgaatcagtgaatgagtgatgaatgaataaatattggtcctcttaaatcccaaagtcctctgtttactatttatgcacagctattagtctgtagtacaacactgttaagagacaaaatatgcatatggggcaaagcaatatttgtaactctaaggtactcaaccttgtagatgaagataagtgaggaagaaccagttattagagtatcaatggcattggtcatttggttataagcgtaagtgaatttccccttgaatttaccctgtgagttgctatttaatggtgttggacagttacagataagtttggtagaacttttctctttgtttccttaagggttttgcctttgggtaaccaccttaatttcttcagtccctgtcttccatggataaagtcttagcagagctattaaagatcctaatgtcaacttctcttaagattatattgtccattaatgggtgttctgagagatgttattttgagatcaagtgctaaagatttacaatacacactttaactgggagaatatgcttgtttcactaggacagatatgtttctctatggtatccccagcacttacagtaactggcacgtaggaagcattaagaaaatgttgaataaatgaacaagataatcaaattctgtcttgtgaagaaacccatttgggatctattatatgttctgggtaattcctctgagcatcagcgaggatctgtgcaactaacactctggtttatatctaatttgaactgctgattgtgggcagtagaaattatttcagtagaaacttagctggcttgaatttatgagatattattagtctcattaagaaaaatgtctaccgacttctttaggaagctcatgtcttcagaaagtttctttgagatttcatatagaattccttggttttaataaacgttcctgacttctgcatatttgctattgatgcaacaatgatgcttggatcaaagttactttgtcactttctaattcatttattttagattactcagctagtagaaaacaatagagtcactttgttgctgtaaagtctcttcgtagtatttggtgggattgtgctattcttcagtgggctggtaatccctataaagcttagagaaacacagggctctttaaacgatcctttttctcttttctgttttaaatttcatcacttggttatttttgccacctgcttggattgcctccttacccaaatctaaaattcctacagtaaaataaatagaaaatgtggtcgctactctccttcaaaataatattttcatttctttggacaagtatgttaatttcttcatatgcagttgtcaatggtccaggtttcggaaccaaatagcctaaatttgtgtctggaccccactacctgctattattgactttgggcaaactagttaacctttctgtgcctcagttttctcatctttaaaatggggctattaagagtacttctctgtattgtcattgtgaattatgaatcaatacataaaatgagtttagaagaatgactggcacttcacaagtgctcaatgttaaattgtttttattgggaagaaatgaaaatacttccttgcttaatgttggagaaaagaatcactaacccatcgcatctctaagatgatgatgataattgcagttgccatttattacatccctactgtgtactaggcactgaattcaatgctttgtccaccttatgtaagtgaaatctcacagcacagtgaagtattattattattccatgttaccaatgaggaaacaggagaccctaaaaactgagttctttctctaaggttaaacagctcataagggatggagttcagatgtgaatccagttctatctgattttaaatcctgttctcttaattgttatgtcatgtcatctctacagtcttcaataattgagacttaatgttctttgattactaacatccagtggctattccaagggaattcaaaacccttgtcttcatgactttcaaaagcaacccaagtcctgaaaacaacatttttgtgaagtatattagtgtaatccaaaacatgataaacactttttaaagatatttgcagataagactcccctaccctcactgttacagtaacagtgtaattttccctggtattgctctgaacattaaggaattaaaacacttgaggctggacttgtcaagagacctatttttgttttgttatgttgtaatagctgttgtttctgatatttttctttttccttcattctgctttttctttctccaatcttggcttaaagggcaacttcctgtgcatgttcaggaatctgtggcaaagggaacaagtatgataatttgtctgctaccatttggatgttactattgtctcagcagccaggaaaacagacagagcccctgtgagcatcattgtgtttgggctgcggctttagttgccaaagtgcagtttttactgttggcatttccaccacctgctatgggcaataaccatcgaaaggacaaatccccttgtctgtgatttttctttctaggcttctttggagaaagactgtgaaatgatttattcctctgtacatatgaagctatagtgtattctccactgcatagttttggcctctgatactctctgttcttaggttaatccattaacttgcctgggggaaaagggacaggaaagatggatgaaggtgttatgaaaacagagatgagaaggatcttaaaaaatcccaaccactgccttttcttccctgttcccatctgctcctgagaagtccttcagaggatgccaggcctgttaatacctatactttatacctgttgttttaaatgaggcagttcttcctcactatatggatataataaacagttaagctgtcttcctctatgcccctcaaaaggagacaaacacacaagccctacacaaatggtatcgtgcccaaatgagtgttggaaatgctggataaaacaaaggtaagtaggtcttttcattgcaggccttctcagagccttaaaaaaaaatcctcactcatattttgaatctctaggagagacatatagtatacaacattctccaaatttgtttgaccttggaatgcttttttttttttagaagcaacttgagggacaaaagttctgtagaacacgctttggagagtattgggatagattactttcattgcatttttgcaatttggtttataaacttaccttggagattgggcaaattggctggttagtttagatacaatatatttttttcgggttgcaattgtatttttacagtagctagcagaagctgtggttctgaaaagatactataagaacattatcttgtgttctagaaaatagaaaatactctattttcttccccacctccatttttcccctgtctttagaaaaattaaagtatacttaagaagaggaaacaaagtgagtggtaaaggtgtatgcctctatagatggacaggtgtgttagttacattatatccaagtaatgtgtaagtgggccttattaatgagatcctaagaaactataaaaaatgaacataccccagatttctctttgtgtacactttgaaagtgtttttccatttctattaaaaagtttaatttgtcatgctcatgaaatcaacataaatttatggaggcagaacataatacagtaaaaagacaatgtgatccttttcatgtggcatttttaatacattgtatcacaaattacttcaaagaaacaattaaaagaacaaggaagaacttaggaggttcttaaaatagtatgtagcacattttagaactcaagtgacagagctttcctgatgggcccaagtcctgtctcctctcaccctttttttttgggggggggtggcgggaacaaaacaataaacacctttattacatgggtgaagacaaaacgaggatttatttgcctttccgggccttgatcttcctaagatagaactccaactctttgccctctagcacatagccatctgctcggccacatccacacagttctctcactctttcaaaatgtcagcaccagttccagaaggagggactggcccttgtgatggccataatgtaaagtgttcacacgaccaggtagcatttccattcttagaaagctacgcttcttagaaagctacgctacttgattctaagagatcagtcatacagacgtgtttttattcctttcagaggcaattcatttcatgaaaaaatgctgaaatgaaaacactttatagttaagcttggtgtagtcataaccacacatagctgtgttctgtcataatttgtaaattgagctctgtcataatatctatttttcaggaggctctcagttaaattttcttaaaaagtctttctgattatgaaagtaatgcatgcattgccctgtggcatattacatattactctctcatagaatatatagagagaaggtggcagtgaggacaattctgtggtcacctggaaggttttcctctggcacaggaaagacagctgtcctatttctagttgataaagtgcctagactgtgcattagaggccaaacattgaaggaagtcaaattgcctttttgttgattctaaagtggtctttgtatcagaaagtagaatctgaagaaatatgctgcaagccaggatgattatagttaacagtaatgtattatgtagtttcaaatagctagaaggaggatgttgaatgttcccaacacaaagaaatgataaatatttgagatgatagataggccaattactctgatctggtcactctatattatatgtatcagaacatcactatgtgcctgatagattatgtataatcatttgtcaattaaaacaaattagaaaacaacttacttgtctttttgctaaatctggatgtggatccagctgaatataatttcttcctagttctatgaataggatataggtcttggtttccatggtgttgtgtgacttatacttttgcttatctttgtcagtacttttgtgggaagaagataggggctctatcagaggttgttagcttggtgatgttttcacccacaaattcttcatttgttcttagaagttttctcatttctttgaactttccattaacattcaatctttcacttatatgaaaaatattttccttcctcctctttttcctcttccgtactttctccaaattcaggaggcagataatggtaattgaaagttctagggacacactgtgagctcaaggtccagaaaggttagggaaagtctttattttgaactgtaggtatgttttaattccttctggagactagcactcctcagggatgctgagactggcactggtgctaccggatattaaacagaatggatttaaagtattctcctgtattaagaagattattttcaaaagaaagctctattttgtagttattgtcactttcctaaagatataactttcctggagctgtggatcgccacaatattgatggcccatcccagcactatttaaaggcagggctttgtcatattttttataatatttgcagcttggtcaaataatatttattaaatgattaaataaattcaacagcacttagaaacaatagaggcagaaaatgaagttgtggagttggggtgtgtgtgtgtatatatatatagaattagtacattttcacactgctgatacaactgagactgggcaatttgcaaaagaaagaagtttaatgtactcacaatttcatgtggctggggaagcctcacaatcatgatggagggtgaaaagcacgtctcacatggcagcagacaagagaatgagagccaagcaaaagtggtctcctcttataaaaccatcagatctcatgagacttattcactaccatgagaacagtatgggggaaactgcccccattattcagttatctcccactgagtccctcccgcaacatgagggaattatgggaactacaattcgagatgagatttgggtggggacatagacaaaccatatcatacatatacataggtcagattggtaaaagttatagaagcaaatgttagaaaactattttgtaaagttggaaagtagaaacaataaaaaaacacaattcaaagagataagcattttcactggtgtttttttctggtgtgattcttccagagattattctggttatccattgctgtgtcacagaccactccaaatttagtggattaaaaatgataaatattttatgatgtcatagattctgtgggccagaaatttggacagggcacagtgaagatggtgagaacagtttgtctctgttccctgatgtctttgatctcaactgggaagaactgaggagctagaagtgactggcatggctgagacctagaattacctggaggcttctttattcacgtgtctgtgtctgagcctggaatgggatgatttgaaggctgaagttagctgagatggtgtggcttttccatgtggctcaggcttttcatgcatggtggctgcgcttctgagagagaagtcctgagaggaagtatctggaaagggagccttccaagagaaccaggtggaagctgcattgccttttctgacctatcctctggaggcacacagttacatttccaccacatttcattggttacatgtgaatcagaccaaacagattcaaggggagaaagaatgagcctcacttctttgcgcaggagagtcaaggtcacattgcaaaagagcgtgttggatggaagatgttacatctgattttgaaaaatatacttctctacaatattgtttggtcatcttataaaagtaaaaaatagtgtacctttataatatttcattgagaagtgtattaggcactttatcttgctaatgtaagatggttcactttaaagtgctctgtgtttgaaacattgtctttcttcacctttctaaagaacgctctaagatgatatatggcaaccaatcaatattacttttttcatttgtgtagcttatttaactacaactatttaataaatattatagggacattgtgttattccattttgtgaccctataaaggaacacctgaggctcgataatttataaagaaaagaggtttaggccaggcacagtggctcacgcctgtaatcccagcactttgggaggctgaggtgggtggatcacaaggtcagcagatcaaggccagcctggctaacatggtgaaaccctgtctctactaaaagtacaaaaaaattagccaggcgtggtggcacatgcctgtagtcccagctacccgggaggctgaggctggaggatcgcttgaaaccaggaggcagaggttgcagtgagctgagatcacaccactgcattccagtctgggtgacagagcaagactctgtctcaaaaaaaagaaagaaagaaagaaagaaagaaaagaggtttaatagccaaagttctataggctgtataggaagcatagtgttagcatctgcttagcttctggtgaggtctcagggaggttttactcatggtggaaggcgaagcaggaacagcacatcacatgacgagagcaggagcaagaggagtagtggggtgccacactctcaaacaaccagatctcatgaatttgcagagagaactcactcattactaagagcagggcaccaagccattcatgagggatccatccccatgacccggacacctcccaccaggccccatctccaacataatggattacatttcaacatgagatttgaagggaacaaaacatccaaaccatatcaaatatcatagaagaaaaaataaacatatgggaacatataagtgagaaaataagtttgtgaattatcaaaaagtggaaatagtaatatctaggcaggttagcatacataagtgatgttctagtggttctcaatctttgtggcagaatataatcatctacagaattcaaatcaaaacaaaacaaaaaaaactctggtaccctgctccctcccccagaaacactgatttaactggtctaaggtatagaccaggcatcaatatttaaaagttccctaggtgattgtaatgtgcagccaatcttgagaaccattgctttaaacagtttgtaaaatgtacgaaacagggaaagatgtttaattacaatgtttagttacatgactgaaattttatcaataagatctaaattctaatctaaacagaaattcatttgcctcttcattcttcaacagattagttcccagaggacactgttggattcatatctgacacgtaaataaagcccacacaccaatatccaaagcagaaagctgaaagggacctgtttccttgataatatcattgaaccattgaaatattgaccccataattgttccaattttgacttctaagaatgtagaatatttgtattttgtttcaactagatgttggaaaattctatagtttgcacccgaaagcgtttgaaacattcctttgtataaacacattttcttgattgtgtggtcaatctgctggacagatccactatgaattcagacagatctgggtttgaatcctggctctgctaccgtttaatgactttaacaatcttatttcatcatgcctccaaaaactgggagaaaatagaatacctgtttcagaaaatgattataggaattaaaagcatccattcttttattcaggaaacctttgagcacatgagtattccaagattgtattctgtacttggagtatataggaatgaacaagacagccacacttagcagaatgggagagggaggcaataagaaagttaaagaagagatgacaatgtcggtttctgatagaagctgggataaaaaaaggaggtagcaaaaaagtgtgaataggacaagtctgagactcaaatgataaaaggtagctctgcaaggaccagacaagcacatctaagtcagagaattgttaatacaaaagagtcttatggcaaaaataagattggtttatttgagaacaacaacaaaaaaggtcagagagcctggatctaatcagtaatgcagtggagagtgagaaaagtaagattggacgggtaaacagacgactgattaggtaagccaggaagaggagttgggatttattataaatctcatgatcagcatttataaaactttaagcaaggtgctaaattatctaattttatatataaaggggtaagagtgaagggggaaacctggttagcaaggtcttgtaatagtcccagtgagatatgatggtgccttgttttagggtggtgctggtggaagtgaaaaaatatatgtttaattttgctgtgaacccaaaactgctctaaaaaataaggtctattttttaaaagtatataaatgttagtaaaacacatagatttacatggtgggcactcagtttattagagatagggtctcactctgtgccccacgctggaatgcagttggcatgatcatagctcactgtaatctcgaactcctgcactcaaacaatcctcctgcctcagcctcctgaggagctaagactataggcatcaaatgcccagctaattttatttattatttatttatttttttgtagagacagggtcttgctatgttgcccaggctggtctcaactcctggcctcaagcagcccttcttccttggcctcccaaagtgttgggattacaggtgtcaaccaccatgcctggccagtaaatgctattttattcataatgttatcattaccattagtacaatgtggaagcaagatctggctctgtcattagcattgctttggtggaaagatttactaaataaagcagagagacttttccaaattgtatttattatctttaaaggctttcccctgaaggtacactgggatactaagaagacctgaatagcttaagatctctacaaaaggattccacataccggtttgggacttctaagggaaaatgcaaagattcacaacttttaatagacagtgatttttgtttctatatctgacggtcatataattatattttagcatcccaacacagttttgccataatggtgtgactctatgattgtgttgtattatgtaccacttcaacccaaattagtttaatgatgctatagaggcagagttgttttcccatcaaaatgggaacaagtatgcaaaagcaagataaacactatctttcagagtgatacattcaagcagcattggttttaagattaagcaaattcccactgccttgctttattagtatacttatgagaagctactttataggtcatataactgaagtgagtttataattatggcaatgggtctacattggaatgtagtttatagttactagctcaaatatctctgcctttcacgttatgttggaaaactgcatgctatctttatttcttagtttcacatctgtaaactgagattaagatctgcttttctgtttaaagactattgcctacatcagagaaatcatccttcagcacttgaaagactttgaaaacagaggcttcctaggcagataatattttgtttactatggttggttttcttttttccttttgaatagactttattttgtagagaagttttaggttcatagtaaaattgagcagaaagtatagagttctcataaacctcttcctatgccatcacacatgatagcttcccccatcaggagcattccatgcctgagtggtacatttcttacaattgatgaaacagtattgacacgtcatcacccaaagtacatagtttacactaggattcactcttggtgttgtacattatcttcatgtgtcaccatcataatatcctacagaatagtttcattgccctaaaagttctctgtgctgtgcttcctcattccctcctaaccactgtcaagtaatctttttactgtccccatagttttgcattttctagaatgtcatatagttagaatcatatggtatgtagcttttcagattggcttcttttacttagtaacatgcatttaagtgtcttccatatctttttttaatatatacatatatattttttattatactttaagttctgggatacatgtgcagaacgtgcaggtttgttacataggtatacacgtgccatggtggtttgctgcacccatcaacccgtcacctacattaggtatttctcctaatgctatccctcccctagcccccattccccaacaggccccggtgtgtgatgttcccctccctgtgtccatgtgttttcattgttcacctcccacttacaagtgagaacatgcagtgtttggttttctgttcctgtattagtttgctgagaatgatggtttccagcttcatccatgtccctgcaaaggacatgaactcatccttttttatggctgcattgtattccatggtgtatatgtgccacattttctttatctagtctatcattgatgggcatttaggttggctccaagtctttgctattgtgaacagtgctgcaataaacatacatgtgcatgtatctttatagtagaatcatttattatcctttgtgtatatatccagtaatgggattgctgggtcaaatggtatttctggttctagatccttgagtaattgctacactgttttcaacaatggttgaacaaatttacactccccccaacagtgtaaaagcgttcctatttcttcacatcctccccagcatctgttgtttcctgactttttaattatcgctattctaactggcgtgagatggtatctcgttgtggttttgatttgcatttctctaatgaccagtgatgatgagcattttttcatgtttgttggccacataaatgtcttcttttgagaagtgtctgctcatatccttcacctactttgtgatggggttgtttgtttttttcttgtaaaatttttaatgttctttgtagattccggatattagccctttatcagatggatagattgcaaaaattttctcccattctgtagattgcctgttcactctcatgatagtttcttttcctgtgcagaagctctttagtttaattagatcccatttgtcaattttggcttttgttgccattgcttttgatgttttagtcatgaagtctttgcccatgcctatgtcctgaatggtattgcctaagttttcttctagagtttttatggttttaggtcttacgtttaagtctttaatctatcttgagttaatttttgtataaggtgtaaggaaggggtccagtttcagttttctgcgtatggctagccagttttcccaacaccatttgttaaatagggaaatcctttccccattgcttgtttttgtcaggtttgtcaaagatcagatggttttagatgtgtagtgttatttctgaggcctgtgttctgttccattggtctatatatctgttttggtaccagtaccatgctgttttggttactgtagccttgtagtatagtttgaagtcaggtagtgtgatgcccccagctttgttctttttgcttgggattgtcttggctatacgggctcttttttggttccatatgaaatatgaagtagttttttctaattctgtgaagaaattcaatggtagcttgatggggatagcattgaatctataaattactttttatggttcaatagctcatttctcctgactgctgaataatgttcccttgtctggatgtaccacagtttatttattcattcacctgctgaaggacaccttagttggttttaagtttgggcaattatgaataaagctgctatgaacactcatgtgtagatttttgtgtgaatataagtttttagctcctttgggtatataccaaggagcacaactgctggattgtatggtaagtgtatgtttagttttgtaagaaggtgccaaactgtctttcagtgtggctgtaccattttgcattcccacaatctatagatgagactttctgttactcgacatctttaccagcatttaatattgtcagtgttttaaatatggaccatactaattgatgtataatggcatctcattgttgttttaatttgcatttccccagtgacaaatgatacagagaatcttcatatataattattgccatctgtattactttttgggtgaggtgtgtgttcagatctttggccatttttcatctgctgttttcttattgttgaatttcaagagtttttaacatattttggataacagtcctttatcattatgtctttttcaaatatttttcccattatggcttatcttttcattctcttgacagttacatcatgcttttaattgtagaattagacaacaatgaaataaccaaagccttagtaatcttaattagagattatcttctattattttctatttttcttgtttcacctgagttagaaaactgacctgcactgacttcctctttcacaataattccagtgaaatgaaagtgattagaaagtcttagcaaattcaccaaaagttagagccagaagactcacatttcaattctctacctaaagagaaggacaggcagaagccaaatatgtaaagagtttgtcagaagtatgccttggagccatgggcattgttcattactctgctgaatttatcttatggattttcccctccacattaatgtttcaatgatcttggttagattgttgaagtacaggttcctgctaggcatttctaactttttgttttaatattctcttatcctgttcatttactctcatttttccttttagaaatttactgccatcttctcttttagaaattcttttgacaatctgaaggaatgcagttatttatccctatgagcaattaaatacttttaatgggaatgtcatgtttttaaatcacatttcttataagaaaaaaatggtgtttactcaaatgaatgtggtctgatggtgatcctgatctatgagcagtaattgagatcatggaaataaatacaggaaagctggctccctgctcccttcaataaccaaatctatggtttagacattttttagcactttgctccaacctgttacagattatcaacattatatatgatgataataaatcagagcaccactttaaaacacaaaagtggttgcctctcagtgctatggcaaacatagaattttgaactttttgtatgactggtatttttttaagcgactatattttaataacgagctattgcatgtgactttactatgatgctcaaatatgttctatgtatgacggggaggaggaatgatgttaccatatgttggttctgaattcctattttattttattctcaggtggaaaaaagaaagaaaaaaggattcatcagcaatagggcaacttagagcggacacataggtactatggcagtgataagagatgagatagatcatcactatgcccttttcaattcttgggaactgtcttcgttaaacagttttagatgcaagggtaatttttttcctatggtgattgtagaaagaacacccagagattgggactagaagtcaggatgtctttagccttacttggttgtcagctaactgtgctgttttggacaatgcattcttttttggtattctgtttatcccactacaaaatagagatagtgagaattggattaccattgtcaatatgaagcacagatgaggtaagtgtgaatcacttgaggatatataaagtcatttaaaactttaataattataatacgataatatagttgttgatttagtttagtttcttacatatgatattctacatattcttatcacttcacagggaagcattgactggccaaagtaatggtgggtagagggaatcacttaccttagcttaaagagatgccaaaatctaggacctattcagagttatgaattatattttgttgagcagtgttcctccaaaattcatgtccttcctggaacctcagaatgtgaccttatttggaggtcacactggagatgagtgggctcttactccaatctgacttgtatccttataataaaaagggaagagacacagagacagatgcacacacagaggagaacattgtgtgcagacacagacacatgaggaagatggccagtaatgatgaaggcagaaattggaattactccgtaggaaggcaaggatcaccaaggattgctgccaactaccaacagctagaagactatggccatgctcacatcttgatttcagactgtgacccccaaaacagaaatggtgagaaaattaatctattaagtcacccagtttgtggttctttgttacagccgccctaggaaactaatacaggagtcaaggaggctgctgaacccagctggacactgaggggcatccacagaggtcaccaaagtggagtggccagaactagattttggaagccagatatggaggcaggaatccaagaagcagggagcctaatgaggaatagtcataaaaagagctcttggcagccgcctgttccagatgttggtgttgctgccagtttctatctgctcagtacccaaggcactttaatggactgagataggttggacaggttctgtttgaaaaaatcccttacatgcaaagtaagataaaaccaaaagccaaagtatcttgctttaccttgaagaaggaagcaactctccctgatcacagagcttccctacttggccataggatagcctcatgtgcacttagctcaatgttactctgagtttctttctactccgtctttctcgatataatcctaaaagttagggattcccaggaattatcatggaacaactggcttatgtcttagtttcctatcactgctgtaataaatcacggcaacctttgcaatttaaaacaacgtaaaacctattatcttagacttttgcaggtgagaagtccattatgggttgcactagtctaaaactagtgcaacactttttaccccctgaaagacatcaacactttttaccccctgaatctaaaataaaagttgaaattatttttagaaataaaaataaattaaaatgtttcgtaaaccactttggtttcctttctggtgtctctgaggcaaatgttttctgctcatttgagttgttggcagaatttaatttcttgtggttgaaggatggagatctggggtttttttgctggctgaaaactgagggccattggcagcttctagaggctactgtattcctagcccatggtgcctttcttccgtcttcaaagcctgcattcttctgcttctttgtccttttttaaagactcatgtgattagatcaggcccacccagataatccaggattatctccctttcttcaggttggctgctgaacaacctcaattccacctgcaacctaattcccttttaccatgtagcctaacatattcacagctctggggattaggatgtggacgtctttcaggagccatgatccttccttccacacattaactgcagctaagcaacatgactccccatcacgacagagtagaaggagaaactgaactgtgagaggggaaacagctttatcaaaacatagcaaatgtcaattataagcaaaaagagaaagtcaagctgcctataatatgtgcaatatatttattcttttataaacttgctgatatggaaattaaaaattaaatctacttaatggaaaatatttgatataagaacatcagacatatctttgataggcaataaattactttatagaatcgtttagcatcttatcttcagggctattttttggccctaactttgagcacattaattttgagttcctcttgtttctcttctatttgttccctcaaacccaatgtatcagaagttattttaacttaagttttccttgcctaattccatccacttatccccagaattgtttcatctcatgtatttattacactgttcacatatcaccttctattttcatgccccttgtaaacagcctaagaggcacattactggtaaagcctcagggtaaacaggcattgcctcccattttgatttcagctccatttaatgactttttatacccaatgtggacacatactcatttttagttttccaatgcagatttcagctatattttggctttattcctcttttttcatcctttttttctttttttttttttttttttgagacagagtcttgctcttttgctcagtctggagtgcagtgacatgatctcggctcactgcaacctccaactcccaggttcaagcaattctcctttctcaagtaatcctcctgaatagctaggattacaggcatgcaccaccacacccagctaatttttgtatttttagtagaaacgggtttcaccatattggtcaggctgctcttgaactcctgacctcgtgatccgccagcctaggcctcccaaagtcctggaattacaggcgtgagccaccgcgcctggcctacatccattttaaaatgaaaaaatatatatatatgtaatttatttgaagaaagtctattcatttacgtaacacttatcattgagcacttcgtaggtacctggcgttgttctagacactggaaacagaccactgattctgatgctcaagggccctgttggtggcattgcctttggtgcatccttttctttcacctcttatactttcgtgttaatacttccctacatggattgttttcttactttgtcatgtgtacactttccctacatggtgttttcttaccttgtcatgtgtacactttttttaccctttgcattatgaaatttttgtatcctgaatctcgtttggctatgactcaactttttaagctaactctatttggaaagagtctgattaaagaaaatgtcaccaaacggttaaatatgttatttctgtgcatgtttgttatttgtcaaggggtttcattttaacccaaatgaataactttttattggtggattgtacccatcctcgttagatcaccaaaggcagtatgtattctgatagggccactttgttgtgcctctctgctttcttttctctctctttttcttttctttctttttctctctctctcctttctctccttccttccttccttccttccttccttccttccttccttccttccctcctcccttcctcccttcctccctcccttcctcccttcctcccttcctccctcccttcctccctcccttcctctctttcttctcttgcctctttacctaatgtctcaaatggtaagtcaggccctgacctcacatgtgacagttaaaaagatgccagtgacatctttccccaaagcaatagaaaggatatttttcaactaacgatttaaataggtcaaagcaaacaggatactcacattaaaggaagaagaaactgcatgttatagaaagacctatgcattcagatacctttgcctgccctgaaattccatttttcaaattcatttgcctgttagctgaggacctttttaatggaactgatgttagtgatctcctagacctctgacagttcttgagagatagcaaaagctttccctgaagtgctagccatgtagcttatccctttaggcactctattgtagaagtctccctgataaagcttcctgtactcaaattcttaggggcagggaggagggataaacaattggaatacttttttgggatattaataattggttatttcaaaatctaaaaaaaaattaaaaataatcatttgaggaactctgttaaattttttaaaaagtgcattaggtttagatgtgatgaagcaacaaatgcaacagatgttgcaatgccaatcagatacttgactaagacaaaagtttaatgccaaactgcttcaccagaaatagcttcctacctgacagaggacactgaattgtgtcaaagtattagaggaggcaattggtaggtaaagataattaaagggacatccaacatgttttgagttctttctccgtatatatggagagagagaaaagggtatatttgtgccttggattcattagtaaaatgcattagctatagctgactgatttgcaactggtgcctgcctgaggtctccaaagagaggagatttacatttaggttttaagcttgggaaactttgaaagttcttataaaaaattagacagtcatttagaaatgtaaatatactgtatttctttctggattacacatttgctgaaattcaccttttagtttttttagaagggagcggtattggcatacgtgttacacttttttgcacatcacttttgaaatgaggttccagatggagtctcagccccagagtgtaacaaagagatcattggttacaacctccttcttacagactaacacactaaaacccagagaggttaaggaagagatttaaaatcacacaaatatttagcagcctggccatccatgactaggacccaagttaatcaaatttccatcatagtctttttttccttcccttcatcagcattatacttgcttgagtaaacatcttaaatatagaatgtttctccttttcattaagaggtcatctaaaatagtatgttctctattctccattaaacatagtttataagatttctttgcctttaaaatcagtttaattagggtaaaatttaatacataattgatcatacatctccaagttgaaacatctattctgtttttaggcttagtttagtcatttcccatttgtttgatttaaagtagggttgaaggggcacacagccccgggaaacttcagtgtaaagtgccatccaactctagccagattcttttatctaatcaccacactccctgaagtctctgataattatcaataaattgggtggtagataaatagcagtgtcatgagagaaggaaaaagctgaaggcacactagcagtgactctttctacctgtcagcaggatggaggagtaaagacagatctgtcctgtttgtcaggagcagaaagtatgctggcgaaaacgaactcctgggaagggaaggtgtcaggaagatgaattaccccaggaagccaggactgctctcccagtggagagcagctcacttggatataatttgccagctgtccgtcttgtcctcgtgcgtctctgtctttttcctcctttgcgctgccagcaacaagcctgtgctgtgtagatctagtgcagccacagaaccttgggactagctgaagggccgctagacctaatggcaggggtaactatttttgcaattgtgaatattcagcatgcacaggcttcctatcagctctcccaggagctctctgagagatggaccctgtgaggaaacatctttaaatgaacaccttagtagagaatgatcctgttaggtgaataaaaggctgattacatacccagaggtgagccataatgaggctcagagtaactaaatgcagcaatctgctgcactttgtatctggacttgagcctgagcatttcaaagtagcatctggaaaagaaaaaggctctggggaaaatcacacagtagacttgaaatatttcatttttttttctccaaagggaacttagggtagatttcttgggtaacggttttgaagaaagaaggcctggtgtgagaggaacatgttgtgttggcatcaccacctcacataaccaaactaacactctcctatcattgttgggtgctgagagagctggtggtccctgcctgtgtctttaaagtgacaagggttgcctagcctgaagattctagcacaacatcagcatcttacctacataaactgaagattcctcaagaatgttgaagcaatagtcattatgtttactacaggagtaagtgaggcatcaatctaccttctaccttgtgagttagccacataaagcagtgccacaggttgaaacaaaccttcttggtctggtttataatttaaattctccatggaagtagctgcagcttggaagctcattccattgaaaagttcactggctttggtgattcacaaaggagcatttcttatttggtgaattagtatcctaattaattcatttcatggagcaagcatctttgtgattctctcttctgctgcctactttctccctggcaggtacaggtaggattctaaagtataaagaggactttcacctggaaaccagaaggttgagttcttaaaggggtcatgatgcttgctagtaatgtgacctcctgctattcaatacttctgagtctccttttactcatctgtaaaatggggagaaaaaaaaactgtcctgccttttacccttttcttagcatacaagagttactgagaatgcttcagaagctattatgaaccactgtagcatcagctatatttatttaaggcacctattttgtatgttaaaatattctagagtatcttataactcttggttaatgaaactaaggactttctcactccttaggtaaaaaagtagtgtttatttcagagcaagatgttcaaaagcaagactaaacaatttgattcctgggatcatgccatcgggctgtcttgactctctctgattgctttcagtatttttattttattgggtagaagaacttggtaaaatgttaccctgaggctaaagagagctctttaaaatgactttagggatctgaatagaccagttgccatttattcccttaatatgattagtttcctaatagtcaaaggctgagatagcatttatttctcctaagtttcagtctaagccaatgtgggtgcctattagtgtcatagtgatgagtggcacagatgagcaaacagataattaaggaaaaccaaatatccttcccatcccccacctcacacccatttagtagttgactttggtgtaaaagtgtcttcctgtttcagtaggataatttggtgctcatctgtcagatagatggaggatggcaatgctaatttgtttctccaggcatacttgcctcagacttaaggactaaggttaccatgtagctcagagctgaaaggtaagagtcagaggcattcaatgattaaatagtcaatatgttctgacttctctgctaatttagcaaaaggaagaacatctcaattttgtcacttattaccagttgtttagcttgtcttagaaacatgccttgatttgaatagataaactacttttaaagcataagtcagcagccttttgttttatgaaatagtagtcctccatttggggcaattaaaatgaccatttctttggaaataaaatgttaaactggtgatggtagggtgaggtctagggggtgataggagagggaagttgagatttcaacagctaagtgcaaaagaaaattttaaaatacttagtattaaaatttttaacttgctactactttattggtctcatataaggacatgaacacctggggaagtaattggaaagggaaggaacataaaaaatattttatattctgtgaggtaaaaactgaggctaaaacataaataatttggcccaggtcatatggcaggagaatattagaatctggatttgatcctgcttttgtctggctgtggctgtgaaaattgagtccatcagttttcatcccatggcatctggaatcattgccccttgccacgtctttgtgtgtgtgcgcgcgcacgtgtgtgtgtgtgtatgtgtgtgtgcgtgctccaagttcatcccgatttctttaatctagccttgttaaaacacattttaaggtcagtttttaaggcacaaaatgtaggatgagtgagttgataggtagatatctattagcttgaaattgtattcaaaacagaacctcattcttaaaagtttaaaaatctatatcaattacccagcctcaaatatagttttcttctctttcaaatgttgtagaaaaatgcttcatattttctggctactgagcttcttaatattagagtaccatctcttcctacaattcggttacaggttgctcacttttagcgacattggctttctagttggagaaattccttagatttcaggtaccacatcagaatttctttcagttagggtgacagatccaatatactacatgtgtgtgaagtatagatgaaggtaatcagatctcatgcttcagggaataaactgattacccgcgatggtcaggaaggaattttcaccattagcatcctgcaaatacacaaacccaagtgcaagaatccaactttcttctatgtaaagttttcttgtagcacctcatcaagtgcagggcataaaatctaaacctatgacataatgtgctatgtataattgttgtcatacatgcatgactgtttattatgcaccaaaataaatactgtagcagttgagacagagtctagttagataactgagatagtgattcattaaatataaactacttaaaatcttttcatgtttcctccaggaatctcaaagtaccttcccaaaatgagctcattaatcctcatgaatattctgtcacataaattctgttacatttctctgaaaacataggttagtcaatcttactaactagtaagttctagcagcaagtcttcacagcactccaacacctttattgccttgaaatctcattagagatttagtttctaacactgttaatctagatggaattctttcatccctagctcattactacatttacccttcaacaaacatgtggtgggagtcaactgtgcgcaacgtgctgaatatgaaaagttaaatggggctcagggttcactgggaaagtgctggtaagttcattcacatgcactccagtacaacttggtatgcccagtgctgcctagcctagcaagaccctctttaatctactgttgccttcttgtacaggtctttatatcatgcgggctttgacacagataaacctactgtaatccgtgatttggttctaagagcctataatgaactccagttaattcagatgccatttagagaaacttggtcatattctaccttagaaaactcttggaataactttagttcttttgaaaattgcagtggtccagacatttttactctagtataactgctgtgtgtgtgtgtgtgtgtgtgtgtgtgtgtctgttgatcagaaactttataacgaggattagacttaaatttggcaagcttttctagataaattctagagaaaggtcccatgatgatcctagaaaatttaattaagagtaacaattaagagatccttttgaagtgcccatgtttaagttttatttgtttggttttgtatttttttctaaatattctttcagatcaaaccaagtctaaactggttactatttgacttaatgaaaggcctgacatgaaggaaggatgtaaataattttgagagaaaatacttttgaaatgttaaaacatttcttttgagcaatgttatttttattataaaggaaatagcactttcacctctgggagtgaataggggcttctcaatttgatacctaaaggatatttcctctcaagacaaacaaacaaaaatgtgcttactggggctgcaccttcagcccagcattggatatgttaattgctgacatacttgaggtctcactaagagaaaaatatcattagactgctggttcccaaaatacattcccttaaatatcagtcctatggagtggtccttgggaataaaaatcagggaacatattcaatggtaaatatatatatatatatatatatatatatatatatatatatatatataatatttatatatatattatatatgtattatgtagctctttattattattattattatttttgagacagagtctggctctgttgcctaggctggagtgtagtggcatgatctcagcttactgcaacctccacctcctgaggttcaagccattctcccgcctcagcctcccgagtatctgggattacaagcacctgccatcacgcctggctaagttttgtatttttagtagaaacagggtttcaccatgttggccaggatggtctcaaattcctgccctcgagtgatctgccttcgacctcccaacatgctgggattataggtgtaagccagggtagctttttaatactgctccctctctcttaggtattcacagtgcatattagcaaattaaatgttctgtgaagtcttgtattaagtacatcttttaatattttatttaagacttcccaaattcacttgaccattcactttgtaatattccttgacagaatacttgttaatatccagctcctgggaacacaatttgggaaatactacactaggaaaaaaaatctaggttggggaaatctaactaaacaagagtgtttatttacattagtaagttactttgtactttatgtgagtctccttttcaagtgagtttctcaagtgtcttaaaatactattttaaataatttttaaaacattgatatttttttgaaaatacattaagtatgtttttagaacttgaaattgaatgaattcccccttatcccttgtctgccagttctgttagtcttctcttcagtatttgatttatgagagatcaattcatatccaacttttcagagcatgtctcatgtcatgtgaaagacagcatacctatatttgtgtaagaaaggggagaaaacctacttctgagtgtaacataaaaactatgtgacagtcaagtatgataaaaggaaaatactggttatagggtcaagcaacctttatctctttttggcttactgtgagatttgggccaacaagtaacctctctgatcctgcctggataattgaaatgactattacttccctccaccagagagtgaatgatgtgtggattaaagtctgacctttgggcaaatgcctcctagtgacttgaaagaaggtgccctcatttctaacccacaccttacatctgtgtctatgatcccattcacagactggttctgaattaattctgtcagtcttgcattcttgcacttgccttcctgtcacctattcacttgcattctctctctacagttaggacattgtcaacacagattgtgtttgagtaaaaaagttcactcagagaaaaataattatagaaaggaaaagcatagatcaggagacaagtaaagacatacagtgaatctttaatccagagttgatttactcaagccttattgaaagataatcatgaagcaaaatgattaggtatggatgtgtaaatctgtaatgaatgactctgagtaaagattgtactcatcatcactagatttctctcataagtgcattgggttaaaaaaaagaattacctaagatcatttgaaattcagtaataagattctcttcagaagatcttttgattctgtagagaattaacatatctaattattatctgaagaccccaaacaccagatcctccaaaataatgttccttctgacattttcaacttgtataaaatttggttatctggaaatttactgcacataaggtccagcaagagaataattacactttattgatattttctcacaatgccatgagaaaatctggctgaagctgtgaaaaatgagttatatttataaaccagagatgttagctttccaaagtagtttcaaatccagacacccaatacacacacttccactcaccttcacgttctcacaaacttatacaagaaagtactcaatgatgtatttctaggcattaaatatttatatggtgtatataggtaggtatatatatatatgtatgtgtatttatgtgtgtgtatatgtacatatgttcacatacatttatgtatatgtatgtatatatgaatcataatttgctgataagcgttagacactattattataaatttcccttaatacacaaatttctcaatatcttagaagaaaattttcaagtatatgagagctcttctttctatcagcataggtgatagcattaaactgaatattaaccattccccagggtagagaaattatatctcagggtagaaaaatatatattttttgtatggaggttacttcttattgaagtgtgttagatctggccaggcatgctggctcacacctataatgtcagcactttgggaggccgaggtgggaggatcacttgaactcaagagttggagaccagcctgggcaacatagtgagatgctgtctctaaaacaaaaatttttataattagccaggcatggtggcacacgcatgtagttccagcagctagggaggctgaggtgggaggatcactttaacctggggatcaaggctgcagtgaaccagattgtgccagtgcactttagcctgggtgatagagtaagaccctctctaaaaatatatatatttttaaaagtgtgttagatctgcatattataaaatgacatgaattaagattcttcctccgtcatttatttctgttaaaaaaattcactgcttgcaaacatgtacatatatataaaccactgcacactaattatactgtatggtgtcacaagggtgttttttttttttacttgtaatgttttgcctaactttagagaaagcttgaaaagttaattaaaatcaacttatgtctcaacattttgttgcagtagaggaatttggaagaagggaaaagagaatagcaatgaattgattggataagaggcagacacatgtttttaaaaaaggatcagagcttgcccagtttctatttaaagtattgtaaggacctaatagctagctatagtgatacatttaagattaaaatgagcagatttggcggtacaggggagatgatggctagctggggatattagaaacagagctataaaaattcaacacaacctggaaaaatgcaaatgaatacaaccaacagtggggtgcagggttggttgcgggggacaggtggattatcttaggtgatatgctgtggaaggcatggagtttggctgcagggctgggtggtcacctagtaagaggaatgctttggctccttcccttgtctcttggaaatcagaagagacactgggccttttctcctttactccaagaagaaatgctcttttttcatatatctttattgaatacctattatggtccatgtgttaagagatggggaagcaaagagatacaactcatccaccctaccctggagaagcttattgcaaataccgtcaaatgcagtttgaaggaaatagtatgagatttgaattaaggacactaagattttattcatggattaaaatccgtattctgtttcttaatgattttgtgatcttgcacaggtccattaacctctgagcattagttatctgtgaaatgggagtaataattgagtctgcctcatgggaacactgtgatgactaaatgtgaaggtttatgataatgctctgaaaataatcaaaagtgctaaaatgatatggtttttaattatgaggtatttttaaatccaagcttgatagtagagtcagattatatacaaagggatcagagaaatagataagtatgggaggaatgataaatataggaagaacattatatacatcacagatgagttcaggtgcatgggggtcctggacttacaagcgggtgtgcttagtttaatgctctcctatcaccaccttgaaagttttaatattttttaaacaaaaggactcacttttttaatactaggcctcacaaattatgtagttagttctggttgtagacatattgcgtgtataaatacttagattagttacatgcccacaatattaatcattaagttatttgtgtatacatttaacagttacccatctatttatctatccctatagagacatattctcccatgtaggatgtgaggcacttgaggagtgaaacttgcttgaatggatctagggcccaggagagaaggcgaacctgaaaaacagttgttcggtctaatagttatcactagttggaagtcttgtacgttccaaggtcaagcgctgtgatgtgatacattacacacacacacatataatatttatttatatcatggaataaatgtgtaaatattactatattactaatgtatcttaattttcttttttacaaagatcctataatatcagtaggtctagaattaggtcaagaatctgcatttttaaaaaggcattccagcggcttctaaggcaggtggtttctagacaaactttccaaatactgagtgaaaagtttattcatgttgtgtttccattatttatgtgtaatttggagaactgggtgatcttttctccaggagcccctagcaacagatccagagaaagaatgtcatagctagcatttctttgtgttatttgggaccaatttcaaagttactgcaagatgtttgctttgccaagagatatcccatatccagtccaggccctattggatgccaaataactattagtgtacagaagcccccacttttccatgggggaaatgatctaagacccccagtagttgcctttaactgtggatagcaccaaaccctatatatactatgttttttccatacatacatgcgtatatacatagttatgataaggtttaatttgtaaattagtcacagtaagagattaatgacaataactaataataaaatggaaaattatgacagcatgctgtaatacaaacaatgtgaatgtattatagtctccctctcaaaatattttgttgtactgtactcacttatttttggaccatggttgaacaagggtaactgaaactgcagaaagcaaagtcgtggagaagggggaactactgtacataaagaaatagtggataataacaatgagaagatagattggggcctttaattctggataaaggatctgagactcttctcagaaggcaatagggaaccactggtcatacagaattaaataaaggagaaggaaacaaaaggtaaggagatcacttagaggctattacaaaaaaagtagagaagaggtaacaaaggccaaaagtgggcactaagagtaaagattaagaaaaaatatctttaattatggaaaatgtatggagattcctcataaaactaaaaatagaactcccatatgattcagcaatcccactactgggtatatatccccagagcttgaaatcagcgtgtctaaatgatatctgcactctcatgttcattgcagcagtattcacaatagccaagataaagagtcaacctaagtgttcatcagaggataaatggatgaagagaatgtagtaatgtggtatatacacaatcgaatattattcagccttaaacaagaaagaatttctgccatttgcagcagcatggataaacatggaggacattgtgctaagttcagaaataagccagacacagaaagactaaaacagcatagtttcacttatgtggaatccaaaacaatcaaatttatagaggcagagaatagaatagtggttaccagaagtagtgggtagggggaatggagagatgttggtcaaatggtaaaaaattttagttagaaggaattgatgataagtatttaagaaaatggatatattaattagtttgagttaatcattctatactgtacagatataacatcactgtgtaccatacaaatatatatatatgcaattatagtatgcccaaaaataatctctaagtcttctttttaaattttactttcataagaatggtatccatctgattgaagaccatcttctttcttctccatatgcaaatgtattccttatagaaaaatgcactcctgcccccaccccagcaaccatgcttcaggccccaaagaagttttcctccctgttaccttgcaaaggtagcctctcttgggaatcgctcactaattcaccctggaatactcttatgttagtttcccttatggtccctaacagcctttatctgttattcatctcccaggtactcacagcttgctgaaaggctttttctaatcagcattgttttgtcttctttaaaatccttgatcatggccactagcatccttgacagtctctggacacttggtgagaaaagaataaactcaatgcacaccagtgagagatcatgcccttttcttctgacaactttgtggcatctttggctgccctttttatgtgcttgtctttgtgctcccctacatcaatctcataaaacatcctttttttcatgcttgacatattgatatcatcccaccgcagataaaacacagagcagtgtaatatggacaggtgttggaattatttgcaatgcacagaaatctctgctgatgtttaagactaggacaatattaaacacattactttccctgacaggcattttcattacacccatgccatgcaggtgcagaatctagaagtgatatcttgttttccccaatagggtctatgcaatacaatttaaaagtgtgtttgggtgtgtatgtgtgtgtgcatgtatgtgtccttccccctttatatctttatctttgcaacatccacagcctcttgtttaaatcacatctgaattcacttggaggaatgacacaaattccaaagaacctgtagttaaaatagttgctatttaccagatcagtattcttatggttggtagtgtcacatggtcaggtttagagggcaactctgagataggacaagatgaaaaatagcctaggaaagatcaagaaagaccaacatcagaaagccacatagtcctccagagtgagttactatgtagcttagtttcatcaaaaagagaatcatggccaaggtggctgtattagtctgttctcatgctgctaaaaaagacatatccaagactgggtaacttataaaggaaagaggtccagtggactcacagttccacatggctagggaggcctcacaatcatggcggaaagcaaaagagaagcaaaggcacatcttacatggcggcaggcaagagaacttgtgcaggggaactcccatttatataaccatcagatctcatgagatttattcactaccacgagaacagtatgagggaaactgcccccatgattcagttatctccacctggccccacccttcacatgtgggtattattacaattcaaggtgagatttcgatggggaaacagccaaaccatatcagtggcaaattcaaatggctacagtaatgaaaacaacaataacagcaacaaaaggtaatattacttgaggatttatcttgtaccagaaacttttacatgctttacattcatgttgaaaattaaatgctggccaggtatggtggctcacgcctgtaatcccaacactttgggaggctgaggcagacagatcacttgaggtcaggagttcaagaccagcctgggcaacatggtgaaacctcatctctactaaaaatacaaaaattatccaggcgtggtggcaggtgactataatcccagctattcgggaggctgaggcaggagaatcacttgaacccaggaggcagaggttgcagtgagcagagatcacgccactgcactccagcctgggtgacagagccagactccatctcagaaaaaaaaaaattaaatgctcaaaacaaccctatcaggtaaatcactgtaattagcacctatttatcagatgagaaaaacaagactcataaaagtcatgtaacgtgtataaggtaacacagccagtgattcaagcccaggtctatctgactacaaaacttgggctcttagctttttgggattctatactcatggagaggtaaagctcagatcctagaagatcagctggagaagttagtgtatgaagtaggcaagccagatctgaggccaagctaagggcagaaaacaggagtcctgggccactcagcatgcatgctggctcaaaggagtgtgtttctgagcctagaatcttcactgtctcctgctcctgctaaatgttagagacctctaaaataaataattgcagtagctttgtggcgtgttttaattggctaccctctgggttccattagtaggtttacttactctaccctggacctaaagctgcagtgagggttgttacctccagcgaggagagtatttatcatgccctctccagaggtaactgcaattttgcttaagtgtactaatggcatctgctctcagctctgtgtttttcctctctgggtcttctgataaggtcattaggaagtgtgaggcagacaacctgagggctaaagtctcattcagctccatcagtcagattctgctgggactgcacaacccaaggatcctgttacagcatctgcctggaagattcttaagaaggaacttgcagttcattcattacatatgttctatgctgaggcataacagtggaggctgttttacagtgtatcatgccaacagtacatctgctgctggcaattatgctactaacatacaggaccttaagaactcttccttcccatagtttcactgagaaaaacaaaatcccagaagaatattaattgacattaatatgacacaattaaccatttattcaattggcctttccacctagaagtttaagcattcatctttcctgtatttcagatgaacaaaatgagataatgcattcatatactgattcagcaaacatttattatgacttcccatgtactgggtactatatagatatgcgagattaaaacaaagaaatacaatgtaaaaattcagattcttttaaggattccaccgtctactaggggaaacagatgcaatgatgtcatctataatataattttctgtgttgtgatagaatcatacataggacagcatccaaatacagcagataagcaactggctcagctagatttgggaggaggtcaaggcttcatgggggattcaatacctgagcagggtattaactaagagtgtaacctatataaaaggaatcttttttttgagcatttactatgtgttgaactggatgcagagtgctttatgtgcgttgtcataatcctatgcgtaaaacaatccagtgaaatctgtactatagccacatgtctcatgatgatggggatacattctaagaaatgtgtccttaagtgattttgtagttatgcaaaatcatagtgtgtactcacacaaatctagacgatatagcctgttgctatatggtacagcctattgttcctaggctataaactcatacagcatgttactgtactgaatattggaggcatttgtaacacaatggtaagttttttgtgtgtctggatatatctaaacatagaaaagggatagcaaaaacatggtattgtaatcctatgggaccatgatcatatatgcagtttatcattgatggaaatgtcattatgtagtacatggctatattattatcatattataaaatttccaagtgacaaaaaaaatctgaacccctgctctcaggctccagatcccagcttttagcagatatgccacactatcattaactacggtgtttcgcttaggaacatcaccaaacaaagctacttgttcttcaaggacccagtaatcatccttatccttgcacaattatcctggctctatcgtttgatgattttctttctgcaactaatgatttgggtagaaagaaaacctgccgatagtcatctttgatattgactggtcagtcccaagatctaggcattgaagtttctaagagtctctctccagtcctctatattgttctctgcatactcctccaatgtggtactgtactatgcagataagcacatggatgtgacctgatcctcctcaatcctatgctccctgacatctaaaatgggcccagaagcaaaacactttgcctgccgatttgtgcttttcagaagatgagcattttcttttacattctggacacacacataaaaaaacttttctatcattaacctgccacagccttatggaaattctgagaagtccagttcagcctcataacgcgtgaacgttatttatcttgaatgctgcaaatttggcatattggtggggggtgacaaggttaggtagatttattagcatcctgtcaggaaatttcccatgagcggtagaggtttgtcagaaaattcagtgtaattgataggagcaagttggactaattcttagtgctagatctgtactggctctgttcacacctttcctttgcagacaacaagatgtgctgaggagagctcattaagaagaccttcctgcaaacccattctttgcaccaggtttctttttccttcctttcttttatataattatttcagttactggagaagatataagcgtatattggaggcattactgaataggcaatgatttcaactcatttgtatgtatcttttaagtctccaagggaacacttaaactctagggaataaggattaacaagaagccgatatctgttcagtgtttcgctctattttcactaaaggattagaggtttcaactgtcgagtctaaaagccatcaaggcaggatataacagtggaaggaggttagcttttgaattaggattcttgggtcccagtctcaagtctccagcctgcgagttctttggccctgggacagttatttaaacttgctgagctttggtttcctcctttgaaaggtgaggttaatgatgcccatctcacagggttcctaataaatattaaatgaaatgaaaaatgtcacagctacttgacctaagcatctttcaatctctagttccagcactgctgcccctgaacagccttccttgatgtggccaagtaataacagccaccatttattgtgactttatgatgttgccacactctatgcaccatgctttgcatacttcatgtcattgactcctcagaatccagagagacagggagagaccatgggaagagaaagggagagaccatgggaagagaaggagagagagaagagaggagtagggagagagagagaagacagaggaaaggaaaaagaagagagagaaaaaagcgagatgagagagaagaaagaatgaatgagttctcatgtaattatggtcaagatattcatctttcctaagcctcagtttccttatcagtaaaacagtaaattatcacgtcttaactattttgatgactaaacgaggtgatttctgttacatgcaacccacagtgcctggaacataataaatccctaataaatagaataaaatattgttgtttctgatgataagtttcatttttgttgcaagcactcctggcacacattgcattatagattccatccactgattttccgttgtttatttcaatttcttcctcctctactagtctgcaaggaggccagagtcctttttaaaaaataatcactgcgatactgttcatcacacagaaacacacataaattgtttttaaaggaagaaaaaagggaaagaggaaggagtacaggcgcgtgtttggtaaggtgtcaagggtcataggtccttagattctactcaggtttttcttcataaagatgccatttctattggaaagtgatggctctgcctctgaaaacatttcacaaaaaccagaagaggaaaacaaaccaaaaagaaatattgctggaacactatagtgtgggcacttcaatgtagttttcctattccttatatttttccatagttggaattgacactgtaagggacacttttcacaaagtagcatattcccatggctggaacaaaataaccaactttgcaaagggagttgaattacttccattccttgttaggctaaaagccatttggcctagccagggataattttggcctggaaagctcagatttctaatctagcctgactgacctattcccagttccaagattttccacatactttcttccctcactcatggagcgattacatggagttaaatacaatacccttagtggaattgtttggtacaaattgtggtggcattgactctgtccgaggttctgcttacattctgtatgcctggatgctagccgatcctctccatccagtggaatccagccttgtctttatctagcataaacctcacccttcccttgtgatctccaaacatgtgaacagcctttttttaacacacacacacacttctctctcttctcacatcatggccttctttaaatgtcaggtgttttgaaagaagttagaggcctttagaaagtgcaagatacaagttaactctgtttaaagtttaatggcaaaaatcagaataaagcaaaactggatcaggtttacagatgatgagttttgttttccctgcaacaaggttaaaaactttttgagacaacattttaaaattgaatagtgtagataaaaatgagctgtccatgaaaattattagctactcttggcaaatcagaagacattgcaatactagacttgcattcccatgtagcaaaaaatttgctagtgattattagtgattgttttggacattctttgggtatttacagtccccaccattgcctatcatcccactaacaccaaagccaactgccagttctagtaataacaaccaaatatgaaaatgcttgagcaccagaatttgtaaacccagcccatgaatttgcattacctgcttgacctctggggtcgttggttttgcaaaccatactgtaaaggaaagaaaaaggaaaaaccaagttagatgtgttacataatactatttcattatattatctcttttttctcccttctacacttttcatttaccaccactccccaccccctgctacctaaatatctttatcccaatggaagatgcgttaccaaagattcacagtttatggaccagaagaaaaatgtggcttctaagtaagtcctgcagtcttatttctcacttctgtcattgacagccactaaatcaagaagaggttaagtgaaaattagcaaaatatgcattgccatactaacaggcagtaatagaacaatctgttcatgtccccacttcacaagtccactttcccaaaactaatcaaactcttccatctgtggaacttgccacagcaggtctttttcagcaaagaaagagcaacaagtttccctgcacatattttccctggcagaaatttatcaccttatttttctacatttcaaaaataaatattttccccttatacctttcccaatcttattttaaaatggaaacagccaaaagctaggtagttgtcttattctcttttattttcattgaaatcatttcctagactgtatacatacacattatgtatgtaatttatgaagttttgtttatatgagaaagcttcttttattttttaacatgcatttatgttgctttttgggctaatgtccttaaccttttcaaaacccaggagtttttccacctctattcttctgcatcacaagaccttacattgtgtgtgtttactggccttcataaaaaaattaaaaaaaaaacactctaaattcacatttcaccacttgttatctatcaccctctctcatagcttgtgatgtttacaaatgcttctgaagtattcagtccctagagtgagctttctttgactggtgggcaccagtacgatcatagttcacagcagccttgaactcctgggctcaagtgatcattttgccttagcttccaagtagctcagactacaggcgtgaaccgccatgttcagttgaagtccacatatgataacatttctgcctccacttaaaaccctccagacagcccttcaatgacctcggcttacaatacaaatgtgttatgattttccaggcccttcttcatctgctctcccttccttttgagcattatcccatttcatgcccccacacagattctagccataccccatgacttacaatttcccacaaagaatgcactgtggctccactccaggactttgcccatgctgggtccccttcctgaaatgccttctagctgttctctcttccctgtttgctgccatttccgtggacagactatacttgtctttctgttctaattgctctgaaatatacctctggccccccagctttcctgctcccccatcccctgtagtccttctagttttcctgtgtccccatgggacttctttatcctttttgaagcacctatcacactgagccataactgcatacctttctggatgtctctttcagtggaccatagttgcacactctcttcaggaagtgcaacttgtttgtcagtgagtcgccaatgccttatactgtaaccaaaatgcagattcagtcacttgccacctgccgagtccaattcacaagagcaagttctagtataaagaaagtgactttttattccaaagctagcttaagggaagaagtataggcttcctgccttaagagtactgcttacttttggagcagaaagcaggcacttttaaaaggcatcttggcatgaatggctcacaggggagggaaatgcaggtggggtcatgtaactcactgcagtgcctaatctactgcgtggttgagctggtgacagctggtgccttcatgggcagaactaggttgtaaacgtggccaaaactctcctggtgggagacagttttgtagcaggcacttcaggttgtacattgactgttgtctctcgaggtgatctcctggtgagagggagttctgctctggagcttctaagcacatagttagatgaacttgccctgtagggagtgtctggaaaaaggaaggtaaaaggttataattgcatgtctaaagagctaagtaggaagtagggaaaaaagaaaagagaaaaaatacattatctcttataaaaatgggggtactcattacaaaactgtgtctggcacatgaatgttcagtgatgttgactgaccaaggagagttacaaaacaaaaacttggaagtgggaggggcatagcaatcagggtcccaaaggaaagaaggcatacacaaaatggttacatgaagagaaactaatgaagggatttatttcccaggtaagaaaattagcaagtgctggtgaaacacttagggatgagaaaatgtgaaaagtctcaattgtccctaggtttgaatggccacagaagacaattggattccatgaacatggctggtgttgcaaccttgtgagagaggcaactcggttatcactttggtcctaaataaaataacccagctactggcacattcataacacatcagggagggttctggaaggaagaatgaataaatgcccaatgtttctcttattgagctctccactgccaaaatatacaagaagccagaggaaaaagacagtcttatgatgtgatctatacagcttatagcagtcagcctttctagtgggcagagaaggaaaggaagtgaatctgggatgaaagtgagaatatctaacccagtgtacctgcctagcagcagaggggaatctttgactataaaaatgtttcgttgttaaattttgaaataataaatgactataagcttttcataaagtatatacctgtattattaatgttcttatgctaacatatctggttattaaaaaatggtgcttatgcactaataaccaatcagtatacagagagctgtcaagtcactcatctgtaagtgctaccagctggggttaataagcagaactgtgacatgtgaatatttccttcatgcaaacataaacagaaatttgttttattttaaaagatagaggaattctaaatatatagtaaaaatagtaagtgtgtattccagaaaatcttagcaaaaagtcagaactaagtaaatgaataataaatgagtgaatgaggtaatataattggactacagagactaggcaatgtgaaggagagaaatatgatgtaggctttgggaacatgaaaggtagagtttgcttacactgaaagaaaagatagagaaaatgtgaacaatgtgacaaggatggatgttattaaattttcatcctaaattgtaagattcttgtcctcagagaaggaaagagggaggaaaactagtatttattgagtctctatgatatgctgagagcttttacaaacctttgcttgtttaattctcacaagtcactatgagtattattatctcatttttacagtaaggaagccaagacacaaagcagttaaagaactcactggttagtggtaaaaaccaggaaataatcccagattcatctctcagaagcccattccctgtttgcataccatgcaacattcaagaatctagtgaaggaaataacacacctatcaataattatatatccaagacagaatgtaaaaatactatgccagaagtagacagtgccttggtaacacacaggacagagaaactctaatcaggaattctgatccaatttcatgcagtggtggcatttaaataagtctttgagagatttttgaaatttgaatatctgatagacaacatgacttaaaagaaagaatcattttatttatttttgacaccttggtacttgacacaatgtccatcaaatagtaagtttcagtaactcaatcaaaaataaaaatgggaaaaatgacatcaggtgtgttcagggaaatggtgatttgttaaaggtctggtagtgagtatgagggatgggttagagtgaaggctacagctgacatgataggacagggctagtttgtagaggattttgaatactattatgcagagttagaactttccataggtgtgaaataagtagccactgaaggattttgtgcaaagcagtgaaattatgtgggctgcacattaggaagatttctccggggaaatgtagcaggccctattcgagaacagtgttggcagctaagaactgcattagtatgccattgtattcattcaaagaggtactagggaatgaacagcactctgagaatgggaaacaggggccgagctgaatgatgctgtggagatagtcatttctctagtttagatagggagagggaagggcgtctttcaagaaatgacttcagaattttgagcctgaataaatggaaaaattatgatgtcattaactacagtatacaacgtacaataagtaggggtaaaatgaggagtgaaaagtaataaggaaaatgatgagtttggatcatctgtagaaagaggtccagtaggtggttatggttcggattattggatgacatcacagatatagatctggggttcctccacttagaggaagtagctgaatccatgggaggattcacaggtggtgaacaataccattgaggatagagctcagacctgggagagcacatttttaagtgacgggtgataggagaaaaactaatgggatatttgaaaatgagaaattgtcaggttcattgcactattacccccatttttctctcttttattctctcttttctttttgtttcttttcttttcttttttttttcagggtcttgctctgtcacccaggctagaatgcagtggcatgatcatggctcactgcagccttgatctcctgagctcaagcaattctctcacttgagcttcacaagtagctgggactgcaggcacaccatgcccagccaattttttattttttgtagaaataaggtcttcctatcttccccaggttacatttttctctttctgatagtacctttatctagaacactaagtagctaatcctttctacaaaattaaagatagttactttagttgacagttaaatatcctattgtacttaaagttcttgtacattccgacgggttaatcagatgcctccaattccacctctttcaagggtggtgtatctgaatgtcaaggtgattggcataacactaatgcataataaccagaaatcgagtttatcttccaagatcttaatagaggatcctcctcaagagaaaacctttcagacatatcagccttacaactggaatctatttacttttcatttgtttttcaccctatttatgtcattttcctttttaattgccagggatatttatatggaaaagagttttcctcttcttatttctgtcagatcttgtagttgacatcttgtttcattctgtcatgccaatgattaaagctcagtaaaatgtccattttgcatatatggctttctaaagatccatttggaggagatcagatgttaaaagagaggatgtttgttgggggggtggtggtgggaggtgggtagggatagtactttagaaactgtttcagatctaagagggaattaacaggatttcagagggtgcgagaaaagtgggataatgttaagtattacattgaaagcagcgaatgagacctttccaaagtgatgacaaatacaacagaggagtgagggctggggcagtcagcaacacaatttttccactcacttgtggagctagaacataccttccctctgttttgtaaagatgagcctcctccctttcttagaacatttggagaacttcataactttcaatataacattcaagacatacttcaagagttgcccagccacatccattagtctaggtggcacctatgtggttcagtcacatctgtatgaagacttgaagactcccaaggaacttacatcagaaggagagaaaatggggttcttcatggaaacttgccatggatgaaggtacaacatgacccattgactagaccaagtagcgtgacctggatgttgagggaaggaggtggttccaggtcaagtttgaaactggttctgaacattcctagatctgttctcctgccttgtctgtgtgttttggggaagagattgtttgcaaaagaaagaatcctgtcacttgtgtctttactgttcttctgtgggaaagggctctgaaaggattgcgttttgacaggaggaaggtgttgaaccactactcgtagatagacagggaaccctgtgcggccatagtttaggtatggttgccagttctgtggggaatacagtaaaagctttcaaggacaatgacatacgtggcctccagagcatgaggctagaaatctgacatatgcgagaaggtcctctctcacccaaaaacttttacagaaaataactagggagggacatcctagagggcaaaattagacttcttgctaaccaagtgtattagtttcttcttatattgctactcttattcttcttatactacctgaaacagggtaatttatgaagaaaagaggtttaattgactcacagttccacatgtctggggagacctcaggaaacttacaatcatgatggaaggtgaaggagaagcaagcacattttcacaaggcggcaggaaaagaaagagcgaggcaggagctgccaaacacttttaaagccatcagctcttgtgatgaactcactcactatcatgagaacagcatgggggaaaccacccccacaatctaatcacctcccaccagatccctccaacatgtggaaattacaatttgagatgagatttgggtgggaacacagagccaaacgatatcatcaagcaagtgggtgcccaaaacattgaggcaaattgtggagtttctttaagtagaatacatttgtaagttcatagtttcagcttatgaactagctcttatttgatcagcatgagagcatctaaaagagaaataataaaacaaatggatccatctctcattatttccattccatggtctaacttatttttttcttgactacccttcttcctataagaagaagaagagaaaggtctgagaaaaatatgtgcccccataacactctggggcaacctgaaggccatcttccaaaagtcccctctgcctttctcagagaagagattgttaggctgatccatgcttctgtaacacacagtccacaagaatgcatggcatgcagtgacaaaccaagaatattctgataatctcagttgaatctaagcattctatggcagaaactcgcttttagtaatctgctatctgttaaagaaagaacaatttggtctcaagcagtggggaagatcagctcatttacaagactgtcacttaatgaagctccttggtgacttttctgtgatgaatttagacattgaaaagaaatatttcacctcttcactctgctccataggctcaagcagaaaaaatgggagacattgtatttctagtttctttcatccaaagctttgctcacttatgttgacattgtgctgaacagctgacgaacatgcgggcaggccaaggaggatgctgtcttactgttggactcttctctgggcaaagttcattattgtgctggcctcagaccactttagctgccatcagttgagaggaaaagaaagaactgcattaaaaagaatgtcttgcattacaggctttagaggggaaactagtgaaaaaactgctgatgctttgggaggcaatttcttccctccctgcctgcctccctccctccctcccttccttctttccttctttccttctttccttcctttctccctttctcccttcctccctccaactcttcctccctcccttcctttcttccctcctttctagtagatgtctctgattctacctcttttttcaattgatttatgtgcttttgcttggcaagtttgcgctaactcccataattgcttggaagggcggtgttgatttaagccttgtttcattgaaggagaatagcattccttctttcataacagaccaattaaagacgacacaatgacttcttctttctgtaagctttccttgattccctgagccaattttgaaattaaactcttcttcagtcctcctaaactcattgcacagaaacaatcacaaactcacactgtcaggagtggcccaggccatctggttccactgtttgcaagcctccatagtgccgtcatagaggcatttccacagtattctagagacactgtaaaccttctccataataggccagattttcctagcagggactaatactagctgatgatagctaataggtactgattgcttaccctgcctggtgttttacagatagtgtttaaatggcagtatagggttaagagtatgacaaccagagccagagatattgggttccaatcctaccatttaatccctgtgtgaccttgggcaagatgttttacctttctaaaccacagttttcttctttgtaaaatgggaaaaaatttagctactgcaagttgttgcattaaatgagataatttaaagtagaatgtgaatcgtaatacccagaatgttctaaaaattaatgttaattatcatccttattatccattgcttatctccaaatgctttagtgtaattttcaacatggtgctacatagcgaggattatgccctctgaaattgtcacacatcaagactggtggctgaaggccagcaaaatggtaattgtgatcattatctagcacattttcttctctagaagatggattttaagtctctgctcataagctgattggtagtgctgccttagattggtatcttctgttttggggaaagaaggtgattttgccagatttcctcagttttgatcattgggaatatacaataatggaaatttgccatgggaggctgggaacccataactaaacagtccatgataatcctatatccaactcttggaaaagggaaaaacaacacttcatctcaggattgcttcagggtgaatactgtgcctactacccatattaaatgcatttctttatgtccatccctcctctctctctctgtctctctccctctctgtgtgtctttctctctctctctgtctgtctgtctctctgtctctctctctgtctctctctctctctctctcacacacacacacaccccccagaagagcattttggccacttaaaggaatgctgtgaggaattacagattttgactgcgtaaaatattgtgcgttgttccaagcaaaggtaaaattctcaaactgttgaaattgtttttatcagcactactcctaatcataattactgttgtcattagtcagtgttgggtaccactaccttctgtgataacacttaacacattgttagcaattacacagaacttcccaattctgccagctccatgctacatcatcaataccatttcctgtagtagagtgccccctagcacctccacgcttctctcagtttaatttgctttttgagccccccaaagagagactactaaatatcaaaggcagctttcactctttagggacttgggctttccaagtggttaagtgcccagcattaatctcctgagatttgttcatctgacttcacagcagctggaacagggacagagatcttttggacagcctgttctgccagaagcagagcaggtggctttctctcgggtcacaattgaatttaaaaatcccattaattttgtcaagtcaacttaattctcttaacctgataattatcttcctttggaaaaagaacaataaaagagtaggcagacctctgttaagcaatgtttaaagtgtgtgtgtgtgtatgtgtgtctgtgtgcacatgtgtgtgtgcatgcatacatgtgtgtgacagaaagagacagaaagaaaggctgcctgactgattataggtttataaggttcacttcttagttcatctctgaaaacaagagattttggctgctgtcttatttgtccttaaataatttgggtgatccacctgggcattaggtcacagccttgggccctctttttaaagcacttgcatgcctgggaagaaggtggtaggctcttacagcagcaaataagagtgtattgcttaaacctctctttgaaggcagggagggcgagggggaggtgtgagatattttaaaaataagatgtgctgctaaattctctgccaacctccgttcatgctgagtggagtgtaagtaacaagtatcagatagttcctccagatgtcagctatttaaagagtcacatgctagaagttctgtggatagcaattgtcttattcctggtggtggtggtggtggtggtggtggtggtggtggtggtggtgatggtggtggtggtggtggtggtggtgatggtggtgatggtggtggtggtggtggtagtgatggtggtggtggtggtggtggtgatggtggtgatggtggtgatggtggtggtggtggtggtagtgatggtggtggtggtggtggtgatggtggtggtggtggtggtggtgatggtggtggtggtggtggtgatggtaatgatggtggtggtggtggtggtggtggtgacgatggtattaggaggtggatgctgcctcgcagaaacttttatcagcaagaaagtgtgggaatgtgtttgtgcatttgagaagtaagacaaattagaccagagggaaaaaaatgacctaataactcaggaagatcatgatatcaacctttgtacaagtaacatttgatttttaaatgtataaagcaagaagaatgtccaggaactctcaattcctgtaaaattattgtattttccttaagaaattaacttataggccgagaaattatacaataaggaaaatgattcttattcaattttaaacttttctctactgctttacctaaaatagactggaaaaaaaaaagttgtgactgttctcttttgttatctctttgaatcccagtggtaaaggacttcttcctacaagacataatgaattgatctgtttaagttagtaatcactgtgaggaagtggtagggtcaagactgattagagtcttcagaatttccccaccagttcaaatgatgttttcttacactcatgcttaaaagttctgcataagggtcacaaaaattgttaagcttcatttcttctcttctcttctttatttaatttttggagacagagtcttgctctgtcacccaggctgggatgcaatggtgtgatctcagctcactgttacctccgcctcccaggttcaagtgattctcgattctggtgcctcagcctcccaagcacctgggattacaggtgcgcaccaccacacctggctaatttttttgtttttggtagagaccaggttttaccatgttttccaggctggtctcgaactcctgccctcaagttatctgcccatctcggcctcccaaagtgttgagattacaggcatgagccaccacacctggcccattccttatatatttttaaaaataacctgttcttcttcagtttctacaaattctggctttattcttttgcttaatttgaatttcagctgtgttaataaccagagggactccaaaggatgtagttttataatttctctgagggtcagttcttccagttttatatggaagagaaataagatagctcccagctcttggctcattgttggtgacaaactcaagtaacaaacactgcctttctaatgggagatatcattatgctcaattcctcctagtgtctcttctaaaacagatactcagataaaacacttatctctgggagaaacagataggcagagaaaagaagggtatgtgattaagtgaaggtagcatttctagaactgaaactttgtcttttccttcaacttccatggcccttttgagtaatagaacaaagtagagataggtttggttgtgtcaaacacagtgggatcagatgtccttcaaacagactttgagagacagtgtggtcatgggttttattttttttcctcactttttcttttctggaatcttctgcaggcatcccaggttgagacacttgcaaaaaaaagataagaggcagctatacaggggagaatcgcaacctgtgtagtcaccatgtgaccacttgtaaaacagtcccagcatcccatcttagtttgtcccttggtagggcaaggaaggttgtgagcttttgttcgtgatgttaaataaagaacattgtgtgtcaaaagaagtagacttccttatctgctgtttacagctatgaaagaggaggtgttggtctttcttctaagctctatcttccagcttttttttcctaccttctgtttcacatgatctcatacagaaaacttctgactttccaatgtagggcttgttctgttgtcagcatttgtagtcagcatttctctagtgtttttctaaaacccttatctgcagggaacgtcaacgtggttgtagcatcaatagaataaggttttagttatatatatatgtatctacatatatatagttatctatatatatagctgtatatatagttatctatatatagctatatatagagttatatatatatagctatatatatggttatctatatagctatatatatagttatctatatatagctatatagttatctatagatagctatatatatagtttatatatatagttttatacacacacacacacacacacacacacacacacacatatacacacacacttagcttttctgtttcaactttgagtcataatgttgaatgaaaactgagtccaagattgatattctggggtcatctacatggagcactgaactatcttcagtgcattacatgggaaggttagatattggtaagaaagttaggaaatcaatctaatttctcctattctgtctcccccacctttccttttaccgtccattgtgtgcagaattcaagagtgccattcactcagttgtgccagagcataattgctgataaagtagagctgatgaatttgcactatggaatgatcctggtcatatgttttcctgaaattttctcaagttttgcaaatttattttctatttcatacttgtctaatatttttgatatgtacaaatatgtatctaccttattactttagtgagatgggactcatgttctctcatacacaaatacatatatcttatgtatttaaaacatatccatatctataaattatattttataagactcacatatccatatctataaattctattttataagactctagctaaaactgagtagtgttttaagaattgttaaaaaggcagacacgtcttgggatgctagcaggtgggaagtatgatctgtccttaataaaacatgattaatctcacaaaaaaggaaaaactctcccatttaaggcccagagaactaggctaaaccagaaaacagagaggcttgtgttggggagtacttttgacagatccctcacccccatccgcacagccacccacaacataggtgtatattgtctctgtatgatttcgtatctggtgctgttctgcacttctcagtttgggggctgaattcctcagcatccttgccacattacagaaatagaaagcccaatatcatagtcacaccaccaccccacttgccacccacaatgtaacagaagagcaggcagccctcagtttccgaaagggttgtattctcaatgttactttataaattctcagagctcagattatattttccagagaaatggtatattctctttccagaactcaaacacctactaacccagaatattcccaatgtcctagtcaagagatactatagtcaagtacctggccacataggaaatgctttctaaaagggtatgtatttggaattttaggttaggataccaatgacatatttttcaccattacagatttgataacaagatctgggctacccaaacacctacttgctgtctgcaaagatcctaggctagttagttctttatccaggttcatggcaaagtttgagaggagattcaaaggtaagaaaggggctccagctggaaaaggacatggtgaggtgctggacttgatgtgctgggaaggggtgaggaggagggtgagatatatgtgaggggcataatgggagcagtgggaattgggagacacagggagaagaaacgaaagctgaaggagtggactttgagggttaacaaagaagagaagcagaacataattcaattcaattcaacatactttgttgatcacccaatctggtatgtgccagaaaagtgagcaaagttgaatgagatgtgttctccacaggcgagatctcctgtaagggaaggagaaagggacatatgcagatttgcattcttggagcagatctgttcggttccagactagagatgcagaaagggcacagagaaggagagatttatcctgacttgaagatgaggggacgtctcatggaagaggaggcagttaagctagacctgaggatgctaagtgcctcacataagtagggaaagaaagcataagtccagtctgggaaaatggtgagtgagatgaaatcccacagataagaaaggtgctgtgtgtgtgtgtgtgtgtgtgtgtgtgtgtgtgtgtgtgtgatggggtgggggcggggggatgacaacatgcctacagaatacagggggatgtgaaagaacaatttaccttccagaataaacttccttctttagcactatgcacatattatcttggcctctaatgagactgcaatcctgcgggcaagttgtggttctcatgggatagaagaagtgaggatgggagagggtaccgaggaggggctctgggactttgagaatttggcagtttggggctagtgggcaaggagatttttcccacttcttgcttctctagatcaactactacctggcctattgtatgactctcagatgctaatgtggtgggagtaaagaaggaagcatgtccttggagcccagattatatttcagggtatccaaggcatcagagaagggaaacacaggggaaggaaatttttagaggaaatgtggaggcttggaatgctccacatttatacaatgtttacacactcaacattgtataaaaccagtatgaaagacaggattagtctgaatttcatgaaacattctcttgggcccctcctgcccacaacttcttttaaaaggaaaaatgaagtgcccaatcctcacatttcttcccatgcaagtgaacccctgaagaatggatgctgaggttggggctgctctctgatcagcaaattctgagatactagaaaaaaagaaggaggaagaggaagagaagcatgaggaagaaaaagaaggataagaggaagaaaaagagggagaaggaagaagaaaggaggaggaggaagaaggaaaaggagaagaggaaggaggaggagaaagaggaggaggaaggaggaaggagaaaggaggaggagaaggaggagaatgaggaaggagaaaggaggaggaggaaagaggatgaggaaagagaaaggaaggagagaggaggaggaggaggaagaagaagaagaataacaagaaggagaagaagaatcatttttccaaatatttgtcaaaagcataatgcttctattaaaatgttgaagtgcatatttatgtttcaggaatttggggagaggacaaatgtgtacaaggaggcagtcactcctgtaagtgctgcacacatacagggccttcaaagcaaagagagagttctgcatttcagggaaggcaaatggctatggacattcacagaaacctggagaaagtggatggctcctgggtggatagcaacactgataggtacaaagcgaagaaggaggtgggtagctttcggactctactttatcatcttttagggcctgtgtatctgactactgctgggattgaatctgctggatgtctacagctggaggttaggggatttcacacttaaagtatgggtgtgtgcatgcatgctgtctgtggcctgtttgtttgacctcagtcttaatgatgaactaccaggaaaatggaatttgaggcactcactacctcttggccattcctcaagtgaaaggacacaaagactttatattaagatttatagcaacttcaaagctataattttgggtcttgaacacatcctttaatggaattcttttgttaaccacacatatagaaatctccatgttttcagccacagaataccacatctatataacagactaggcaaatattggcatatttcttttaaaagattaccaatcttaccatttaaatgaatatgctgaaatttaagtattatgttcatatctttacactttgaaaaacaggaagacatccctctgccctagctcaggagctcaggtgaaatgataaaatccggggaaaacatgttttggtactttggtaaatgtgtgtgtgtttatctcattcattagtaaccagagacaagcaggaacatgttaaccatcaaatcaggaggtgggagatcctggatctgatttttacttgtttctatccatttttgagcactatgcctttctaggatttgaatttctcctctgtaaaatgagggaggtaataaatggctcttaatgaaaggtaataaatagtaataaatgaagtaataaatggttcttcaacatttctgggtcacgaagttctttaaaaatataaagaaatctttggactttttttccagaaaaaaaatgcatacccaaagtaaattgaatatagttttggaaaggagtttttatcttatcctaccatagatattatgtactacacaactccgggggcacaattcacagactgtggtgtaaatgacaccaccttggaggtgggcaaagaggtgactctctttatagcagtaccttgaactccaagctaagaactcttttgccagatgagctttaagattctctctggatctgaatttcttcaattccagaaatgtcattattattaccaacaaccctatactaatctggttaggccatctttacaaaatactacagaatgtgtagcttaaacaacagaaatgtatttattttattttttatttttatttttttgagacagggtcttgctctgttgcccaggctagagtgcagtggtgactcacatggctcactgcaacttccgcctcccaggttcaagcgcttctcccacctcagcctcccaggtagctggggttacagaagcccaccaccatgcctggctaatttttgcatttttagtagagacagggtttcaccatgttggccaagctggtctcaaactcctgacctcaagtgatctgcctgccttggcctcccagagtgctgggattataggcatgagccatcatgtccggccaacaataggaattcattttctcacagttttagaggctggaagtccaagcttaaggtgtcacaaagttaggtttcttctgagatctcctctctccttggcttgcaaatggctgccttctctgtgtgtttacatgatgtgtgtgtgtgtgtgtgtgtgtgtgtgtgtgtgtgcgcgcgtgcatgtatgtccccaaactccgagtgtttctttgccttcttataaggacaccagtatattagattagtgcctcacccttatgacctcacttaaccttaattacctctttcaaggctgtatctccaaattcaatataggaattttaagagaacacaattcagtctgtaacaaatcccaaactgataaacacattgcagagagtaactagaaaaatcaaaacatctttcagatcccttctacatgcaaataagtctatcaaaaattagaatgaagtatgctacttttcaaaatgggaatttatgataaataaccagaatttatctgctactatgcttactaaaggggaaactgttacagaggtttatttagtattacatatacacgcatgtatatatctagtatatatgtgtgtgtatatatacatttatttaaaaactaacttgatgttgtataaaataaattaacttttaaattaactggccaaatgtcgtatatagtaggacaaagaatgagttaagatggaaaaaattttaataacctataaacattcttagtttttgtttttctttgggtcctccaagtgatcatcttcgtgtaacataaatcaaacaaccaaaaatctcttccacatctggtaagtgagggtaggaggaatgggggttgctcttttttttttttttttttttttttaaattttcctgatttttctttaactataatggaggatcaggggctgagaagaaaaggccaagagtttcttgtcatttttatttatgtatttattatttctcccccagtgccacatatagtaaccaccaccttctgagtaattcccgaagcaacaaccattctacaccccacccccagttaccctagtgccaatggtagctaaagaagagaaatgttcaagaagaagatttacatattgctggatgttcttattcttaaagcctcaccacgattctatggctgtatagtccattcagcaatgagtcaagcctgtgagttagcagtgttacagactcaccaagaatgtatggcaccacccaatagcatactgtcctttcatccttttttgctttgcatgtactgacctttttctctattcatcttctgtacaccgacaaggtatacattttaggaaattacatctatcaggcacaatgactccctctgtgatgtttcactcccacgcaacactcccttggatgaaatggcttgctctctgcctgaattgggctaagatatatgcctgctgagggcttctgccctcccatctctcttctaccacccctgccttgtgaattatcttctttattcctagggaatctacagtaaatactttgtcatctatagtcatttgcttgaaattaacaggtgggtggttggccaagcaaggcaggagagacgtgggacaggaaaaataaatagtaggcacaagcataccagcaggtgttattattccaaagctgtgtagctctttagcccctgtttctattataaaaattaaaatttttaaaaggcacctgggaatctataggagagagtcagtggttaagtgagttgcctgatatctggcaattaatgtttgagccagggactaaaatccagatatttttgattcctaaagtgtgattaaaatatgtctcaaccatgacatattaaactattggaaatcatacgtaatacagtcctttctatattacttcaaaacctggtttaaagaaacaaaagtatgatttttttcatgacttttcaaaagccttctgattttctccagctataaaggttatatatatatataacctttagagccaaatatatatgctttctcttctttctcttaaaggtaagctttatgctcattattgggactgatgttattgatcatatcagacttctcttttggaataatgtttccaggattttcactttgagaggatcaaaacccaaaaaacatcagatgcatttttctggcatttagttcccaggttgggcagtacattttcaaagtataattgattttgtcaaggtcttgagtttgggagtgaagactggagtatcaggaaatgtacatctctagccatcaactagtaacaagaatggcgtaaatgttctagggactcactctgacatccaaagggaagggagcaacttctgagattaagagacctttggttttgtgatgggaacacaaaaagtaaacctatttgtccatatctcctaagactccaacaaattatatgaacaactgcaagttatctgaatatggaatgaattatggatcatcaactaatttaatgtaaccccaggttgcaattcccgtttttagagaggtaacacaaaatatttttaatctctaaattgtaaattgctcaagcaccatgtaataaatatcaatatctaacacaaatgttttggtcatcacttaactatcatatatataattgaaagttgactgtaagtattgcacaggagggcacaaaagatatgtaaactaattattatccagtagtccacactgactatcatttgtatgtcatttgttttattttattgcaaagtaggcatgttgacacgtgtgttgggtgacctgttataaacatatagaaaaacaaaaggagagaaagagagataataatttgatcacagttctctttctaaaagcattgctttaatattctcttatatacaggtagtgataattaaggatatagaattattttctaaacacgcataaatttatagttaagagaaagcatctcatttcaatgataaaatgagagatcatttaattttttttttttttttgagacagagtctctctctatttcccaggctggagtgtagtggtgcaatcttggctcactgcaacctgcacctcccaggctcaaccgttctcatgcctcagcttccctagtagctgggattacaagcatgcaccaccacacccagctaagttttgtatttttagtagagagggggtttcaccatgttggccaggctggtcttgaactcctggcctcaagtgatccccctgacttggcctcccaaactgctaggtgagctaccacacccagctaagttttgtatttttagtagagagggggtttcaccatgttggccaggctggtcttgaactcctggcctcaagtgattccccctgacttggcctcccaaactgctgggtgagctaccacacccagctgagatcatttaatttttgatcacaactattgggagtattttaaaattgtaattgacgtagactggtatgacattggggactgatgatatggaatgttattgctgattcttcagtatgtggacttcttgcattatgttccatatattcttaaaagaatggggctctcatataattttatttcagatatgtccattatttctggactgttagttatgccatttaaattaggtatagccttgctacctttttccagcttatcagttttaagaaagatatggtaaatttattcaactaatggtaaacactttttctaaacattgttctaggttctgaagaatcgacagtgattgaagaaacaaaaacatttactcccatggaacatacattttagtgggttttttaaatcacagatttgtcattttttttagtcagtgtgtgctttatatattttgaggttatgttattaggtgatacagatcaggactgttacagctgatctagttaattgtttttcttcaggatataacgatgtttttagatgtaaagtctattttgtctggcaataatatttccgtatctgttttcttttggttaacatgtttcaagcatattagttagaatatttgtttgacagtatggtagttctgcttctctaggtcacctccagatccaggttgcctttttcttgttgctcagccacagcacattgggcaacctatcagttcagcaaatgttaaccagaagaaaacatgtggtaatgtccacatgggcaaagttggctcatcacctcatccacattccagaaaaggggcaaagagaaagcagaaagaaaacgtcagcctcttaaggtatgacttagaacttgcacacataaattgcataggatttagcaacagaatagtaatgccatttagaccgtagacacagtagataggtggtttgggttcaaatactggctctggcacctcctggctgtgtgagtatagacaagttacaatctatgcctcattttctccaattgtaaaacagagatacttataataatatatatcttatacacattaatcaagtattggttattattattacctttatttttcttctgcagtttctagaatgcctttgtttaatcacttcaaccatatttattttggcaatgtatttcagattgttctattacgtcacattatttgatcccttgttctaccattgttgtggttattaactctctctcatggtggactattttcttactaaatttttatttttcttattttattttattttattttttgagacggagtctcgctctgtcgccaaggctggagtgcagtggcacaatctcggctcactgcaagctccgcctcccgggttcacgccattctcctgcctcagcctcccaagtagctgggacttcaggtgcccgccaccacgcccggctaattttttgtattttcagtagagacggggtttcaccatgttagccaggattgtctcgatctcctgaccttgtgatccacccaccttggcctcccaaagtgctgggattacaggagtgagccaccgcatccggccctatttttcttattttgtactgaagtttatgatactgtaggagctatgcatgcctcactctagaagaaaattccagctattctgacattaatatagcatatgatactaaacaagtcactctcttctgtatctgagtttatcctaggtatctcctgaatagctaacatccttctttttcttaccggcgactgaggagagatggccttgtgttggttagacagagcaaagtagttctgcagtctgtcccacggttctcaggctacacgtctttatttagggtgattcatttttatttatgtttagcccaccatagttccatgctgaagaggtaaggaacaatagggtaagcaagccagccagcatattcttcccataccgatgagcttttcaccagaggaaaatgccctctcagatcacagaaacagtagctgtgtaggtgttgctagtggagaaaaaaaaatgtttggtatttaaaatagaaacataaaattgttaataagtctacagacaacttgtattgcatgcagaaataaaaaatgaagtcctagtacaacaatactgcttagtcttggattcattttacagaagtttaagattcctcacctcaatgaatgagattttaataaacagaagtgtattagaatatttgcagcatccaggcattgggtttgagcctcaaaataaggccagggatgacatttaagtaaattcagaagtaaaaagcaaatggaaaacacttttaatgatgtgtcacataatgtaaaatgtgaaaaataacttagaggttatatactccatcctcttgcttcagggtccctaacaggcatctctcacttgagcataccctgtgatggggagctcactgccttgcagtgaatctttgattttgctgtggctccaaatgttggaaagtgattccttatgagataattgcatattttggaggttcccccaccacacacacatacacagaagaaatgttctcccctatagtaattcaaaatatctcgatagtattgcacaaatatccattaagtgtctcctatgggcctaaaactgtggacaattggagataaggaatattgtcgttttcattttgcctgtgagaaaaagagttttcggaggctaggtaacttgtccaaggaaacgattgagcagagatttgaacttaagctctctggccctggaatttaagctgtctggctctaggactaggccctcattccctgcatgatttcagaattcatgattccatgaatcatgtagggaacccagatataaatcaactgataataacagaatgtggcaagtgtgaacagaactgtactttaggaagctaggaaagaacaactaattctgcctgtccagattggaaatagtaagttttgaagacatagacaccatcaatgccaaagtattgttatcataatgttgtttcacctattttaagaaaaatctgtttcttctacctatgacataaacttacatttcagtatcccccacctcacctcgtcatcagttttagaatgtgctaaattctcaatactactgagaaatgcccttattccccatattgcaaagatttctggggctgcttaataacactttgtaccttctgttcagagaacattcatcttattctcctctcaaattctctgttaagtaaatttaatactacatagcatcaagaggaaagtgaccatttattttagatctgtatctatcttagacgatgtacttttcatggaatagtgagtgagacagacacttgagtcaggtgatgtttgaactaggatgttcccagaattaaatggtagtctcttaaattggatctcatgagtactttagtatctgaaaagtaactacatggaataaattaaacagaggaaaactcctggctatgccattattaaacttttttaaaaatatggtctttatttgacatttctgagtatggcaacccattccttggaaataaagaatgtggcttccaacacatgagtttccccctccctctcccctcccctcccttaccttcctccttcttccttccccttccctttctttcccttcccctttctttcctttcccctttttttcccttcccttccctcccctcccaccccttaccttcccccttcctgtctccttttttccccttccctcccctcctctttcttccccttccctttccctggcctgccctttccttccctttctcccttccctcccttcctcttcccttcccttctcctgccgtgccttgcctttctgtatcccatggaatacctctcttttgcattggaagaaaaacttgatcccttttggagctctttgggctttaaaggtttaagtgccaagtgaacgctgggcttgtttgcctcctttaggaagccccgtgtggatgattccacccctcattgataatcttcttactttacactcccctttctctgccaatttaaaatcattcaaaatcaagttcatcataatagtgaacgtcaatttacaatgctcttttccaagataacttcttttcaaaccctcaaaactattctatgaggtagagatgattcatagttgtacagttgaggaagcaggctcaaaaagtttaaggtaacttgttcaaagtcatatagccagtggacccaggatttgaactctagtcttttaacactcagtttacgtgttaccttgtctatgaatccttcttgatggtccctgctttccctgccgtagatcagtagatcaattccattctctattcccctgtgtgctttgtttatacctttgttctagcacttatcacattgtatttgggaagcagtgtatttaaatggatttgtggctggtctaatttggtttaggtttttttttttttttttcctgttagtttatttacttcctaaggcctgaaatctcttcttcattatttgacctgctggacttcatgcagtgctttgcccatagtatgtataaatttagtgttcatggagaaaatgaatcaatgcaccaaagtgaaggacaggggctgcggtttctttgtatcctgagtggaacctagttcagaggtacagtcacaatcacttttaaaaaaatgttgaataataatgaaatactacataaatccaatagaaattcttaaaatatttagaaggcatgttttctaggaagaaggctaattattagaatttattttttattctagagaagaaagagagaaaataaagaattaaagaaataggaaagagaagtcactagagagccctttcacgtcccagagcagattaggatcttgagagctctaccctactctgacaaataattacttataaaacaattctggggtttcatagcctgcattacctggttccagggaccaatcatgagcttcgttgttttggagttggcttggaggacatttataagaaacatgtgatgaagttgcccctttttctgcagaagataggcaaagagaatcccatgagttgggtaacatgtgggacagattttgcattccgtgatttgaaattatgggtgggggccgggtgcggtggctcacgcctgtaatcccagcactttgggaggccaagacgagcggatcacgaggtcaggagatggagaccatcctggctaacatggtgaaaccccatctctactaaaaatacaaaaaattagctgggcatggtggcttgcgcctgtaattcccgctactcgggaggatgaaaaaggagaattgcttgaacctgggaggcggagattgcagtgagcagagatcacgccactgcattccagccagggcggcaatgcaagactctgtggccaaaaaaaaaaaaaaaaaaaaaaaaaaaatgggtgggagggagggtgtttactccctgccctggagatttgtataaacaggaaaagaagactgttttcttgtttagtcttttaaactaaagacttttctctcatctggagaaaaaaataataatggtagtaataataataataataaaatgggccgggcacggtggctcacgcctgtaatcccagcactttgggaggccaagacgagcggatcacgaggtcaggagatggagaccatcctggctaacatggtgaaaccccgtctctactcaaaatacaaaacattagccaggcgtggtggtgggcacctgtagtcccagctacttggaaggctgaggcaggagaatggcatgaacccaggaggcgcagcttgcagtgagccaagatcgcgccactgcactccagcctgggtgacagagtgagactccgtctcaaaataaataaatacataaaataaaataatttttattattgatcatttttgtgtgtcgggtactatttctagacaatttacatgtattaactttaaacttgacaacaaacctattagatagatggtatgattactcccatttcacagatgaagaaactaaactacaaagaagctaagatcgagccgggcatgatggctcacacctgtaatgccagcattttgagagtccgaggtgggcagatcacgaggtcaggagttcgagaccagcctggccaacatggtgaaaccctgtctctactaaatatacaaaaaaattagccgggcatggtggtgcattcctgtaatcccagctactcgggaggctgaagcaggagaattgcttgaactgggacccgggaggtggaggttgcattgagccgagattacgcactgcactccagtcttggtgacagagcaagactccgtctcaaaaaaaaaaaaaaaaaagaggctaagatcttggccacgttttcacagcagctaacaagcagaatcaggatttgaacctaggccgtggagcaccagagcccattctaaatctgaatgcactctcaaagtgtcttgcagggaggtgagcccagtctgtctctctcagacttcaagaccatttgcagtggtccccatacctattgcaatgattctgaataaagtctcctgtaccaaaaaaataaaaagtattctctaaatctttaatattttatcctagaaacaaatgagattattccttcttttattgtgataacatattatgataactcattttatttgattccctaaaaccggacagagatttccatggtgctgaggatacgaagtttagaccttcgatagctagtctaagcttagtggagatctgatatccaatctaagcttagtgaagacaaacaggttgtaaatgcccaaatctctctatgagaaactaattaagccctgcctttgagtaaaagagaaaaaaaaaaaaatgcttctatattaaaataacttcatttggagttcaaaggaagctaaataaggttttcacaggaagagttcatatttttttaatccttaaagtaatgtgtataagtttcaatgaagtaaatgtcccagctacattattcaaactcaagagattaaaaatattttttttccaacatccaaactcctgatatccctatttcagccacagggaggacaagggcataactatggatgtttattagaaggataagttaaagaggcagaagcagtatatacattctctaaactatacatttatacaaggatgccattgtctttttttaagcaaatacttgtagaagtgatgtctaaaagaataaagcttctcttctatatctccaaatagaaaatataatcaaaatccgcttttatgtaggatggcttttttaaataaataagcagaaggatgaattatgtggctataaataaatctactgacatgtaataaagcaaagtcgaactgttttatggtgtcactgaaacccttagatatatttatagccatgttaacagtccccagtattttttcaggacttttatttcatttcacattatgagagtttagttgtttgtttttctctccctaaattgccttctggagccctttgtagagatagaaagtaaggatctctactcttcatatttggaaaaaaaaagggtcttcaccgaaaaagcttagggctcacacagaaacagtcggttctgatgctttctggtctgcctgtttctgtgcagttcatatgagatgtgcctgcgaagaacaacttgacaggtagctcctgctggcagcaaagtggcaagtcagagtctatacaagtgaggagaggcctgtgcagagataaaatgtacagtactgtagaaaacaagcagatggacagagcaactttgcattagattcctgatgcctgacacatttaaatacaatcacaaggcttatttcagaagccaaagaatctccagactatcacatagccgaggcacagaccaaaacaagataaagggtctgatgggtaaagatgctcacaccttaccctgggacattctcttgcagggtgaggatggggggggggacatttaaaaagcaagaggagaaggtttataataccagttctaaagcctgaagtaatataggggttttttaaaattgtattccatttagaaatttcaggatccaaagagtatggttaggattccgtggggggtttattcaagtggagctaagcgtggttgttcctgtgaaattatttatatttttcaacttgaaatctgggtgagcatagtgtttctaaatctatttctcttcttttctatcttaaaagtggactctcattttcatcctgtagctatacacttgattcccaagtgttatcactcaagggacccactagaaaagccaactcaagaggaagaggagagcttttgatggtaggacaagggatgacaaatccttcagctggaactctagctacaggcagtatttagaaagtatcactggagctaaaaatctttaaaaatgtatttaatgtgttagactaatataggctctaaaagacctaaaaagaacaggatccagaaaagaagtcgaaataggaatgtgttaactagagggaggggcaggagggataagaaacacatgaaaaaattaacagtggggtaaattggagagggacattcattttattaggataattgggggttgtctctttgtagtggaagaagtaaaatagacctgtcttacatttgtcctctgaagagtcttctcagtatttaactgtgttcccaaatggaatcagccttaccaaaattcacggtgacttcttttgacattttgcaaaaagtaaataaataaattataagtatgacaagtgaaatgaatagttccagctgtgatgcaccagcagcatttccagattttgtactgcattaaggatttattttctctttattgcctagcagagaattaattggaaggtccatctaagcttcccacacatcctcagaatgaagtcaaagcagtctccaatgctcaatgccaattaaaaaaaaaaaaaaaaaagaaaaacagtaagtgggtaggtggtcagtttatcaactctggaaaagcttgtctttgaggattcacactgctaaagccagacaaacgcatcagcaaaattaatggcataaggaaaatgtgagtatgagattggcaattgattcactgagttcgttcattcagccagtatttactgagcccgtatgatgtgctacctattttttcacacacacagaaaacaggagaaaatgaagactcagccctcagagagcttataaccattttaaggagataaactatgaacaagtatacagataaaataatttcagacactggagagtgctgtcaaggaaataaaacaaggtaatgggaggggatgccttccaggggtggtggtcaactttaaatgaggaccagagagggtctctgaggaggtgacatttgaaatgcacccatcacatgaaaatcttggggaaaagccttccagacagaaggggccaacaatgctataaaggccttgggatgagaaaaaacttcccacgatcaaagcagaaagacctggggaactagagagtagggaggaatggggcatctggcaggagatggagctgaagcattagagttaagcagagtcatctaggccgccttaaggccaaaagtgcagtggaaatccacctggggactaaatcaaggagtggttgaattgagtggaaattatcatggatatttaggatattaagaattttttctggcttttctagcaataatagcataagaccctaaccatgtacttaacctgttcttcacctttttagagcttcagcttatttttctagtggacaaagaatattgccactgtttgtcaggtgctctaccagatactgtatattttctcattttaaacccccaacaacctcgagagggaggcatattcctcattttacagaggaggaaactgaggtttcaatggaatgtccataaaccaccccttccccttgctgtggtgtccctgagagcatgctgctggtttaagacactgcgtgggggcacacccaaaagtatgcaagaccttgtcagagggccatttcctggggggctgtggatcctggaccacccttacaaatgagagccagggcagttagggtgactgtgtgcatcatttactacgggcagcttgaagcttttggaggacaccaatttcagaaccagaataccagttcactgccataaattctgaaatggacttgatgtatgaccttgaaggcaaatcacctgtaggtttggtctttttgttagagagacataatgctgtttcctcaacacctccttggggtgtctcaaggatgaatagggctgtcttaatccctgttctttatcctcagggggtttgaaatgagagtggagtatataataggtgctataagctccttttaaaaaagcctcctaaatacaacatatatatgttttaaccagcaagtattgttcactcacctccccttcctccctgcaaatgtaatgggctttttacccaaggtgaatggtaggagggagtcaaagctagcaagacctgtgtggacaacaacctggcctgagagggcagcctgttgggtttgtccttcctgcgcatgagacatactggaggggtggatgccgcctagtccacagtgttaccgtgtcctggcagagccttgggtcagtcccctcctggagtcacagatggccacgacagaggacaggtgctgccattctggctctcccctgcgtgttcagtcgtgaggtaaacaccgtgctgtctttgatgcccagcgcccaggggacttcacccacctggggcagcccttctgcagccagttccggacaggcgccagtcacttctctttgagccagccgacttggccctctccccttctgaagttttttgatcaggactacaggcgcggacgataacctctggattttgaatcccaacagtgtcctatccaccaccgggggtggcagccaccttctggaaggactgccaatcacggagcccttcaccctttggagtccccaggccaccgctccaccttcacttttgggagtccggactcagattcccatcattcgccctgcgggaggggccctgggcattttaaccccgggagacacacgcgcctggagagtggtcgcccaagccaccgccaggcagggaggagcgcgcgtgcggcaccaccgcgtgcagcagctccagcgctcgcgctgcctcaaggggtttatttttatttctatttggagctacttcggccttagccgccgcccttacttttcctccgaaattgtgagaaggtgccttcatggctggagtttggtttcacgcgcctgggagaagagcagggcacgggtgataaagaaggcgcagtgtcggtctgtcggtgtcacacacgcgcgcacacacggcggggcgggagccgcgcgagcgagaggagggcgggcggcgtgtgctggaggctcgcgcgggtgtatacgagcctgtgcttgaatgggaagggccgggattccgggtcgctctggcccctccttcctccggagccagccagtccctcggcagagcgctggggctgcactgatttgctctcgggagtgcgctatttgcatatgacttgcccatttgtgaatttggctccccaactcctcgcttcacttcacctgtgcctccctggtccgcgcacttcgcaggcgcccgcccgcctctcggccacctctgcagcctgccaggcacctcctcttgcgctctcgctgatttcgcccacccacctccctccaccccgtgccacgttggtttgggtggctgctccgcaccgggttcctcctcctctcctctttccctccagtccttcttattctcttcctctggctgcggtggctgctgctgctgctggttttcatccagttgggaaacccaggaagccggcggctgctccgtggcgctagtccagcacgcccagggttaaaagcctcgcgcccttccgcggagactcccaggaacacccgaagaactcttccacctgcagcccccttttgcctggcagttctgcattgcatctcatggaagtggaaacaggaaaataaaaatgttcaaactccttggatgttgggataaactcacctgaacccacttgggttcgggctgcctccttctcttccttcattgccacctttcctctgtgtggctcccgggagtgtgcggttaagtcatcagactcgaagtgcctagagatccggaggaagccgcgccggtcttcccctgacatgcgtggcatgccggggctccgtaggaggtttgctatacctgggaggaccctggcattctaaatttcagctccgggaaagagaaggggctttttgccttttatcttttttttttctttctttaagtagtaattttttaactgattcattgtttggaaagcgcatattgcttccctcttccccgaattctggcaactcttcctcctgctatgatgggcccttgggcatcatgaacttcattactcctcactggctggaattcaaactgcccatctgtagtggtcccgtgcgttgaccatgcacctgagaatccacgcgagacggagccctcctcgccggccggcctggacgcttgggatctggttcctgttctggggatgtatcgtcagctctgtatggagttcttctaatgtagcttcctcctcctccacctcttcctcgccggggtctcactctcagcacgagcaccatttccatggcagcaagcatcactcagtgcctatttctatctatcgttcccctgtttcccttcgaggaggacacggtaggtctctctgctctttatccttttaatggggcatagcaattcgctaacccactagccttgcaggtagtgtcaaaggtgggaagggaatttaaaaaaaatgaatttaaaatgatgaaaagcatcgtatgtccatgagggaagcaaatttctactttctcataaaggttagtgttttctgcccctagcctccgacaaccatctccacttttctctaaagggttcttttccccttagctccctcattcatagctgcacagacaccacactctctcttttgcaaccttctactctctccacccccacggagacaggcaacttatcaggtgagtcccagtgctgtacttggagaaatattcattcaccttgctttcacccttctttgctgtggtcttgcttgggagctagtgggggtggggtgggaatagctgacaacaggaatcaggttttcagcctgaagttgattgaactgttataaagtagcctgtgtggtaatggtcagggaaaagtagccgaacataagaaggcagaaaatataattaacaacctgtggccatttgtgttgaatttggcagctttatgtttgtccacatatctagtggaaaaagcagctatctctaaaactacacatctactattgctatcagaaaggaagcaatatgtaagataaggctaagttcatttataatttacccaagtgtaaatgacagtaacttggattccccgtgtatgcaaatgttatttcatctttaggtagcagagatgggcttgttcacacaatacaggtacgatgggttttactccaaacaaccctccttacatggctattgagggaagagatctatggctctgaaaatgatactcagctgttagccggctgcctctaaaagggcgatgtctgcagctaaggtaggagcttgctgtggtaaactgttctaaagaaaggagcttcttaatttgtttactatgcactccactctgatggtaaggagagtaggacacacagaaatggagactggtcttgcttgggagctagtgggggtggggtgggaatagctgacaacaggaatcaggttttcagcctgaagttgattgaactgttataaagtagcctgtgtggtaatggtcagggaaaagtagccaaatataagaaggcagaaaatataattaacaacccgtggccatttgtgttggttttggcagctttatgtttgcaggaacagccctccagggaacatgagcgtgaaccatactagggggttcctgcccttgtattttgaagactgataacatccagaccctatttggaaagttgattcttcctgctgcctcctagccctgagctttggctttatgctgtctgtagtgtaagtggaagcacattgagaaaatgccagcacatactctggctctttttgactctgtctttaaattttatttgatggagttgtcaagcagctcacagcttgtaaggttggtggagggggatggtgaaaagaagggattgcttgatcttgatctggtggctcttttctctgtgactcctgctgggtctggtgttggctcccttaaaaaagaaagaagcaaacaaacctaggagaaaaaagagccacaaccaccaaaaaagcaatttcattgacatggaaacttagctcctaagggggagagggactggggggagcgggtaagacaggaaaaaaagagggagtgggagataggggaagccagagagactgttactaatagccataattaaacacggaaatgctcagagattagctaaattttgctaattactgtaaatgatcagcagggagaggaagattatgcattacaggttatgggtggcagggtcttgatatcttttgttcgggttgtaaacagttacagcagatactagtaagtgatggaatttgcagagcagtacttccctagggtccctaagtcagagtcagtctctctctctctctctctctcataaaggggttgagccttgcacaggttaaacatgaccctttatttagtttatttcttcaacgattggttgctcagtctcctttaaatctttttgactggtccccagtctagtttctcattaacctacatctgataaggttcagtgtgatggaaaataagaagaaagtaagtaaatggctagagaccccagaaaaggccctcagactcaccagagctgtagagtacagtgaactccatccagggtctggcatggctgagataagaaaactcatgaattcagctcttcagaatcctctttcaatcctgaagtcccaactcattgatttggggcttggagagtgaatgcatctgtattaagtagactccttgcatatttaattggtgtttttgagcataaaatcaagagaagcagcaatcaacaaaatatccctacctctggcttccatcctgcacccaagctgtgaccctttgcgtctctaactaaaaggaccagaagaccccacagagctttgctaatgcacttctcattcttacttggtgtacacttgctttttcctagtccaagacaaagacctagctaacagcaattgttttaaaaaatatttttggatggaggtggtaggaggcatggcaccaagagactgatggttgttattgatgatttactgccaatcttattccagagttaaaggcagcactctctgttgtctgtgaaaaagtaaatgcccttgattttggtatgaaagaaaactagagccttgagtccaagaatcttctttggacttaagagattgttgtttttttaactacacttgctcttcccttgcccatttcctgagaagccaaagtcctcaaagctgctgttcatcagttggtgctcccaccccctttctctactatccagacctatagagagattcatgctaagacagatggaagaaacagaaatcctccaaatagctgatattttacctacacttttgcctgtgcttggttccaagctttagaaaattggttatattatagatttgcttaaagcctttatcccaggacagcctagaggatgctgggattctttgtaaattagggagactaaggccacacttacctggggtgcccccaaaaaatctcacattaggattgtgtttcaggataggattaaccttcttcttaatgggaatctagtaggctcttccccattctgttagagtcctcaccccactttcatgctctcttctgttcaccagtcagtcaatactctttgagcacatactctgtgccaggctgtgggctactgctgaagatacagaaccgaataagacattgtggtgttcagctaggaataattgcaaaagtatatatatatatgcttccatattttaaaaagtgcaaggagtgggtggagatccaaataccaagcgaaattaatacaaaatcaaaatatcctttataaaatgaaggtttacattatcctgttatttaaaatatccctccaggttccttttcatccttggctttatttccatatgtaaatatcattttttatcaaagtgcaaggtagtttagtgattacagatatataaatagtaaaatatatttgtttaccaagctttaattacataagcaacttttgtatattttttccttctttttttccctctctctcttaaaggtcattggacctttaagaaatccaatgtgtctgggcatggtggctcacacctgtaatcctagcactttgggaggccgaggtggggggatcacctgaggtcaagagtttgagacctgcctggccaacatggggaaaccccgtctctactaaaaatacatatatatatatatatatatatatatatatatatatatatatgtatctccaatgtacatctgcctaaaaaatgcttcagtatttatagtttaaatgcaggtttctctaaggattcaaggttttatatgtaccttaaatgctattctctataaaacagcagactttcctgcctctgtagacgatttgtggggactagttgaggacatggaactcttggaaagctcagttttaaaagggaacacaccacgctatatttgcaggaagaactcttgctcagaaaccagggtgtgtgaaaagggggagtataaaagtcctattcaaaccatcttagcagaagtggtggtgatgggcccccttgtgacacatgatcctggagtctttcttggactcattccttgtcccagggatccacccccaaagttttttcagccttgggggcttgttttgctttgatctattgagtgccttcttctgctcagccagctgctttctaaccactttctttatgcctgccttcttgagattcagggagttgaataattcatagtgttggttgacagatcaaatgataagatttatatatctttggccttggtgatgaattaattagattggtttctccatctttggctcctctagatgcgttgtttttcttctttaaaattcactggtgagtggtgggtctggagattaacttgttcttgagagaccaccataggatgattataatatcctagtgtcaatttcttcaggactttcaacatggatcactgggtggtgtggagtaggggcagctatatcatagagaggagagataagatcatcagaacaaaaaacaagacgcacacacacacacaaaaacttgccgatactggctgcgggatgaaattttacagtaagaacttgattgctttcacctcagattttgaatctaaaagagaaatgtatttcattttacattttagtaaatgaacttatcagcccaaagaagtttgctttactagaactctgggtgaccagggagggaagcaaatctctgaagataaatcttgaacttactcatactttcctccttgtattagtttgctagggctgccataaagtagtaaagtactatagactgggtggtttaaacaagagaaatttgtttgctcaaggctctgtagagtaaatgtctgagaccaaggtgtcagcaggtttagttctttctgacatctctctccttggcttgcagatggctgttttctcactgtgtcctcatagggtctcaccttgatctacatgcatgcatccctggtgtctttgtgtgtccaaattctcccttcttataagaacatccatcagattggattagggtcctccctaaaagcctcattttaacttaatcatctctttaaaggccctgtcctcacatacactcacattttgaggtaccaggaataaagctttgacatatgaattttgaagagacacagttcagcccctaatgctctttctcctcaccgtgcgctgccccccaccgccccccaccatcccccgcccagttattgggaaagaagtaaaactgtactgttcagtgaatacccattggactcaaactttcacagcagaaaaataaaacttcagtgacaatggttgcaatttacaaaattcataagatagtgccctaagaggtaatgttgtgtttacagatatggggaaaaaaacagctattggttcagtgaagacttgtgttttctttcttctcagtttatcttctgtgactgagtccagatctttatttgcacatagactaattctgtctgactgcagacacatgctctaatgtccacacattaaagctttctttacctagacctgctacccttctgacccagaccctccactcctgccactgactcctttatgaactacagttgtttgctctttgcctttcctgaaacacaaattaccaactactttcacatctcagcctttggtgaaaacaagagaaaaaataggttaactaagtataaatttctcgtttttcaattttcatatttctcaattgaaaaatatgttaaataggcatcagtttaattatttttctcttcaattttattttttgaaagttcatctgaaaatataaatatgaggtaaattgtctacttcatgacatggttatgaagcttggtgagatgattgagagaataatatatatatatatatatatatatagtgtatatataagttctggttgttctaaatcctaagcaaagcattccatctttggggaaagggtatacctttctttgtctgtttgtttctgtgctcaaaatgcgtgctgatgttgataatagataaataataatggcattctggtggacagtgtggtgttaggtgaggtgggaacaactatggttggaggaaatagccttcaacctcaacctttggttctaagaaactttgtctctaagaaactaagttactaagaaacattgtgaacttaagtcacaatgaataagtcacttggtttcactgagactcaatttcttcacctttaaagtgagcaataataatagttaaccatacttatatcacagaaattgtatgagagattaaacaagttgtattttgtacattctaaaccaatgtgtacaggttaaatattttatgagacatattttcatgataaggctgccctctttgaattccttgcacaaagaggagcttcaatgttgatcatttgctggttggtagatagtggttaaagaacatgcatctgctggttctcctcattttcctatctatacatacacttttttgcctcctagagattatttcatttacatagtactctgagtaaatgtagatgagaaacactttactgtattttcatgtttatggcactagaacacagcatgggacaaaagtcagcttgtgatttttggtaatggtctgcttaggtagaaagtcatgccaggcaaattttagcatggaccaacacattatagcaaatcatttagaagctcagggattcagtaaagtgaaaagagaggactccaagaaatactctgagatcattttggaaattcagaattggatcccatttgcagtaaacctgtgcagaattcaaacattcctacatggttctcagtgtccattgtaaactaagatttttaatctggtttgtgctgggaagaagcaggtgtttttagggacaactaccttcagatgtggaagtgaagtacttcttttaatgcaatttcttaggcttactagggctcaaagtttgtagagcagataggagcacaatattatgccagaactcttagaattgactttgtgaagcctgaatttgaaacagaattcttactgagagacatggtcctgatacatagattttgccccagttttctccctgaccagctctgtaactttgaattataacattatatttttaaattatattcatcttttaacttttagacattctgtgtgataccttgatttcctaacctatattcttggctttacctgtagttttctgcatggcatgtagtatgaaagctccttaataccatagctggggaaaactttccttttcatatcttcatcatttgtacaatgagagatttgagtgagatgatctctccaaatgttttccagcactggaactgcatgagtctctgatttgtatgtctttaaagacaccactgtgcatcttaaacctatctgagttccacaagtctgccagtattttataggtctattttcttgactatcataataacttatgccaaagccataagccaggttttctcttttcccctcagacagaagcagcataatgtaccagagtggcacactgtgatgttataaagcccacaatccaacttcagtgcagtcacgctgagatgggaagaatgcagctttcatttaaacacaccttaataatgctagaaaggagctctatgttatgtttaaaatattctgctgtgtttagccatatcagagcagggggcagactagcaactgggtttataaagaggaaatggtttatttctatttacagttaggattttgagagagacttgcttgagttatacaccaacacataatgtacacccactgtgtgacaggtactcttccaaatgctttacatatgtgacttcatttaatcctcactagcctttgaacctaataaagtgactattttacgattaaaaacattgagactcagagaggttaagtggcttgattaacatggtgttaaagccaggattcaaacctggttgtgaccagaaaactcttggtctttctgctgtaccacacagtctgtcaactcaggaaacagactacacaaacacatcaagctcttttgtcaggaatcaagtacacagattgatgaagcactttgattaatgcagctaacacacctttccaaagcatctacaagactttccaattcctaataagtatttgaatgttttccaatctgcctgaacccgtttcaacccaaggagatagtaaataaaaggagcagactgatgaaacactcacacttgatatgtctttttttttgaatgaatgaatcaatgaataaatgattgagtgaggttccacatgatcaaatctcttgcactaggaaaggagggatgctagtttataaaagaagcaaaggcacaggaagttatgcacccttcaaaagcacaccaatgggctcgtagaacttagagatataagagagctcaatgttccaggtaggcagggtgaggactcaactaagagcatccagttagtgtcaggactggtcaggagcacagacatcatgactctgagtccattgccttttctttcctctacttctcagtccttcaagacactttcttaaattacaaacttgttccccatctctctttcttcagagaaatctccccttatccagattatgtcctgcaggcacatattctgccagtgttggacttgccaggccttccattaaaattaattattggctgggcgcagtggctcatgcctgtaatcccaacacttgggaggccaaggtggctggatcccctgaggtcaggagtttgagaccagcctggccaacgtggtgaaaccccatctctactaaaaataaaaaaattagctgggcgtggtggcatacgcctgtaatctcagctactcaggaggctgaggcaagagaatcacttgaacctgggaggcagaggttgcagtgagccaagatcacgccattgcactccagcctgggtgatgagagagaaactctatctaaaaaaaaaaaattaatcatgagaatccttctaataggttcctggctttgtgtgccaaggtagggtttcttggtgtgttctgaaggcttcctttgtataggaaacctcagtgtgaaaaagtgctcagattcggggttctgtgaaagatgcttcctgtcctggttggatgtcacttgccagaaggcaggaaagaaatggcctgtctgttcacctgttgctgctcctcatctggaagttgtgaccaggatcttgtttgaagacctgtccccagccccagtcctgacctcttgcttaccagctattgagtggctatgaaaacataaagcccctggaaaccagcaagccacattttctgagatactgtcctgccctcccttttttattgttttgaaatattcctctcacccccccacgttaaaacataaccatgtgtattcactcctgagtgactttcccccaaactatgaatttcaactatttccgaggcagtcgttcagaatttgaatataattacactctttgggtgaaaattgtggtttttgctacataaaaaactaatggaaatgatctgcctgttcctgtagtttacagattatatgcttcagaactgacgatatatatttaggctgcttttctgtgtggcacatttaaatgaaaatgaactcggggtgagccaccatggttgctaggcaatagagcgggttgatagagcacggtattaaactgaacccacattggtgttttacttaacatctatttgcttagcacctttgtcatctgtggtgtcatagaagggaaaggaggaggagacaggcagagtctggttatctgcagagactcaaacaagtaggagaaataatcatcccaaacaccaaagtgacatgagcattttcaaaaatttgaggttgcagcacagtcaactcatttaatgaagaacatgcaagacctgaagaaatgcataagcatagcagacatattcatggatgtggtagcaagaggaactaaagagattccccaggctgggttttgctctggtggttccagaaaaaaaaaaaaaaaaaaaatagccaccacgctggttgaaaattttaaaaatgcgtctatgggtcatttaatttcctggcctaaaatcccagatttatcatgagcaagcggtgataggcagcaaaagcattgcggcttctttacaattgataactaatagaggaactccaattgctttgaaaccctggttttaataaaagctgaaagtctcttataagaaaacaactggatcacaataaagcaaaacctcgtcagactctttgggtccattctagccactttctgatacatttaaaagtttgaaaagatgattaaagggttaaaactcagctgtggggagaatttggtctcatgaataatttgggcagagagaggatcctgtgatttggatagccaaagttttattgtttattttttccaggagccaattattatatatcttttttcattgaatcaatatctctgcataatggaatggtcacctttgaatgttctcttttcttaaaacaaacttcttagataagttaaacacaagatgataggaaacctctattttcataagaatgacaataacatctactttggtttttattatagcaattgatcactttttattatgcctaacatttttgcctttcaatatgcctgacatttctataaacgttatagttcatttaattctcccatgaagtaggtggagttgttttcccattttttaagttttagttatttattttagcagagatggggtcttgcggtattgtccagaccagtctcaaactcttgggctcaagtgatcctcccaacttggtctctcaaagtgctgggattactggcatagccaccatgcccagcccattttcccactttaaagaggcagactcggaggcatggaaagtttgagtcagttgcctaaggtcttataggtaatataaggcacaatcaggttgggtatttaagcagtttgaacctgtcctgttcaaactgcttaaatacccaacctgattgtgccttatattacctataagtatatactgaaattatactgaaaacagtatactgaaaacagtacaatatttcataaatactcttaaaatttcagtatttatgaaatattacctgaatggtgggaaaaaatttcaaagtggtattcttaaatggaatactgggccatttttaaaaggacctcttagggtctacctagatacaggataaattatgaagacagaatattttctaaacaggtaaacacctacctcatatgaggtattctaacaaatactttagcttactgcatttaatctttactgaccatccttcaaggtaggcactattgttatcatgaatttacgggaacagaaactgagccccagagggttaagcaactcactctagttcttccacttactaagcagttagcctatagcatctgttgaactcttaggtcaggtaatctgtgcaaatgtagaacagttcccggatactgaaagcaactaatcagaatgcttccctagattcacaaattctattacattataggagaggcttttcaaaacagcctttggaaactcacaccagttccagaatctgctggcaatgaatagttacatctttacatcttcaatcaaggacccaagagtgagggaccccctctcctttgacagggaagcccattggtgcctcattctcctcatgtttaattcactctaagaatccgtttttttcaggaagtttcttttccagtaattacgataggctttctccccaacttatgattttaggcaagcaaccaaactttcctgattttaattctctcacctgaaagacagggaactgtgaggtggcctgccagctttgctttcaaaagtgtggcattcatctttcattaatgccaaaaggcaaaattccaatgatttctaaaatacttcctcacccttatcagatcttattagatcaccttgaatctacttttaatcttggcccttcatacatatggtagtagttctttaaatatgagggtgaaactaatgaatacgttaagaggggcagtgggtttccaacttgagtgaatatgtgtgtgtttgctttcacatgtaggtaaatgtgtgaaccaaaataaacgatgtaacagaaaaccttcatagcagcccaattagttcctagcttagaatgtaaagatcagacatgagaactaagtctgccgtgcattacagacgtagggaggtttcagtacctgcttcttactgctctggtatcatttatcagtgcagtgttgtcacaggctcatgtcaacatgtcaataataatctcaggagaggatagcttttatgtgaaataggaaggtaaacctagagtcttggccttatacagacaacccccttctttgggatgactagtgttttcatgtttcttgttttttccatgccagggagccattttatgtgtgtgtattggtaacctcatcaactgttagctattaaagactggttaaactaattattattaagaactctctttcagaaaatcctgagatagttccttttacttcccttcacaaagtaacttgatattggtccctgagaaatagatccacaacctcatcaccaagttctccaggccctgaggaatgatcatgcccctaaaataatgttctgatgaaggactttctttggactcaaaatctgctttgcatttgtggaatcatcaaatgcgaaacctgcaagaggtctttagaagcccttttcaatcaagttatttttcatgtgaaaaagctaatagaccagaagtttgtgaatagttttcccaaatcacacttttcaaattagaggcaaggcgagggcaacgtgcaagctttcagcttcgctgtttagtctctttctagtctctttctactgcatcacaatgttagcactcaggctttccaggtgtcatctgttttgctgtggactgggaaactgggattgtctccagcaccacttggataacaaatgagcacagaaggagcagagagcagcatgacaaccaagatactccaaacactcgcactgtttcctgtaattaccatccagagagcagctcccactccgtgtcaggcatgtcaccccctcacggggtctcctgctttctctctgccccagcagcctagaggggaaattcagcatgctgcatttcaatcaaactgtttgatgagagcttttgagcctaattacatggaaggttttatccagtgaaaagaaagaggaaagagaaagagagaaattaaattgaagtataaatcagtcaagagcttagatcccgcgcttgctttctttttaatcaagagtgaaatgagaggagagttttaaggatcatcacaagacaccattaactacccaaggagctcttggctgaagatggtttgtcataaaaagaaaagtgtacaatctgtccataaagaggaagtatctgagggtcgtgctgcagtttaggagcatgacactaaaaggaaggacgcttggtttttccgtgattattttatctttatttcccctagatacctagcatattttctcgcacacattaggtgttcttgttctgtattttaaatcaatgacttggtaaataacgtagtgtgttaactcaggtaattattacataggaaagggtatgttatcaactcattcaatattagatacaacacatgaaatcagtattcaaagttttggccagtttccctttgtggttgatgtagtttgggcatatccctctaatattactgttatttatagaatgctttacagtgttacagagaaaattcacggtaattatttgatccacagcacagccttgtgtggtaggaggacaggtagtatgattgttatttattccatttttttaagctgatgtaatcaaaaccaaagaagcataaatgacttgatcagagtcatccaagtattaagtgacagagcaataactgctacccagcttctattacatcaccctgtatgacctagaatcttgtacagaatttctgggttcttcagtataagaaggataggtaaacagcagagaggagtgtttgcaaaagaaatgcattggaattcatactttattattgagtacttatgatgagcaatgcaaggcactggtccatgctctgaactggaatgtgaaacatgagctttgtccccaaaggcttacagtgtggttacaattcattaaaatgatacttagatctatcctttccatctctattgcattttcaaccatatcacctaaacagttgtgacaacctcccttaacagaccttccttagcttctgtttttccctcctgtccatgtttccctcaccattggagccatccatctgaaacaccagtctgatcatgccgctcttccatgggctcttcgtgtcatttcctctgtactcagaacaaaggctggccccttatctttatgatctggcccctgtgtatccccaacttcacctcctaacatatttgactaccttggccttcatctttttctttttccttttttccccccttgaatatatcaatcttgctactaccatagtgcctttatttgatcagttccttttctctgggatgttttcatccagattgccgtatggccactccttcttcttatacgtcaggcttcaacttcaatgttatcccctcaagagcccttccttaatgacccagtctaaaaagcactcttttttagaaggatcaagattatatgaaaaaatttaaaaaaataaaaaataaaaagcactctttcaaatgtctctccagcataccaccttgttttgttttcactgtagcttgaatatctctgttacagttccttatgtgtgtattgcttccattaacccactagaatgaaagttctgagagcagagaccttgctgatcttgttcatggctggactcccagtacctaaggcagtgactggcaaagactgagttttcataaatcttgctgagtaaagggatggatgaataaatggcatagatgcttcacaaatatgggctcccacctagcattttaacctcaatactcagtaggccctttaaaaacatcagttttagtttgtacttttcccttgattgagaatctctcctatttggtagactgctactaatttttcacgttgcagctgactccataatatctggtctgcaaagttttccctatctcccactgcacagtgagtttcccagccttctgtgtttacttttttcgctatagaagttttctcattgaataacaaaaattattaaacatatattcagtcttctactgttttccaggcactgtccagggtgtcagactcttaaacatacatcagatttgggccttgcctacaagaggttcacgccttggtggaagagctcactctcattttattaaacatgtaacattgcattgctgttatttattgatggtgattgttttcctcattaggctctgcctttcttaagggtaaggaatgagtcattcatttctatattttgattggctgacatagttcttcttttacaaaaggtgcttaatggcactcattaatgaaaaaatagagtgagtgggctgaaaaggtaagaacatacagtattttaatgcacgttgtagtgtgacaaacatcatgagataagtagaaactaccgtggggatttagaggggaagatgtcacaaccaattaggtcattaaaaagtgcttcatagcagaaataaactttatatcatgttttgaagaattatttccacaggcatgcaggagatgggctgaaatatacttgggaaaaaaaaaaaaaccagatgttccagaatcagtgactccatttgctgagttatgggcttgtagagctcagttgtgagaagggctggtgaaggagtttggggctctttgatggaggacgttgagtaataactataattataatggacatctttggcatttacagtttgcagatcagtaatgtaaatactatatgacttgtccctttcaattgccctgtaattcttttatcatgatcactatttacaagagaaaaaaagggtcaaggctgagaagttgatgcttaaatcttataggatggtgctgtatcttttcaaaatgtaaaactggttttgtaaatccctggcttaaaaagataaaacaaaagcaaataaataaataaattaagcctctttcttcactgtttccagtgccctctaaatcaagataaaaatgtttaatgtggcctagcagttcctgcgtgatctggcatcactagcatagcacgtttagcctcatcactcaaaggtccttctgccttcttgattccagcgccctggccttctcccaaccattcatattcaccactacagacttgcctttgcttatcctatttaagcagaatcctcacttcttcctttgatggtcacctactcagaactaagaactcttctttagtgtagcacctcctcaaggaaatccccctgccatttctttgagaaattcaaattcccaggccataggttctcataaccttctagaactctctcctgttgctcatttcacaattcctttttatacatttggttgtgagattatttgattaatatccatttcctaagtagattccactggggttagacagggttgttagaaaataaaaatgcaagacagccaattaaatttgtattcagataaataactgactttttaaaagtacaggtatgtcccatgcaatatttggaatatacttataatttaaaaattttgttgtttatttgaaattcaaagttaactgggcatcctatattttatctggcaacctatattttatctcatcagagactatatctgtttttttcttctagcataatcactggggttgtaacaaacaggtaatcatctaatgttggatggataaataaaatgagtttaaaaaatattctggcagcgcatgtaggctgaattggaatgacaagagactgaatttggaaggactcattagcaaactttgaaaatcatcaaagggaaagttaaggacagggtggtggcattgaggctagatagatggagatgtatagaaggaacatttccaagtggggctcagaatttgcacaggtgttattgggtagcaacccagcactgcgaggaagaggccaaagggccatttcaaattattagtgatcaggattaaaaccagtaacggagagaaaaataaatataatgcctctcatttatatagtgcttcacaacttttaaagtgctgttttatgttccccattatgccccttggtaggagagtattgtttctaaaaagacagccatttaattatcacttttctttataaattcaattacatttcccagtccatgtagttcatcagttcagagatgtttgtcttcatttctgtctattttttaacaggtttcttttatttaagttcctcatttctcagtcctgaatcctttatttctgaagcaccaggtaattttgtattacgcataacaaatctgaaatttatttgtatgagcagattgattttatatccatcagattttctaaaaatgggctataactggcttataatgacatgaccagccagaggctaatttctgtggtatttcttcctgatgccagaataggtagacaagtcagaagcacccacttcagataataaagatataattccagttattcaaatttgtgttgaaagcaaatcctttcactgcttatttttcaattagtgccaagtgtggctccatggcttctagctacagaaggccaggtgatcgagcattcttaaccagatacatgaatagggagaccacggttctgcagttgacatttcttcagctgctctttcagaggtcttaacattttttctcaccagatacttgcctgtgagctgctatttgaaagataaggtgtgctgagtaaatgattaagcaagtgagacaataagaagcaacgtaatctcatcagagactacatctgtttttttcttctagcgtaatcactggggttgtaacaagcaggtaatcatctaatgttggatgaataaataaaatgagtttaaaaaatattctagaacaggggagaattctagaaggttatgagaacctatgttctgggaatttgaatttctcaaagaaatggcagggggatttccttgaggaggtgctacactaaagaagagttcttagttctgagtaggtgaccatcagaggaagaagtgaggatgctgcttaaataggatgagcaaaggcaagtctgtagtagtgaatatgagtggctgggagaaggccagggggctggaatcaagaaggcagaaggacctttgagtgatgaggctaaacgtgctatgctagtgatgccagatcacacaggaactgctaggccacattaaacatttttatcttgatttagagggcactggaaacagtgaagaaagaggcttatttatttatttatttatttgcttttgttttatctttttaagccagggatttacaaaaccagttttacattttgaaaagatacagcaccatcctataagatttaagcatcaacttctcagccttgaccctttttttctcttgtaaatagtgatcatgataaaagaatcacagccatgtagaggacgaaatgtgagcttttaactccacatacctgagtgtcactgatcactctctcagtaggtcacccagaggttagcaaacttttcctgtaaaggaagagagtaaacatttccagctttgcaagcaatatagtctctgcctcaacaactactcaacactaccactgtaatgtcaatgcaactacagacaatatgcaaacaaatgagtgtgagtatatcacagtgaaactttatttacaaaaacaagaccacctagtctgcagacccctgcccccagatttcagcttcctgttatgaaaatggccattataaaacctatatggcacagttgttgtgattaaacatttttacatacccaaaaaacttagtaaagaatcaggcatattaatgagagttcagtaaatgctaacctgtatcatgattataagttttagggctgcaaggaatcttgggtgtgacagacaattttctcctttcaaaagatacctagatggaggattcaagaagtatagggacttaaccagggttacaggatctattttcccgcaatcctatttgtataccacttccagaaaccccaagaaatatgatggcatgaagccaagctatatattgcgggatatttgagcatccattcagcatgtatgcattgaatgtcagccatgtataagacattgtgcagtatattgcaagtgacacaaagatcaataaagttcctgcgttggaaaatctaacagtttaagtcaccctagtaactataatgaggtggaaagcgacaagtatcaaaggaatgagtgacccctacgtgccaagcactatgttgaagtgcttacatgtgttgtctcatatgatcccccagcaggtggatttttagcatttcatcctcaatgacattcaaatgttaagtaatctgctctaggtcaaaagttactaagtgatagaacaaagatttaaactcgtttctctaattgcacagtgtgctttctaccagacgctggggaaatcctcatacatgaagtatggtttagttagctattgctacaaaacaaacaacactaaaaagttgtgtttaaaatgggcatgttatttgcttgtgattctgtgggtcagcagtttagacttgactcagctgggtagcttggatgatctcacatgaggtccctcatatagctccagttatctggcagatagacgggggatgatgatggtctaatatggtctcacacacatatctgccagttggttctggttattaggctgaggagcctcacgtgatatctctgtgctttgtgacctctcatttggctaatgttgactgcttcacttggtggtctcagggctgcctcccagagaggtatataacaggagcagcaactcttgagagcttggaaatcatacaagaacactttcgctgtattctgttggtcaaagcaagtctcagaatcaggctagattcaatgggcagggaaataggtgacgtgtcttagtgggaggaacagcaacatcatactacaaaagggtgagcgtgcaaggatgggagggtttcttgctgtgtttgccaacaatttaccataaagtgataactgagttggaccttcacagaaaataaagatttgggaaataaagactttgccagagcagggattataaagaagagcattacttcagattagctgagaatgaggccacacgcctatattgcattattgaggaaatttcctcttgcctttgctccacaagcacattgcttctactagttgcagggacataattaccaatttcatatatataatacttctaacttttcagaggatttttatttctcctatataacgtttaatatgctatatagttttgttgcattgttttactctgctcattcctttcctctctgtaagttggtgtcgtcattgcaacaaagcccaggttcccagctcacttcccaaaagacaatcatgtggactatctgctgtgattgactgtggctgagtgtttgccctggcagcttttttgttgctgaagatgaaagtttgatggactttaagatggaaaggaaggaagaggagaaatttgatttcatcggcagctgtcttactcatcttcattaagatgggttgtggacacttcaaggccattctgaaccagtggtcataaaactaataggtgccactcaacctgcgctgctcgtattattgcctgagacctgtcatctcggtagttattgcaaaaggagaaggaatctactgtagggaacacaatggtccttgtgtgacagaagtgaaactgaaagaaatagatttttctattagctgcaaatcaaacccttgcacatcatcccttggaggtgacagtgcctgattctctaaggcagggttcaaacaaatcatttgggcttgcagaaaataatatgagattaatatccaagtgtgtgtgtgtatgtatttgtggggtgtgtgtgtgtgtgtgcgcgcgcgtgcatatatgacaactacgtggctcctcacttgaagttttggaattagctactaatatatgtgtatgtttaagggatgcatttgtggacttgaagttgaaatagggaaactgagatgtattctgaagagggaaggagaagagggaatccagtcctgattaggggaatattgaaataagtaggtgaataatattcagtctcccaggtttgtggctatgagctcttttcttccagaagtatttgctgaagggagggaagaaaacactccttttcttctgacaatcaaacttttcaaatgtcagcatgcatgggtgtttctctctattcttgaggctcctttttgtttcagtctaacacctcacatcctgtgggttgtaataataatggtagcagttaccatttattaagcccttgtcatatgccaggtgctttacatatattacagtgtttgtaatccatacaagaattattacaagatagatatcactatgcccaggtgtgttagtccatttgtgttgctataaaggaataccggaggctgggtaatttattagaaaaagaggtttattgggctcatggttttgcagactgtacaagcatggcatcagcatctgcttggcttctggtgaggccccaggaagcttttactcatggtggaaggtaaagaaagggcaggtacgtcacatggcaagagaggaagcaagagagataggggaggagttgtcaggctctttttaacaatcagatctcatggtaactacagagtgagagctcaatatttcaaggagggcatgatatggttcgactctgtgtccccacccaaatctcatcttgaattgcaatccccatgtgcagagggagggacctagtgggaggtgattggatcatgagggcagtttcccccatcctgttctcatgatggtgagttctcaggaggtttgattgtttaaaagtgtgacccttcccctctgtctcactctcctgctgccatgtaagatatgccttggttttccctcaccttctgccatgattgtaagtttcctgaggcttcccaagacatatggaactgtgagtcaattatacctcatttctttataaattacccagtctcaggtagttctttatagcagtgtggaaacagaccacacagaccaccaagccattcatgagggatctgccctcaggatccaaacacttccctccaagccccacctccaatgttggggatcacatttcaccatgaaatttggaggggacaaacatccaaaccgtatcaacagggaactatagctcagggaggttaagtaacttacccaacaacacacagcttatatgttgcaatgtaggaatccaaacccccaaagcttgtgccctcctactgcgctaccctgcctcttccaggcttggggctttagggaatgccctttacaagcagtataaagacgcatttaggaatttttcaatcagctcttgtctagatcttctttggaaagtcttcttagttactggcaggtcaaaataccagctacttgatctaatagtgttatcagcaagaaactaaaaatcatgaagcaatgcagactttttgaatcagataggacttactaggccatcttgtgattctaatctaacatcttatctggccactttttctgccttgtgcaggaagtgaggtctggataggtcaaagggcatgactagagcattggagttaatgggaatggggaatgccttctttgcttcttgacatttctcctccacaacactgcacatcccttgtgaaataatttactattttttagacatcatgtcaaagactgaagtgaaagccaccctcttgtgatcaactgaggtcagaagttggcaaatttttttgttgggggtggggggctaaagggccagataataaatatttttggcttttcacaccagaaagatctccattgccactagtcaattctgcatttataactgagaagcaaccacagacaataagtaaagaagtgggcagcactgtatccagtataatattatttacaaaaggcaaagagggctggatttggcttcccaatctctgccttaggcctttaaagatatagcttccctggggaaatctctacactttgagatttatactccagtactaataacatagtaagagaatagtaatggtggtggtaataatagcagtagtggcatcagcagcaacaacaatggcaccttttaacatttgcttaatacgttaaggtttacaaagtctttttacaattatcatctcacataaaccttttaaattcctactcaagaactacacaagcaagggaaacgtgctagctgagcagtgtggtacaatgaaaagagaatgggatatactgcatttagtcatagagattggtggtgtgggatgaaaatgcctagagagtaggtgtgtgtctcctggccccattaggggacagttcattcagcagcagggtgagtgtcggagttcccaaatacatggctgctaatcagttccctcactctgtaggcattttgcatttaaagctgtccagaaaagagaggcttggtctaagaggttgtggtgtaagaaaatctctacatttccacccattgccttttgggatccctgtatgttagtgagcaacagtaaaaagtgacctgtgttaaaaaggtaatggaagcatggtacaattttagagttcatttgagcaaacagagattcatgaattgggcagctccaaaccagaagtggtatggggattccaatgaagaagtatgagaactaagctattataaagagaatgcagacctaatacaaataaaatatttgattgattacagttataaagctgtctttgctgggaaattcctagttatgtaattataagtgtgattggttgagcttaagttctgtttgtcattattataggcatttacaagaaatagctcaagttaagttctgctgatgtttgcaattcaagcaagtctaaggccacttatgaggcctaactggctctgtctgctcaggaattcttgcaccattgaagcattcttcaaggtctccattttaatttagtttaacacctcttaacaccacgccttcaataacatttatttaacacaggtctttgcttcgtgctaaaggcaaacatgtatatgagactctgtccctaaagcatctgtaactctccaaagacatacccctaggaacatcctgaagattctgaatcttgcagcctgccagaagcacagcagtgctgttggcatctctagaccactgtctgtgattgacttctggctctgctacttgtcagctatgtaaccttgggcaagtttctttttctagtctctttgtcatgttcttcatctgtaaaatgggtattttttaaactacccatttatgtagtctgtgatgatttaagagctaatatggtatgtgtagtggttatttatgagctaatatgtgtatattagcttaatgcctagcattcgtaaatactcagataaatgccagtcattattattatcataattgctggtgaaattaacatacaaagtcctgtgcaaaccttaattttctcactatggacttcatacattttcagaatcctagctacttggttctcagaacattcttctaacacctagagattccacagccaatgtatctttgggaacttattgactaacacagagctaaatgaagtaagcagcatttgtaccctgacattttacagatggaaggaatcatagaggtcatctcagccagaaacacattttcaagatagggaactgaggttcatagaaagtaaatgactttgccaaagtaatacactcaggacagaatgagggctagaaccccggggattagtttttttcctctggcctcaaaactcttccttctgccatttttaacttaccaatttcacctaataccttccacatatttttgtgactgtttcaaagattccactagctaccatagaagaagtaatgaactaaccttataattccatcccagtggcttcacctcacctgccctcagtttcctcacctgtccagtgaggcaaacttacattggaagatccctaaggtggttcccagttcagataagatacaatcctaacaaataaagtggggtcggagtggaatgttcttgaaatcctggtatcaatgggactgggatattactctaaatctatggaaacttcaagaacaatatatttgttttaacctgaaaagacagttgcgttccagtgtgaaatagccaccaggctggatgaaaatgtgtgatgtgattccatcattgaaatgagcatgtgttgaccgtaagttcttctctttctctctggggacatttgcagtgctgcagagcttctctgtgagctgggatgctctgtcagcttaaatcctttccagagtgataaatatacattgattttatttgatttggcccataggtgggggataaaaaacaagacatcacagccacactatactgtatattcattccccctgaagacaacgcacacatccttgttgaagtctcctcatttagacaactcttcctttttatgcttcattataatgccactttcatgtcccttcccctcaacatcgtgcaccttgttccacatccagcactctgtgtttttaaattaagggaaatgccatttaaatatggtttttctctttgtaatatactcacctataaaaagtctttaaaggtaatgctaactgctttggcagaaattcaggcatatatatagttattttaatacaaggctatttgtttgcttgactgtttttaatgactactcattaacaccatgatcttatcctcatttcctctgcacagagcttgagaggtgctgttcacagcccctgctgcctgctttctgaggtctccaagatgctagctttctacttttccactcagccctgacacctagttcatcatttgagataagccccagttgtcggcaaattgcaatctcatcaggtctgcaagatagcatcttgtttgactcttttcaacaccttccattaacactttgggactaggtctttgggaagagccaggcctcaccacatgggcgattgtggttgatgaacagattctagttttccccattattgacttcattaaacttgacagcctttttagtctccagatagggtgaaccttttttcactgacccttattaagagctgtctccttaagaagggtcattcgagaagggatagtgggggccactccttctacttccaggaaatagctgattttggtaaacaactttgatttagtttttagagttctttcacctccctaattaggacagccacaatttatcaaatgttagcaatgcaccaaagcctaagaatgatcttatttcttcctccttattcatgggttttattactactatcctaatttcctcatatggaaatgagcctcaaaaacattaaataagttactctaggtcccatatcaataaattgacagagctggaattggaatcaacttaagtctgacttcagagcttaaggttttaaccatcatattctaccaccttcataatacctttagttactttattatattttaggtttaccccttgttattggtcttcaaaatccatgagttcattctgattttatgaggtgtattggtaatctattgtttcatgaaaacttaccccaaaacttagcagattaaagcaataaacacctattatctcattcaggctttgtgggtcaaaaattcaggagcagcctagctgggctcagggtctcttatgaaattgtagtcaagatattggcccaggctgcagtcagtcacctgaagccttgactgggctggaagatgtacttccaagtttcactcacatgcctggcaagttactactcattattggtagaaggctttcgttctccagcaatgtctgatcctaattttattttaccatagattagtgcagtcttcacatgaggtttcatttcacctctctttctctctctctctctttctctctttctttattttttttctctctctctctcttttcccctggcagtcttcttttggtcaagccatttgtattagtttgctaggtttgccatatgaaagtaccagtggcttaaacaacagaaatttattacagttgtggaaactaaaagtccgagatcaaggtgtcatggagcattgttttctctgaggcctctgtctttggtttataaatggtgatcttgtctctctgtcttcacatggactttcttctgtctctgtgtcctaatcacctcttcatataaggatactagtcatgattgaggctcatgcatctgagctcattttcacttactcacctctttaaaggccctgtcttctaatacagtcacattctgaggggtgttaggacttagggggttaggacttcaacatatgaatgttgaaatgaagtaatttggctcataataccatctttgtcctttgtatgtcttgagaatttccttttacactgtcttacctattacttatgtcatttctccattcttaacctctctttgcctcaagttcccaaagctattgtgcagccaactttaagagttaactgcctgcctttctgattgctcgttacacttgaaggacttaggatgctatacctgaaggtcttagagagttagactggtcctccaagcttatgaattttctagaaactttttaacttgcatatggtattctcctgaagaagctgtggctaaagtcagatatatttttataaactattctttgatcatgtatgagtgccaaaaaaaggagtctttaattactttgagggaggggtctgtgcatctttcttaacccttttcctggctgccctgtagatattccagaaagatttgatgtcttgtggaatggtctgagaaccagatggaagctagatgaagaacaaaatcaaaagtgtctctcttgtcttgcatgatagaaactaatatcactaagaacgcaattgagagcaaattattaagaatatgcactgaatgtgtacaacagccagtgtttgttcctcatcagcacagggaagcattcttttttttttttttttttgtgagtaattttattttattttattttatttttttttattttatttatttatttatttatttattttttaattttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtggctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccattgatgatgagcatttcttcatgtgttttttggctgcataaatgtcttcttttgagaagtgtctgttcatgtccttcacccactttttgatggggttgtttgattttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctaaggtttttatggttttaggtctaacgtttaaatctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagttgtagatatgtggcattatttctgagggctctgttctgttccattgatctatatctctgttttggtatcagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagctgaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgacagagggcatccctgtcttgtaccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgatattggtctcttcagaaattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgtgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatctctgttcttttacatttgctgaggagagctttacttccaactatgtggtcaattttggaataggtgtggtgtggtgctgaaaaaaatgtatattctgttgatttggggtggtgagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgttggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttttcctggataatatcctgcagagtgttttccaacttggttccattctccacatcactttcaggtacaccaatcagatgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctggagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgcgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgaggacgggcagactgcctcctcaagtgggtccctgacccctgacccccaagcagcctaactgggaggcaccccccagcaggggtacactgacacctcacacggcagggtattccaacagacctgcagctgagggtcctgtctgttagaaggaaaactaacaaccagaaaggacatctacactgaaaacccatctgtacatcaccatcatcaaagaccaaaagtagcacagggaagcattctaagcttttgccaggacgcctgcttattatatgctatggtctgtccaaatcttctgtggctgccactacagcctgatttcccttggaaacttggcagcccgtgagttacgatggaattcccaggtgataatgtatctaatttccctcattgtacttcttttatcctgtaatgtgctgttgattcccacggctgagctgtgatggagaatagccattattattgtaatggcattattcagtccattaagacttaaaacatacctggtaaaaatagtgaaagcttacaagtcttcatagcaatctcaaagactaataacttagttgttagtcttttcctcaagtaaactttgacaggtgtttgggaataattctttcctgggctgatagtatttgatttgtactatatattgttctaagtaaatgcaggaccaatgctccatcctattcgaaaaaagaaaaggggtctctgtagagaaactattaaaaaagtttaaacagcctttacagaaacgtggtttggtggcaaagaaagggaaaccaccaccccttccaaagctcaccaggagaaaagtgagaaataaaatatcaaaatgaaattgactccacacaaagatatctgatcaccagacaaaacaagtaccaaagtgcagaaaaatattacaataaataacatcagattctttattcaagccaggcaaaacttatgtagtttttcctaaccaggttaattattttcctcatcttcttttcctttaatataaaaaagggatataagaaagcaagcctgagtatattcttggttgctctgtttcttgtgttagcctagccagaacgagctacaatagaaagaagttatactttagaaaacaatctatttaatataattcaatgctacacaaagctttatttcttaatatggacaattatttgctactggaaagaaagcagagcgagatatggccctttggggagatggttaaataagaaatacatttccagatgatgtcacatgtaaatagcactccgaaatcactaggcatcaaaattaatcaggctgaatccattgctttgtaaggtgtaaatcgctagccttacttaaccttacttcagtgctgggactcccgaatcgcgaggaaggtatgattcttatttcttcacacacacacagactgagtgttctcaagacaggaacatgattgagaatgctggaaaaaacattacattaatctacattgtaagagtaccatgcaaacatttgcttgtttccaacaccttgtaaatgtatctcgttgttgactcaaaatgaacatttggtgcagatactgagaaaaaagaatgtacttagaacagggatttcattacttctcttataggtctcagctgtggagattgtttagccaacaagaaacccaatctctgttaggtatcttgtctgagatgatattaaaaatattcaacaaccagtaggaaatggaaccaatgaaaatgactcaggtcccctgctgagactggcattgacctgttagttgttgaattgtggaaagaggggaaagggaccggatgatcggtggtaagggtatgtttgaagcagtgacattcatcatctatttatgcaagtattttaacattttaataattgatacagttatctgggtgcatgccagttgacaacttgccctgcatattgataattttaccatgcagactccactcctcaggtaactcttgttctattacactggactttatcatcatgtaatctgtcctgtccctctctctctctctctctctctctctctctctctattgaattctgggggtgtagtagtccattgtttagagggaatttagaagttttcctatattaggaagtgtattcatttcctaggaatgccataacaaagaattacaaactgagaggcttacaacaatacaaagttatcatatcatggctctggaggtgaaaagtctgaaataaaagtgttggtggggctggacacggtggctcacacctgtaatcccagcactttgggaggctgaggcaggcagatcacttgaggtcaggagttcgagaccagcctggctgacgtggtgaaaccctgtctttactaaaagtacaaaaaattagctgggcgtggtggtgggtgcctgtaatcccagctactgaggaggctgaggcaggataattgcttgaacccgggaggtggaggttgcagtgagctgagatcgtgccactgcactccagcctgggtgacaagagcgaggctacttctcaaaaaagaaaaaaaaagtgttggcggggccaagatctctctggaggctctcagggaggatccttccttgcctctttctaacctcttttgatttgctgacaatctttggcattctttggtttgcagctgcagcactttgatcacggccttgttgtcacatggcattctcacctttagtgcctgtgtgtcttcccctcttcacataaggatgcaagtcatattggatgacttatcctactatcctactatgtctatcctactccaatatgaccttatcttagctgattacatctgtagtgaccctatttccaaataaggtcacactccgaggtactggggggttaggatttcatcatatcttttgggagagacacaattcaactcaggacaggaaggaaaagccccggcaaccgaattgtattgttctgctagatgatgacaagtcataatgtagagaagttgctccaaagtgggatacatacattggagggcagcatagaatgaaagttttagaacatctatttatatttattttaatcgtattcctttatatttttgttatagtctgtttcatagcacatttagtgtataaatataataatacatgtctacgtgttaaaaatgaatgaaaatacctacattgggagtgggctgaatccacagaaagttttactgatggtggttcagggaatgtaagcaaaaggatttcaaaccaatgtaagagcatgaaatattaatgacatgtttcagataaaaatctctgtgtaggtttttcatagccccaattcaagttagactgggcaagaaatgagattatttaggcaaaaaaagggaggagcactaaattcatccacaattttaaaagtatcttctttcaggaggcttttggacagtaacatttccaaaaaaatatagtgttttatgccacagagaatcaagttgcattgtgtatactaaatggtcaagcattttcaagaacatgacaaaataaaaacatacaaatttatatctcaaaaggaaagtatcttctttcatgtcagatcatcagcacagaagccctcgatgcatgcaaaggcaagcacaggctctgcagatgagatgtgaagaagcaattagggaaggaaggaagggacagtttggatgctgggtcctgacccagaaacaacacggagtagatctcggatttgctttttcttaggtccaatgctaggacgattactttatctgtggtgaggaatgttataaaaaaccattgttggaatgccaccaaaatacttctttcccttttagcatcatcaccaagattctagaacgaagtaataacagttgccaaccttgagccattctccagctgttgtcatgtttcagtcagacaggaagtgttggcgagtaatatgggatttattgggagtgttcctttacgtgagtccaggaaataagaactagagatgagcttgggtgcctctgcttcttttatttctatggaacattctttggggtcagttttgaataatcactgggcattatcggatttctatcactattttttgcatgttcttgtgattattcaccagggaacattttataatactcatattaaatttttatttcttaatttcttgcctcattactcccatttgcattggctgcagactctctaagtattactttcccttccttgtggttcataccctaatcattgaatattgatgttctatttatttctatgcactcactttgtttttgaccaagttatatagttatttggttttcaggtaatgctttcttacagttactcaagaatgtatgctagaaaatgttgcccataactgcttaaacataaaagaggatatgttttcttgttttccatctatgttacagtctgtttctgaaatatcctttattatgagtagaataaaatctactggacttggaatccacattcccttttaaattaaaagtattcccagactttcaaattttacattccttagcatgatctcttctctataaagacagaagaggggacagaaaattctgactgatcatttcttgagctagaagcagctataatattcctgttctccatcctttataattactttctcataaatactaaactacacccccctgagcatctagaagatttaaacactgatcaaaggcaggtttagctgtatcctcaggacaagctgattcaatgaagaaaagctcaggctcttggagagcttttagaaagagaaataaattaacaattagcatttaacagcagtaaaaactgcttagcggaagcagacttgatgttttaggggatttgagatattcggagtgatgagatgaataggaaaaactgtgttccaattaggaagacagagtgaaaaggtgtgagatgtggtcttctagttcattccactggtgatatagagcctttcctggacagatttttatcttttttgagtaattattatccacgttataatttcatgcctgttgcttttaggtaagctcagaattatagtcatggcttgagtaaagatctcattgcagttgagtactagcagtaccactactcttgcatgagttgcattctctcttgaccagctctgttaatgggtgtccttatgtatgaaactgattttcttactaatggcaggattctgtctggttaggatattccctgaaatgcccaagggtgtattttgcttaaaagcaaggctggccagagaggtttggtttatgtatttatttttaaatttcttttgtacctaggataataaatatattcctctagtcttggataataatataaaattacagccatactgacaaaattaaagaagacattaacaaaaaattcagattaaaatataaagttcatgtctttggcaagtacacacaggattgtggttttgcccaaggtgtctaattaattactataatttttcaattccctgtgttcaataaaaacacgtctatgaaatgctattcataaaagcagaactcactggtcattaaacatgcaaatatccacgaataaatacacaattctctcttgcaggaaatgctatcagtagactaaataagtggtggacatttttctacagtaagtatttacttttcctacagtttgatcttaaaataccacagttggccagggcctcatgtgttgctggtgcaatctccgcattgttaatgggtatatgaagctcatgatgatgtccacaagatgataccgctattggaaaacttcctcattcttcctgtctaaccagtagcataatggatatgtgaatagtgcctgttttgtacattttccctcaggtaaactgtgataggcctttgggaataattcttttcaaggcctgaagcatttaaagtgcactgtatattgttctaaatgcaagaccaatgccccattctatcagagaaaagaaaaagggtatctgtgggaaactatttaaaagattaaaggagctttgactgaaatgtggtttggtggcaaagaaagggaaaccaccatcccttggtacagtattaaggctatatctgggaaaaccaacaaaacgtgtcatatgtggatagatcatgacactgacaccattagcaaggactttttttttttttttaacagcatttcttgtgctagtttcccagtgccaagaatggcttctttatttattcttgaactccaatacctatcacagtacttggtccttacttggtactcaataaatgtttgttgaatgaatctattttttatacttttgtatcaaactatcacatctgagcgattttgtaattttattcagctgatgatattctttataccagtgcaattttccatatgctcatgtgtgttttatttctcatgatatcagtttttctttctttgaactttgtagttccctgaattgcttagtattgtttatatatgactaaaggcccaggtggataagatggtatctttctttgtttattgtttatatatgactaaaggtccagtgaaaggtaaaaaatgagtttgttagatttcaaaatcagtcaaaaggtaaaatcagtgtgaagataagataccatcttatctaactggacctttagtccagtgaaaggtgaaaaatgagtttgttagatttcaaaatcagtcctaactaaaaaccatttcccctactggatgttgtaactcacatcattacaatttatggcttaatgaaacatttatttttctgaacaacttggatttcagtgagcagatttcttaaaataaggacattctatttttcattatagtactaagaatgctggaacaaatattttttctacttacatacttgagttcagttgaattattttatcaggtatttgcaagatgacctggaatatcttggaagttattatatgtaaattatacatacacatatatgtgtatagttcctggcattgggcaactagtataaggaatgctgcaaaaaaaatccttgctaatggtttcagcatcatgatatatatatacatatatatgcatatgtgtaattacacatatctatatgtataaataactatattaatatacttatataagctactacatattaataaatgatcaacatacctatattatttatatataaactatatataaatataactatatatatacacacacacacatatatatatgtagttgtagaaagggtcttttttagtgaattaagacttcatgaaaggccagttatagtggctcatcatgcctgtaatcccagcattctgggaggctagaggatcacttgagcctagtagttcaagatcagcctgggcaacacagcaagatcccatcttaaaataaaaaagatctcatggtaactaatatttgatatgtatgatatatgactttaagcaatattacgtgacatcacctttctcacattctaggttgctgtttacattttttgttcagtaatgaaacaaactcacgaggaagtaaaccaatcaacattttatgcatggagttttctaaatccttcatgtggctttggtagcattttgattagaagcccttgaattctgtcctgagtgcttacccattatctagtgatttacagagtttacaggaggacaccgaaatcacaggcttgaccgcatttacggatggcacagataccagatccaaaaagtttttaatgatctggaaccatgaagtgaaataaacaaggagcccagatttcttgaagacctcctctatgccaggcattttatgtctctcaattctttgagagaacctatggcatgaagttattaatttttttctagatggcaaaactgaaaataaagtatattcaattaatttctcaaggtcatgggattgaaaatactgtgactgaaaaaaatattttaagtcttcctgatcctagagtctatcttcttacattaaaataaacatattaaataaataagcacaatcagtttaggaaagatttgttttgatagaaatccatgcaaagcaggtcagggaatttcagttgaccacagattcaatggggaacatcagctaatgagagaaatgtacagtgcaaattatttcattgtacttagtgctagtcaggcttaataaagggtatgatactttggcacctcattgctttcacaaacaagaaggcattctgagtaagaaaacatgaagacaaagatcctaaacctttatcttgtggatgacagctaagaatgctcaggtaagaaatgactgtagtgacggcaggggatggatgagggctataacatctgttgcaatacatacactgaatggtgactttttcttttttaaattgacacggggtctagctctgttgccctgccagagggcagtggcgcaatcatagctcactgcagccttgaactcctgggctcaggtgaccctcctgcctcagcctcccaagtagcttggactgcaggtgcatgcaaccatgccccactaatttttttatatatttatttttagtagcaacaagctctcactatgttgcccaggatggtcttgaacttctgggctcaagtaatcctcttgtcttagtcttccaaagtgctggcattacaggcatgagccaccatgcctgccctaatggtgtttttaaaggaggaattagctgtggtcagtacagatttatttggaagaaatggaatctgtgcttagaagccaaaaggcccattattattcaataaaaggaagctctttagaacactttgaacctgaaagagttaatgaagcatgagacattagggttcccatatttagtttagatctatgtggcactatttttagaaggttacattgtttttaatattttatatagtaggccgggcgtggtggctcacgcctgtaatcccagcactttgggaggccgaggcaggcagatcacaaggccaagagatcgagaccatcctggccaatgtggtgaaaccccatctctactaaaaaatacaaaacgtagccgggcgtggcggtgtgcgcctgtaatcccagctacttgggaggctgaggcaggagaatcacttgaaccaggaggcagaggttgcagtgagcctagattgcgccactgcactacagcctgggcaacagagtgagacttcatctcaaaaaaaaaaaattatatagtataattctaataatgggatgctccacttcacttgcaagtacttgcatatggaggtgtttttttccccagtatgaggagagatcaacagtaaatacctatattatttctattgctggtcaatgcagaaaatatttgttaagcacgaagagtgtggatgtgtttgatgactacagaactaaggatttctcaaagaaacaaagagagaagtctaagttcaggtgtggaagcccttgcctaatttgcttcttcacttttgcccagaaataatttggccagggattgtgttactattgttgaattaaaccagacagaatcaggcctataagaagagccgtttagtaaaggaaatgattctgtgaaaattttagatttgataactgacatgggaggtgtttaccttcttttgaaaagcagatttaaaaaattgaattaaatatacacacagacttttacactcattttcagggaagcaagaactctatcataataatcaccaaatatcaattaatcagaaggaaaaataggcttgcaggaagagaaaatcagttcctttagacaaatggtattgacatagagattccaggtatgtttagttatataccatgcattctggatcaaatagagaggcttgtgacttgtatcagtattacctggcttcacagcagcaggagcagagaaaatatgcactatgtttagagatgaattaggagagtatgtctgaaagaaccagggatgcgtgggcaggtagatttggtcaggcatatttataataatgagccattggatttgggattgggtggagggaataaagtcagaaaaccattgggtcatcttccctaataaaagagaacgtctgtggagttataaatagaattgcctaatatttcatctaatagctttattcaatcattagaacctaagctttcttgtatcaatgtaaagtatgtgtgtgtatatatgtatatatattcatatgtgtgtgtattatatgcatatgtgcatatacatgtgtgtaatgaaaaaagaaaacagccctgaagaatcctcaagaaactgtcagacgtccttgtcctttaaaagctccagttgcccttcttgtctaaacacatcagtgcagtgtgaatcctgcattattcatgaacacataaggtctgtatttgtatacatttatctcttggctatttatttctataatctctgccccaaaccctcgccatgctttgtctttctcttttcctacttttcttttttttctggtagtttgaaaaataaacattagaaatagctattttattgcttacttctttcctttaacatatggcatttgcttaacctcttggagagttgtggttttctgaccctggagttctgatgggaaagataatgagaagtgtttacttagcatctaggccagcaagctaagaaaaacattgtgccatgctagtattgacaaggtgacagagagcccacacttgcctcacatgttggccactcccgatgctacatcccactttactcttgctggaggactgacattaatgcttactgttttgaggtctggacataatcctggtagattctaaaactcctagcaaacagtggtagacaagtcaagggtctataattgcgtataaacagaaaagtaaagacttacatatttaagcaacctgctaatccccatggtcatttagttccctagtggctatttttaatttgtcttgtttttagaggcactctgaaagcatgaggcaggtgaaagcgtgtctgtgtgttgcttgcatgcacatgctttttcaagaaggtcttcttcttttcttgtcaagactgcagctgtcaactgttccccaaaggtgttgcctagaatcagcatgcagcgctgtaggcaacctgtcacttagatgagacaccttgtatatatgctgtagttcactctctgacttgcctgtgtgcacaatgccatcttgtctgttagaagacagggccatcgtgagatgcagtttctctttgagatatatagtagctcttctttcttcaaaaggaaaaaataaaaaataaaaaaaagctactcttgctggaaaggtagagagaagggtctgcgggtgccctctaccattgtggtttcaatgtctaaatcttctggagaggattgctgcagtgatgagataaaagcagctgcctttccaagtactgtctatttgcattgatatttacattctttgccaaagtgacatcattaacatttgcttagtatttgtgccacagggatatgttttacataatttaagacttggaagtgatgataatgtatttcagatgggcagtagaggccacagagtgctgaatttcatcccctttcttcttaaggaccttagtgcataaataagtccctagtccgtatccctaaatcatattaacaatactgcttactgggtgccaacaatatgtctggtactggactagatatatgtgtatatattgtttagcccccatgacaacagtatgagggtaggtaccattatctccattatatagtaaagaagcaaggctagaaaaattggtgacttgcacaggtctgaattcagagacatctcaccgcaaggacttttctccttatgctgtgtcattctatctcccatcttgtagcctacttgtttcttcagatttaagaaacagaaaccctatattttctcaggacatgacacttgaaataacaagaaagaatattgtgggactctgaccttggtccgtttctgtctctttcattctcatctttactctaggtgcccagaaactcttctttgaaataaatataaaagatctgtgtttgctttgagagaaagccacataacattgtcacaagccagattattgaactctgccagatggcccttatttaccaaatatatgttttagttttatatacgaacagaggttttaaaaagataaagacgaacaaaattgtgtttaatgtcctgtatgataccttttgccttatttacaaactggtcctctctctgactgtacctgctcctgatgccccatcctcaatgtcctccatcagcataaaaaatgtgaaacctctttttcaaaaacaaatttaaaaaaaagtgctcagtctctcatcttgagatggagaattagaagcaaatttgcccttgcttttcttcttaatcttccttcttcccaccttctttccctcgctcccttctttcttctttctttcacaccatgtgccccagaatgacagctcagggaaagtaggcattataagctgagtagccttttccttgatgtcccttgaagggctccttatgttcagagaatatatcactgcatttgcagctcccccagaaatgccgtagcttggaggagcctattactcacttgaatctctttggtgtagacctataaatagattctcgtcttttccttgtaaccccctatagattcttgattcaagggtcaaaaatggagagatgagagttcaatcttcttggaacttactgacaccctagctcccttttaagaacttgtcctccttactaacaccatctacatggccatctgggtcttctcagctcagaaacaccctgcaacaatggctggcggaaataaggggagggcccatttgaattagcacattcccccacaagcacacacatccatactgccaggcctctgtttgtccagtttcctcctcttgtgctgttcttcccacccttctcctcagtgcagttcagatatcatctgtgtcccatgaagtctactctctcccaggggaaaccctttgaatttccattgcatattattctgtgcttctttttatgattaatcccatttaccttgtattatataaatatattttggtccttattagattatatatacttggaggaggacagtatctttctttggtccattggtgtggctaccacaggctcacagcatggcatttggttgcctaaaatgatatgtcttatccgttctttgatgtacagataagaaaagcctttatttagtttggctttcattttgttcaagaacagtggcacagtttggtttttcttgatatctttcccttattcatggttgcttttctcaaacagcacatgtggggcttaatacctagatgatgggttgataggtgcagcaaaccaggtggtacagggtcctgtgtgactctaccatggtgcacatttacctgtgtaacaaacctgcacatcctgcacatgtatcctgaaacttaaaatttaacagaaaaggaaaaagaaaaagaaattattataaatgtaaagtaattaaaagtatattatttaggagggacagtagatatcacaaaggtaagcatgtttcattctcaaatgaaatacacaaatttataaaagtgaattcagcaccagtggtgaatataaaaggctgttaaggaggaggagctaaagttttgattggaacttgaagaaaaggtatgttgttataggcagaaaacttgccatgcaggtgatcatgttagaatcagtgtcagacattaacaaaacattttcagtcaagggcagagagtaaatattttaggctttttggaggctgattacataatttgcacaatgaaatagtgggtccctttttcaaaaagcaataacgaagtgccatgagaagtacttaaaacataaagctctttttcctttttccatggtttctctctctaaacttgtcatgttgttttatatttgctcttcagtgtcattctaaggaaagaaaatgttaaattattagcatgaattttgccattcatctttatattatgccatgccagtcttaaataagttctgaataagaacttctaattcatttgcagaattactgacataggaaacatttcttatttcatagctcatgcagtgcatatatgttttgttcttaccagaaaactggacacactgcacagattaactcacctgtttttatttatttcacttcttgatatacacatattcaacaaacactctcttcctttggcttcctaatgagtaagaaaagactgaaaagaaaagaaactgagttgctttttcttttcttttccttctttgacataattttcagctgaggtggttggtcaattcatggaagtaacatgagtaagaaaggctataattaggttccttagtcatttatgtttcttagaatgccatcgttttctttctgtgttcaaagcaagttttggttccaatggaaaacatgttctttaaggactgtcagcatcccagcttactcagagtagatgtgagagactttgcaatcgctttgagtctcattgagtgtgcatcctaagtctaccagaatcttctactcccggggtattgtgagagctatagggggtgaagtggcaagaaacaatgggcatgtgtatagtatatccatatgtttatgcatctctcttttgctactgcacatgcctaattgtttcattagacttcattcaaaaacacaaattcaaagataaaattattaagtgtttcaagacggagagacaggagaatattaaaccaagagcaggtggtacagggtcctgtgtgactctactggctgcatacccatgaagcttcacctgggttttgcaagccatatggtctctgtctcaagtatttagctgttgtaccatgaagtgcggctataaatgatatgtaaacaaatggacgtgactgtgttccagtaaaactttatttacaaaaaacaggtagcagccagaatctggtctgtgggccattgtttgttgatccctagttaggcaaaaacatggagatgagaatatgtgagccttgtttgagaattgcttagctagtgtgaggtaagtcagggaatttcagaagaaagccaattatgaaagcatggattggactgtttgaatattttcctctagttgataaagtgactgatggctttagctactgaattaacgtgatcaaaagagtttttttttttttttggagatggagtcttgctctgtcaccaagctggagtgcagtggcatgatcttggctcactgcaacctctgcatcctgggttcaagcaattctcctgcctcagctttccgagtagtgggaacacaccactacttccagctaatttttgtatttttagtagagatggggtttcatcatgttggccaggatgatcttgatctcttgacctcatgatctgcccgcctcggcctcccaaagtgctgggattacaggtgtgagccaccgtgcctcgcccatcaaaagagatttttagtgaattaatatggaagtgtcctatcacagagataggaaggggtggatctgttaatagacagatgaacaagggagctattgtgagagtccaggtatgagatgataacaacttggagtattaagaagggatttgcaatgatggaaatatttgattccagaggaattttaagtgaagtgtcaccaggatgtggagagtgatttgatgttggggctgagagaagaaaagatgggaaatttcaaggtcttgtgcccggaaggctgcaaaatggatagccattcattccctgaacctgtattgtgtgtatcttctgtttgctaaaataaccatgaacagaaatggctggtgggctgctgattttaggtggctgcagaattttggtctatttgagttgatgttgggttgcctaatacacatgatgcttacaaggcattcaagatgtgtcactggcatagaggagtggagtgagggatagaagtaaaggtaggtagcccatcttcacagaaaggtgaattagaccagcgacagcagataccatctcccaatggagaaagcatagagaagagaaagaaaaagaaagaggctctaataccctaatcacttacataccctagtgtagtcctctatgcttttcaaattaagtagatatttcactttcctgtttaaccttgcctggaaagattgagaggtccatgtctagtcacaatgttagaatgaaataaatgtgtgaaataaatcatgtttatagtgtagatccccttcatcttcatctttgagtcaaatgccaaagccatttgttggctcagtaacgtttcacttagaaaatgaaacttttattttggctaaacgagtatggtgtcctggtcctttcccaaaaacataccttcaattttaccctagctggctgattgactgtttcctttacagatgcagtctagggatgctaagggcaacatcctttgtgataatgaaagccttataatgtattttttccagtaacttaggatgctgtatattaagctgtatattggtaaatattttgtctatgtggagaaatgtaaatgagatttttttttcttttcatcattcttctctacaaatgtgcattgaaaagacactgaactttggtcccatgcttatgcacaaggtataaaagttgcttatattcctaacctctccacagagttgtctagattcacaggactatttggtcaaatgttctgcaattcagttccactgcttgactgtaattcacctataaacccagaaaaatactgctggagttcagaggccctgactgttattagacagagaaaacctatagcacactggaacaatcacatttaaaagatttgcctcaagctttctatggtcactattactctttaatttatgcttttaggtttcaactttgaaatgatattgaaattttcattatgggcaaccctgaatctggaaaaatccaaggcagcttttaggacagtcacctttaattacccaccaccgttaagattaggaagtaaatgctgaaattcccatgtaagtgtattttgcaagaaattttcacactatgaaataattggtctttatctctcatcctgtctgattctctatcaagacatatcaaacatgcacccctctgctcaaagtgtaaaaaaaaagtttgctttttaaagttttaattaaggcttttgctgtgtgtgtgtgtgtgtgtgtgtgtgtgtgtgaaagtactacacactttagttgtttaggtgtcattgttgagacatttagactgtatttcattcaggcagatacttttactttattacattcccaaatgaggaaatgtgctgattagatggaaaagcatgtgtgtatcttatagtgttagcaatttggcacggtttttgttttgttagctctcagcatggttgccttcaactatatttacaccacatgggtgggcatgtgttaaagatacaaaaatcctcagacctctgaattgcattcctgaaggagaccttaattctattaggttggtgcaaattaaaatgccgttacttgtaatggcaaaaaccgcaatgattttcgcaccaaccttatactgcttattgcttttgcctcttctgtaatgaaaggcttctaactggtttgcctgcctttgattttagctttttgtgtagccttggtcatatcaagtttctgctgaaaaatttggcatggcctttgatttcccagtctcatctcctacaactcaccagtatgcaccggtagttccagtccgcaatacgtcctgcgctgtcgagcttacgcacctttctgtgtgctgtttcctctgctaagaatgtctagtgaacttctactcaccgtttaagaccagatttaaatggcatcttccttacaaataagttgattgatctatcattttattgattctgtcattcagaaacattccttcaatgcatgctatgttctgggaaactttctctaaacggactcaaacatttcttcttctgggttttcccagcgctggatactctgagtcattactaatccacactgggttcttgttttctaggctgcatccctcaatagactgtgaggtctttgtgagaatacaattgcttttgtgtttagttccatattcacagcgttcattctagtgtctggaacatagggttccactacatgcactacacatttgttgactagaaaaatgattcgttttatcaagggactgtcttaggaaatactaagtggggtgcctttctgatacattgtaatgaccacccttttctctgttctctaacgttgtatcccaaagtagataaactagagttttatccttaccaaccatctttctctcatctccatcctactttcccagcactcccctgcacccccctgctgtgtgcaaagctccaatcccgggaaaataccatgcagcgctttcattctaaaggggagcaattgaaagcatttctttggtaatttaagcacacagcagctacctttgcaaaagcctggttgctaaattatcccctcaactactcattttgcaaaagggaaaagaaaaaaaaaacacactggggggatagagactctaataagaaaagagtctgtgttttctttaggttcagcctgattcctctccacctcctctcccttcagtgactgcaaggctcctggtgtggctcgttctgctacttttccttttaatgttttaaatgccacaaatgcttgtcataaaccaccttcttaattatgcagaagtggagctgaatggttagttagcagttctattgcaattactgcactttttcaggtctgctgctgttttatgtggcactgttttctaagttgctgattaagatgatgtagtgggtggagttcttcttcccaccattggagaagggccgctgaagcctgggataatgagtccttaggcaatagtttatggcctaataagagttaaggatgggagcaaggaggagatggagagttatgctcattcatttccttcttaaaaagaaaaagccctctggttttgttcaacttttgcttctcctttgtccagtgtagatgctgaaattgctagagaaatatccatgatggctcttagcagtcctaatcttatttggacctgatattctgaggcttttaggcatcttcagatatccttgtgcagtgaaagagccttgcattggagttgaaatgatgacgagaaaatttaagaactgttgagaatttgaatcaatctcttcatgttgccatctctctctctctctttttaaagccaaatatgaatactgctgtgtgccgatcttgagccctgagaagctgcacttccagtgtagttctaggtccccactgaaaataaaataatgtgaaattgaaagcagcatgctattgtaaagtagtgcaatcattcgttcattcacaggtacttactgaatgcctactatgtcctaggcactgtgtgaggcccaggggatggggctaaaaacaatataaacttcttgcctttatggaatggcattctagtcaggtatactgatattaaaccaatctggaaataaatatatactcttcaatggtgctatgaaaaaaataaagtagaatgaggtgctataaaaaaataaagtagaatgagggaatggagagtgtgctagggcatgctattttgggtggagaaggtttctttgtggcagtgacattgaaataagtgcctgaatgaggcaaagcaacaagatgtaaggatatccaagaagagcattccatgctgaggaaatagcaggtataatcaccctgaaacaggaatgcacttggcttattggagaaacagtgggaggctgatggctagaagacagtgagcccgcagggcaggacagggggtaaagtgaggtcaaagagataaccaggagcatattgtgtatggccttgtaggtgaacaaatgggctttgaatttaatataatttaatttatattttaaaatcatcttggcggctgggtgccaattataccataaagaggcaaagtagaagactggagccaccgaggaggctgctgcaggaatctaggcaaaagatatattagtgtggtagtggcaagcgtgctacattattatgatgtcctcggccttcttaagtgtttgcttcataaatcagtagagttgtgagctgtgacttggacctgataatgaatcattacttattttaaaattgatacatacaataacattcttaattttttataagctcatataaaatattgaaggaggattggtcttattttgcatctgtttattaaacattagactggagataaggttgtgaggccctagagccaaataaatattcccagccttgcctggcagacaattattgggtgtggaggttacccagcctccatgttgcctcagtgactccctttcctgtccttcactaggtaggaggcaaaaagctcagcagtgacacacaggctctgctctcctaattgctgtaaagaactgtgctgtttcttcttcaaaatgttgattgcaggcagctacagggatgtgctcttatgttacagtataaagattttttattgtaaagaaaggagatttgttggcatggtgggatgtgtgtatttgtgtgtgtgtgtgcaagtagctgtgcttgcactgggagactattttactttgcttttttcctctcccattataggaagtaatttttggaggaaaatagtatgacagtcctgatactattttatttattttcttcttcagagtaggtacaacagaaaatcctgaatttatgcttgttgtattttttctccctattatatttctgcgtgttcacacccctctattaacagagaaagtttatgctatattctgtactccttttactctttttattaagagaaagtgagaaagctgtcctagaattatacaaaatatacatatatttttccacatctgaagggtaaaggaattgtaattcatgggaatagagtgttaagggcttatacaatgatatatactatatatatatcattgtttgtatgtatgtacatatattgcacatatatacatatcactttttggctctacttttattattttcaagtttcttttatataaccccagctgctcttctgcatttagttaagtgcagtcctaccatgtctagaacccccttctattctgcctacattcacgactttcatccctcaactctggtcccatttatctgtcacttagcattaactacgttataatgccatttatcccttttgtgcatgcattatttctactcaagtgggccatttgcttttttagggcaaatatcataatatgcacctacttatatgctccacatctgcatcaattcagacagtttggttgcaagcaacagatactataggcttagactacctcaagttggtcaggaatgtattaaaagtctttggggtagcttacagaatcaaagcaaagactaaaggaagaggtttccaaaaacaatcagagaatcttgggaggtctaagtaacagggactaattaatagctattttaggctgcagctgctagaatgcataaactccaattatttccccccattcttacaacagcctgctgaagcctccaaggtattgggtcatgtgcttacccctaagagaagcagaaaaaaaaatcaccttttgacaatcctacacctctgtgaacaatgggaaggagatgtaatttcccaaaagaaaaccgggcactgagtggcccaaaacaattgtcctctataatatcaagcatactttggtgtccacagttggagctctttacagatctggtgtcagtgatggtgacgacaaggagaaggaagagttgtaaatgactttgctcttttgagtaagtgatcatcaaatgtccttgcagtcagaatggcaaacaaatggcatggcctgtcagtatctgaagttaatttgggctggctgtcctttctttttggatatttaggtttcagtaatgatttcccgaaggccacaataataaacatgtgttatgttataaaaagcgggtgctgcatacattggaagcaaggccccctaattgaatcacctgtgctatgactctttcaactcctaaggcataattgaagcactatctcagttggcatctttgtggtttccatccacacattcttactttctggtagctggattatgaacaaccccaaggtcaggcttgtgtagaacccaacatcttacatattttactattgataaaatacaccctgagtataaatgttcacataacactttctctcatctctatagttatgtttctttcttatgaccttggccacatactttaaactccttgggaaaatatgctgccgttaaaaacgcttcacctatttcttgaaaaatgaccgacaagatgtttttcgtccaattctgtcgtatatttctattccctagatttaaatttcctggacttaactgttccctatagttagcagaaacattattttaagaacaatttaagttgaacttcatgtgaaactggctactgaatctgagtcgggaccttcttctggagggaggtaattaaatattccttattgatgctattttaaatgtgttgaatgaaaggagttaattatacagcagggaacatggcagagttctgactaataatgagctcaatgtttaatgtcttcatctttgttagaatcattaaagttgtttgaaccaatcagatgtttcaagtgaatgtagactcacagctaaccagctccaaatggcaatccctcacagatgcaggagctggtatatctaatgatgacttcaggaaaaggatggcgatatattgctttcttccatgcagtataatctgtttcagttggtcttccatcgtgatggtaaagagaaaagaataagtcttatttccaaaatttcatgtgttataatggaatgatgtttgtgcctggacatataaaagaggaaatgattttgttttttccttaaagttttacgtagccaatctctttggaatctggtgcaatattgacatttctggctgccaattcctcacatgataaatgcattaacactaaatcttaggatgcccaggaatcactagaggaccaagcactgtcctaaagaatggatctcctgtaatactgttgtagagaaatgtaggctcttgaggtcaggtttttcataccgtattactggtttgttatgtgtctttaaataaattttgcaaactccccgacactcaaactacttcctcttaaatttctcctcccttctgattgcttcaccaaacagcctgtggctttgtttttatttacaggactcctaagactctgtcctgtcctgtctatgctggggaatgtaaagtacagaagattacttccttggttctccatggaagtccttttacccagctgtgaggattgtaacaatgattggcggtgacatcactctattactgaacttcacatatgggagttgggagactttgaggaatcagtagggtgaatttaccaagttctcccatgagcccaggcagccggggtgtgtgtgtgtgtgtatgtgagtgtgtgtgtgtgtgtgtgtgtgtgtgtgtgtgaaggaagagtaagtgttaggacagaacagcagccatcatgggaaagggaaatcctagttccacctaggatggttacttcgtggagagggttactttgggtagttacggcagccttcagggttttcaagaataatataacatatatgatttatatttttgaacttcgattttaccactgcgttccctccagtgtacttagtagagataggatcatgtgtatcgagagctcaggctttagaatcccacaggtctggaatgaaatctcagctctgacttttactacccatgtgactttggacaatttatgtatccactgtcagcccattagataacctttaaaatgggaataaagtagtgcttgctttgcagaattgctgtatggattaaatgagataattcaggtaaagcacatagttgagtgcaaaattaatttatcacatattattagaaatgtggttgaagattgttttgttatttagatgaatcatatttaaatctttcattttcaagtatctaagacttccaaggactaaaacttccctctgaattttaccactcatcccagctggagatctaagataactatttttgtgtttgtttgttaattatttgacatgtttcttctcaaattaagggaaaattcttatttcggagtcactgttcagaatgaaaatgtgagactaagtatttgttttgcaaagcgcaacagaatagagaagaaaagttgggcattctgtagggcgacccatttggaaaaataaatcctaccccttttgaaggggagaaattaatgagatgagtgtcagtccctccctccccacccactgacctctctctgggatcacacaccaacagcctatgatgaagtgttgctgcagtgcaatggagcaaggttaccttcacagtaacagcttttctctggccagattactttatagccaaagatgtggttattttcacctaaacgtttcatttaaatacattgtaaagtgtgacctaggaaaacgagacaaaatcattctaagctgtatagagttggattgtttgtagaaatgctggacattaaccaatgactctcaacttgaatgtacatcagaatccccaggagggcttgttaagaaacagattcctaaaaccttactccaaagtaggtgtcaggtggagcctgagaattttcatttctaacaaccttccaggtgttgctgatgctgctagccaaggaaccacacttagagaaacaccttcaaagtgcatattttcgtgtcttactattcaaagtatgctccctggaccacctgcattagcatcacctgagaccttgttggaaatgcaaattatcaggtcccacttcagatgtaatgaattagaattgtattttcatcaactccctgaagtgacttgtttgcatattaaagtttgaggaacactgatctagtgattatagccaaggtctttggagagttgagaatctgagacagtcagccctggattcaagtctcacctactgccattttctagccctgtgattttgggggtgttgtcatttttcttctttttaattcccaatttcatctgagaaattgggatgatcatacttgaaaagttgtgaagattaaatgtgataatgtaggtaaaatgcatacaattagtagtgttgttaaattatgtcttcatttctttttatgtgaaacctgtcctgtgaaaccattagaaacagctgtttgaagaaggtatttgaaattctctctgaagtgttttcctatgtcctgttttgagagaagctattttcacagtatggcattagattgtcctcactatattattttgtgtatgagtgacagctgtagagatatataatggtttgagtttgccaagtcacagccccctcgtttgacctctgaatttaagggtgtgtgtgtgtgtgtgtgtgtgtgtgtgtatgtgtgtgagagagagagagaaagagatacagatagacatttcgttggaggaggagtgtgagggaaaacctagggttttctttcttctctaataataaaatatgacataggctttcaaagataaaattcgatttgtaatatttgacaacactggttagtcagccctaacctcactgatatattatgaagatgaaggttatgccagttaataaagtgttttgagaacattgaaaggtgctaataaaattggatatttgactttttatttacgtatgtatgtatgtatgttttgagacagagttttcctcttattgcccaggctggagtgcaatggtgcgatatcagctcaccacaacctccaccttccaggttcaagggattctcctgcctcagcctcctgagtagctgggattacaggcatgcaccaccacgcccggctaattttgtatttttagcagagacaggtttctccatgtttgtcaggctggtctcgaattctcgacctcaggtgatccgcccacctcggcctcccaaagtgctgggattacaggcgtaagccaccgcgcctggcctgacattgtttaattttttaaagtacagcccttagtgataatttttccttttctgtagccagagaggattctagtattttggcagttggacgatatcttatctctctcaatgccctcatcagttgagaaataagcctctttcttttagtattttatattctcaaagctcagaacatttcagagtcatgttatgtaaaaatgaggtataatggctgcagagaaaataaattaaaatgagaattgcgctaatgcaaattaaaagggttaatgggagcattttcttctgggtctcaatgtaggtctctgtacagatgattgaggggtttttggatcctgagtgttattcagcttggaggggctcttttctgaaattgctggctcccatacaaataggcctcttaggaccagtcattatgatgcacaccttgcactataactacatttttaacatttacaggtagggcggtggagctcttcactgcttagttactacccagggtaatctccttcaactgtaacagcaagtcaccaagttcttaatgagtatctcctgttggtccatggtaatgagggtaggtgtgtgggagaggcaaactgtaagacctttcgctgcaaatcctataagcacttgccactcaaagtgcgatccacaaaaccagcagcagtagcagcacctaccagcttgttagaaatgcagagtctcaggccccacttcagacccactgaaagagaatcagcagtttaacaagatctccggaggctgtgggggagactcacaggcagcttaaagtttcaggagctctgctttaagaaacattcctttcagagagggaacttaaactgagccaagatctaaaaccatgtgaactccaaattcagagaatcaggtcagtggtcaccagaacagagggtataataattggttataaaccattctaatagttgtaggtttaaaggaacatgtaagtgtgaggtcagttattcactgtattatgaaagatatgctttatagtttgcctcaaaaaaaaggaagtctgattaaatgtcctcaatctatgtggcagatccaagtaagaccccaaaggttaaaaacaaaacaaagcaaaaagggcaatgccgtgatcaattgcaagtcagagttaagatcaaaattaaaatatgaggtttgtaaatacaatggtaatagaaatttgacgttagcatacgaggctccccattgtttggaaccctggtttaaaagctagaatcaaaagaattttgtctagacctaatgcatactctcacttaagctaagtggaaatctttgcctctgttccagtaaccaaatctgtggcagagctgggagtggaggtattggtgagggttgtgggtggggagcagtgtcatcccccaacacactttgtgacagtttttaaggaattagttgatgagactcttgtttattctatggtgcagagagattagaggaagcagtttgagagcaaaggtcagactgttgatgctgggttgaaatagtctctaagatgcagacaggtatagatgtcctgccaacaaccagcaacacagggttgtccccagacttgctctcctgatattagagtctggctattcttctgaaccaaatacattattttactttatgacaagtgctattacatttaaggactttagagacactgtgattctctctgacatcatagcaaaatttttatgtgtgtgcccaagtactactactttttttttttttcctttggcttcccaagaagaggacctacttattgtttgtatcagatttttcaaggcaccttgggatataaaattttaagtctgctgaattggagaatttctatttattttcccaggggaaccctttggagttctgtcctactcagctgcgttatcccctagatttctgtaactgtattagttaggatgctttggagtgctagaaacagcaaatctggctcaaattgctccaaccaataaaaccaagtcactgacatgtaactgtaaccgcccaatgggttcaccttgtctgctgcctagatagaaccgatttatcaagacaggggaattgcaatggggaaagggaaattcatgcagagccggctatgcaggagaccggagttttactattactcaaatcagtttccctgagcatttggggatcagagtttttcaagataatttggcgggtaggggcttgggaagtggggattggtcaggttggcaatggaatcatagggggtcgaggtgaggttttcttaatgtctgctgttcctgggtgtggtggcagaactggttggaccagattaccagtttgggtggtgtcagccgatccatcctgtgcaaggtctgcaaaatatctcaagtactgatcttaggagcagtttagggagcatcacagtcttgtagcctccagctgcatgactcctaaaccataattgctcatcttgtggctaatgtttgtcctacagaggcgatctagtctccaggcaagaaggaggtctgctttgggaaagggcttttatcgtctttgttttaaactgtaagctataaagtataaactaagtttctcccaaagttagttcagtctacccccaggaatgaacaaggacagcttggaggttagaagcaagatggagtcagttaagttaatctctttcactgtctcagtcataattttggaaaggcggttttataactgaaaagaacagcctggctcgctcttcatgagacttgatacagggtacaaaggtgtcacctagagcatttttttctttctctttatttcctgtgcctttcctgcatctgccagaagatgacctaccaaggctagatccttgtgtacctctcaaatgttggccaacaactctggggccaactgctttccctttcaatttgagttggagagaaataatttttgtcccatcaatctcaggaaaatactttcaatctcaggaaaatatttcaaatatttccttcaaattcactgaagttgggttgatatagtttacctgcacagtctggaggaaagaatcctttttcccttttttgaggagatgttgtcttgctctcttacccaggctgatctcgaactcctaggctcaagcaatcctcctgcctcggcctcccaaagtgctgggattacaggtgtgagccaccatgccctgcctgaaaaaatcacttttgccagagggatagctgatttagttagtgcatgtgctctatccctggagccagggcagtttctaaatggaagtcagtggaataaaattctgggaagagaggtaaaaaaatgtttaccagttttctcagaatgccagctctgtttgacacttctctctcaggactttgaagactccaagaggaatgtattattatctatattctactgaggcaagccctgaagtcaaaagttttaagtgaaataggtggggttgtgctactggtctgccaactccagatccttccagggctcatctgaccatgtaggagtctagtttatggtatccacccagctggtgctaggaggtgagtgagaggaagaagaggcagactctttctctctccaattagcctctgcctctctgtttggttaataagatccatatatttaatatgctcaatgtgctttaatgtgttaccaaaccatttgagtctgttgtcacataggaaatgtagaacttttcaaacactattaaattcccttaatcgattaaagatactgccaaaatggtttacatgaaagaactaacataatagattaaaatatctttttcttttacatttattcattacattaaattttatgccatggttatagatctgaaactaattaaaacaattatacattgacttttttattcctaaatgtatcatgtttttagatgtgtaaaaataagaaacagattcagatttaaaaaataagctatgactcaaaaaaaattaatgtgaaatgcatctggaaaatttctcttttgaaactgaaatattcctcttactaaaaagttgacaatataactctttgtaacacaaagtatatcaggagaatctttggcaaaatggtgaaagaaactcttacagaatatgtaagtcacctaagttccagaattcaatctgtgctaagatttttatggctcagagggaaatatcatggactctttatgttataaaaggagtgaactatgtgattatatcttattctgaatatcaactgtaagaagcagattctcacgggcttcatccaatatgctcttgtaattctttctaacatatgtcctctattcacgaagaacaagaaaacatctccagtttaactgcattttttgtttgttttattaaattctttttttgggtatttgcacgttccaactacccagaaaattactcaaaatatttgccttgtggtctctgtggcactgagcatttaaagcaaactagtgtagttttggcttggtagagattgaacaccctttcgtgtttcaaatatttttagagaagaaattcagatacaaaagccatataagatttatcatcactttgacattaagggagcagccatgggttaaattacttgctttaggtgggtaagggaaattgatattacaccgattctgtcctcagcaccagactgtgtaatgtggggtcaccagaaacctctgacacagctcctgtcctcggggtgtttatgatgaggttttgagaaaagccagactaataagaattagattcacaatgccatgtcttagcaggatgatatagtttgggtacttgtcctctccaaatctcatgttgaaatagaatccccagtgttggcgatgcagcctggcaggaggtgattgggtcatgggagcaagtctctcatgaatggtttagcaccctccctttggtaataagtgaattctccctctgagtccacatgagacttggttgtttaaaagtgtgtggcacctccctcctttgctttctttgttcctgctgtcaccttatgatacccccctttaccttctgccatgattgaaagttttctaaggcctcaccagaagctgagcaaatgttggcacatgcttcctgtacgtcctgcagatccatgaatcagttaaacctattttctttataaattatccaacctcaagtatttctttatggcaccacaaaaatggccgaacacacaagatatgtctgcttggcctccaaaataaatctcaggtctctgattctgcctctatcaacctacattaggccaccatcgtttctcacctaaaccacaactatattcccctaaatgatcttcttgcttcagtttttttccttgtactggtttatcctacctatggcaaccagagttattatttagaatgtaaaacacagcggctgggcacagtggctcacgcctataatcccagcactttgagaggcagaggagggtggattacctgaggtcaggagtcccaggtcagcctgaccaacatagtgaaaccccatctctgctaaaaatacaaaaaaattagctggatgtggtggtggcacctgtaatcccagctactcaggaggctgaggcaggagaatcacctgaacgcgggaggtggaggttgcagtgagcagagatcatgctgttgcactccagcctgggtaacaagagtgaaactctgtctcaaaaaataagataaggcaaggtaagataagataaggtgagataagacaagatatgagcacatcataaaatgatcttgccaaaaaaaagaccattcattgatgtcccagtgcacttaaaaatcctaactctttcttactgcctggaaatctttacatgatcactgctaaaatctcagatcttgtgtgctacccctctgcccctaaggtcactaccctctgatcacattaactttcctgttctttgaagatgtcttggaacttgccattgtttctgtgtgaaatgtgtttttcctgtatgcttaggtgtatcactcctcgttatccagggttcacttacatctcgcctcagtgaagagatttagcttgattgccccatccaaaaagatcttatttgttaacttatttacatggatactatgtcttccccaacttcaagttcatgaggtctgtgtttctgtcttgtttatcaccccaggctcaatgtcttaaaatagcacctcgtaggctctcaataacagaagatggcaccaaattaatacactgaaaatgccacaagattttagataaatgtaaaaacattcaggctttgattatttggtgaacattttgaggcattacgtgagttggagcaaaactcttgaggttaaataatatttgaatgggctctgagaggcaaggggagcgtggccatgcttgtccccccacccttatctgtattctgataagaaaatacagaataaatttctttgaaattaaaaaataactcaaactctctgtaattatttttctttaattttctgagagaaggtttttttttaatttggagaaatttttaaaaattaaataaaaactagaaataatacttaatgtcttgacaaagtattaacttgatctagtttcagaaagatctcattaaactgcctgataaagtgattattcagtgccactttcatagagttttcagtaattatctgaaatgatttttagaatgaggcaacgttttcctttttttttttttgaaacagagtctcgctctgtcacccaggctggagtgcagtggcgtgatctcggctcactactacctccgcctcctgggttcaagcgattctcctgcttcagcctcctgagtagctgggactataggcacgtgccaccacccctggctaattttttgtatttttagtagagatggggtttcatcatgttatccaggatggtctggatctcctgaccttgtgatccacatgccttggcctcccaaagtgctgggattacaggcgtgagccaccgcacctggccaacatttcccttttcagtagcaggtgaaaccgtcttggtattgacacagaaatgctgataggaaaaggtgatgaactcatacacactaaaaatatgacatctacctctaaaagttttagaaatatgtggaaagcattcttggcccttttctcctaagttaagactgttcgcaaatcacttttgagagcgaagtgacgatgacatttttctcactcaagtcctaactcatttctaggcatataatttgaattaaacccttatatataattttctaattagatttttcttctttcatggctttttaagctttacataacctttgtgcttcctttttccattaatccttcaaatgccagcatcctgccaagagggtatttaccgcagtatttccatcattgttaacagagccacaagtttttttccagtatattgaaattacccatccatgagaaaatgcagtcttggatttttaattatttagttgacgcttattcaactatatgatgtaagtaggccttttctccctaatgttttattaccagttaaagcacagacaggtattttactttaatttagatatagagtaggtaacagagagctgaaattttaaaaattagataaattttttggtagttagttttatagttaatcttctctctttttttttttttttgagacagagtctcgctctgtcgcccaggctggagtgcagtggcgcgatctctgcccactgcaagctccgcctcccgggttcacgccattttcctgcctcagcctcctgagtagctgggactacaggcgcccgccaccactcctggctaatttttttgtattttttagtagagacagggtttcactgtgttagccaggatggtctggatctcctgacctcgtgatccgcccacctcggcctcccaaagtgctgggattacaggcgtaagccaccgcgcccggcctaatcttcttaatttgtcacttagagtagggcagtcgccacaatatggaaatgagctgggattagtgttatcactgggaagtgattgtaacttttgggtttgtaccaagaagtatatagaattgcttaaacttctgcatgatcaattactgcagatttttgcacctagctccactacgtagtccatcacatttcatagggcgatttctccactcctttatcatagaaccttaggagagaatgttcttttataactcccttgatggagttgcttaatgctgcctttaatttaattgaaaatggttgatcaataaagtcactttttatggatttatttctactgtttgatgtggcaaatcattaattatcattacctaaattagcatggattgccatgaaagtgaaaggagtaaattgctttatggatttcctagtgcatagtacacatagaacttttctaaatatacatcctcttcagcagttagtttgtgccagatttcaattcctacgctacaagttctccagcaaactagaggtgtccatgtccaagtggacatgctaaaaaattcaaattttacagaaattttacagagaccttacttttgtaaggtctccggaatctttaaaaaaaatctatttaattattgatagaattttagtgaccaccatagaggggagtacctgtgtaagcagaaagcaggaggaaatgaacccatttccagaaaacgaactagacattaaggagaaaaaaagaagagaaagaaaagtaaaaagaaaggagagcaaatacctctaggttttttattctgaaagcccatgttatgggttgaattgtgtatctcacctccgtcctccccgggaaaaaaaaatacacacacacacacacacacacacacacacacacacacacacagacaatattatacataatatgttgatgtcctaacctctagtacctaaaaaccttaaaacctctagtacctcaaaaattgtatatagtatgttgaagtcctaacctctgttacctgtttggaaacagtcttaacagaggtaatcaagttaacatcaagtcatcagtgtgggccctaatctgataggactagtgtccttataagaggaaattttgatacagacatacatagaaagaagattatgcaaagagacacagggagaagatgccataggcaaaccaaggagagaggcctagagcagctcttagaaggaaccaattttgccaacaccttgattttggacttctggcctctagaactgggtggcaataagtttctgttgtttaaaccatagcatttgtggtagtttgttacagcatcactagcaaactaatacagcccataatttatgactagcatttcatattaaaattaaacatattatatgaaagcttccccaaacactggaatactataatctataagagttgcattaactattttcatggaacgtcagaatgtggaatccaaagaaattcagagcctaagctgggtactatcaaagcattttataatcaaacattcaagtatgctctgattgagagaattgatttccatatgtatctttaataaaggaacccaactttcatactttcattgtattaacaagaacaaggcacagactttgttaagcctgattctgaatgttaagtaagccaagggtgaggaactaaaatttgtagagaattgagtcatgtagtgtctactctactgtgggactctggtgttggaattatcaaatgacaatgtgaatgcatcatagagatttatcctggactagcttacacttggaccaaaggtgatttatcaggcttatcattttatattgaagtccataaactctctcttctgcatccctctgttcgggagtgtgtgtggcatagaacaaatcagcctttggcacacattggaggaaagggtgtgtgttttgttttcataggttttttttagtgatgacaatcaaaagcccattttcttgattcctatggatatgaagccgattaagtattgataaggagtaaggtattagagtttaaaatcggggccatctctgagctacatggttaggtcagtggcacctttctctgaatccataatcctccaagccatttcaggccttttatgcagtcctactgcaacccagaactccttctaggccttcctctccaggagcagttatgagattgagtgttaactgcttataagacaccatatgctacacaaaactttttataaatgttgtgcttatatcaactttgacattaatgctattataatcctcaatttacagaagaagaaactgaggcttgaagcggttaaatgacttccccagagacacatagcagtatatgctagaggcaggactccaacccagaactggcagaaaagctgatactttcaaactttcaactaatggtctctgcagcctccaaagtatcagatttctccgtcaaatccttcttgcctggtctgtctgaccaactaatctctgataatgtaacgaaggttataataaatcccttccagagaggatatttgcatttaactggatgtttatgaaataatgtgctggcagaaagaaatgatactcatggtgggaatttctcattctttttctggtggaatgtataatcttggacaaatcatgaccgcaggagtcttcattttatcatctataaatgccaggattgggttaactactgtctaaagatctcttccagattcaaaattctatgattctttcacattaaatgcaactccttttcaacatatgtgtatacttggccctttattgaacctttttataagctgccaattggaaatacacagtcacggtagatatgacaatgagcaagtcacttaataactatcagcctcagtttcctaatctacaaaaggaggctattaagagcacctacctcacagtgttaatattatatacacaagtagcaaaatgtctggaacagagcaagggctcactagctatagctttaataacgtgataactgatggtgtgatcagttctattatcatctccctgcagaaatcacagtttatctaaggttatagtaaaagcacccatcatgacttcttttaatcataaagcatttcatgcagagtgcatattttaactttgtattctaaaggcattggtgtctcactaaaagctgggcagtatttatatcaaacagtatatcatctatgtgttcatttatgcatgcagactttcacccccctccaagctatgagaacaataggcgctttaaaagtctgaagcaagaaggatattagctccatgaatctttattttaaattacatttctgagttagaagtgtcaaaatggtagaacaagttaagcaagattgcattccccagtagggctattgatgttggttgcaaataaattgctggagcaggtgatgatagcaaagtccatgccatcttttatttagcaaagtatttctcttgttaacagctccttctgcatgctttcctttcttctgtttcacatcaatcatatttgacacattgcccaatgtcagggtaaaaaaaaaatgcagcgtctggctaatcatccagatgtttggcctcacactgactgaaacatctggttgtgtagctaaatgttatgttctttcatccagttattttgtgttctgttagacagaactgaagaataaaccctaggatcttcttctattaggataaagcttatagaatctcgaacttgagattccagaaccaaggccttactggttctcatagttgcacagctgtcagcagaatccggatcaattgagataatgtgtgtggaagcattatatagtatgtggaggcattatatggatttgagaagctcatgttaaaagaattctactccctttacttggttatacaatggccaaagaatgtttgtcttctggaaagaagttttaaaacagaataaaaattaattggtgttagaagccaagatttcagagctagaccaataataataacagctaagatatgtctgatgctaactctgatccatgaactcttctaagtgctctgcatagatgtaaaaacaatcctttgaagtggaccctactctttttttccattttacaaatgaagtaactaaggatgagagtgcagttaacaatttaccccagttcagaagctcaaaatttggattcagacaatttgatttcagagtctacgtatttaacttgtaaacttcctctgaaatcaaaatgtttattcagcttccaacaccatcacttattaaacttggttttgtcaccttaaagtggggatagcatgacataccttaaaaggattgttgtaaaggttaattgaaaggatgcatgtaaaacatttaacaatgttgttttttggtaagtagtaagtaaaagtagctattttttctctatgttatgcaatatttggaatcaaatatttcaatactaatttaaataatatattctaataatctcactttctgaaaattcattcaatataatttttttttcttggaagaacattcctagcaggttaagcacttttgatcaactcttgatataggctgttcttaaaataattggaagtccacaaattatatgtttctggaaactattctgaatatggaaaattatattcctttttctttttaatgaacatataatgagtatgtattaaggggaagatatatgctgagcttcctcttgccttccttttctcccccttcatttctgtcaccctgcctttcctatcttcacaatggtcctgtacagtaaactttgtttgcttttgcatttgaactttaggaatcaaggtttttaaagaagctgcatcatgtatcataaataaaaacgaaaaaaatgaagtgtaatattttaaactgttttagaacatgaggctcagtgttctatccaacaggctatgaaatattgctgttactaataagtatgatgatgaaagccactgattcttggacaactactatatgcctgacatattgctgggtgctttgcatacattttctcatttaacgcttagaagttcttgtgattgacacttgggtatcatgagcaactttgctcaccattttttcctatggtccggcgtctttagtcacttgtattactgttgttcagagtgacctttatttgattcatttacctttcagaatcttctattactcatgtatgaggaccacacatttataattagggagtaaatttggtcatcaactcggataaggcaatgggcaaatctgacatgttttcaaagacttttcagtatgctaactttcagtagggctggtttctataacagctacgacatcttttgtcaacactcaggctgattaaattgcaagattataatgttttccgaccctaagtgaaagtgacacattcttgttcttttagtggcttcataaaagtcaaatgtttaatctcaggaggaaatttaaaagatggaagtaaaaccttaatgagatgcaacataaataatagaagtccctttgcgtgaaatgacttgtgatgaggtttcttcaaaggaacaaactataaaatggagtgtttcagaaacctaaaatacactagtaaacactgcgttttaaaaatatggtatcaatgatactcagcattcagtaaataaaaagagttagacaactggtgtctgtaaaaatgttaattttccaaaacactataaatgtatcaccaaaaaataaacattttttaaaaaaattaggtgactattttcatgaatttttagtccatgaaacctgaggagttacttgaccacagcaaagattctttctaatcctttatccagccttttgtgcaatagtacctcctgttccactcacatttcacatgcctgtatgcatgtacattcagatgtgcctgtctttgtctcccagtgcttgttacacagaaggtattcaagaaatggtagccattctcacaatatcattcctattaccatttaaaaatgtatgtggaaaagggtaaagtgcaaacctgggttgttaaaataccggaaggatatctataatttaacaccagttcatttttgttttcaaatcactccaaaatgccctcacttattggtttagaaataatgtaacaaaacaaattgtgttgtgtctccaaagaacattttgctaagtgccagagctgtatataacactaaagtagatgctgacatatgaggattgtgagagatgaatggtgatatttggcttttgcttcccaagtataggtcgtgtccgaggtatagataattgttgttggtttatgataattcgacttgcggagttaggtcagtcagcatagatgcatattttttggatggttttttaacaatgttgcttaaaattttaaatcagattatttgccaaaggggggtgacaagatttggttattagcaaaaaggaaaatattaatctagatttgtttggtcttagtactgattatgaataagtcatcaatagttaatgataaggaatcagtctgctgtgccatattggtagatgaaatgctgctactcctcctattcctgggcttttctgtcccccacccccttccttccctccttcctctgtccctccaactcttcttcacatctcccaactcccccaattcacttcttttccactgcatgccatgttaccctatgcctagttatgatcctaattgtaaccctagttagagtagacacaaagtaaactcaggagcagggattataaagctcaaaattgttcctcggctccgcattttgtgtttattaacctattttacccttgcagcaactccaagcaagtctgtaaattttagcattgagagttctccattttgtgagacccctctgtctggtcaaagtgggatgacagttggtcactatagcattcaataattatccactatggttatttttattcttacagcttttattgaaagtttctttttaaccatagtgccaaagacaaaataaacaataaatattaatgattttcttggcttctatttatgatattgttattttacttttaaattctttggtatcttctgccctttcatcttttctgttctgttcagtcaagacttagctgatcctatctcaacctcaaacatatcttttctatttcatctcttgactagttagaaactttcacggcagctaaaatctcccacacaaatctgagtaaagaaaccctagaggtcaaagattgtagtgtaaataaaagtattttcctttatatatgatataatttatatgtgttatataatatgaagtctcaattagaatagggaaaatgaaattcaataattattagagtattatttgcgaagtgttctgctaatatttttcctcctattaatcaaaattagttttgtattttttttccatagcaaagtagtctaacaatagagaagaatgtcttttaaaagactaaattaggtgaaatctattctttttgttaaattatcctaatgtaaaaccaggtggcctgattaaaactagccttctttgctgcctcctactgtttcaagaaaaaggtcgccttaacacttagtttctcttgctgtcttttgtttggagtatgtgtgggggtgtgttatttatgcaggcatagctcctcattatgggaactccaagagcctgattgtgactgttttttaatgccgcctgctgtgttgtccttaaactcttgcttttcctggaatgcacaactttctcccagctcctggtttagccattggtgtcatgtcttcatgctgcatccttgtgcctctgaaatcgtgttcaaaagagtgtttatgtttcaaattcatccacagtctcaccacatttaaagataattgcagaaggtaaaacactattaataggaacaaatttactagcatctcttttactatgtgtcttatgcataaagcagtttctggttgttgggttatacagtgcctattgtgatagtctattctaccttcacctcccgccccactgcctccccatttaactaaagctcctgctgatatgttcaatttacttttttttcttttttttgaaatggagtctggctctgttgcccaggctgaagtgcagtgatgcgatcttggatcactgcaacctaagcctcctggggttcaagtgattctgctgcctcagcttctggagtagctgagactacaggtgggtgccaccaggcctagctaatttttgtatttttagtagaggcagagtttcactttgtggcgaggctggtctcgaactcctcacctcaagtgatctgcccacctcgtcctcccaaagtgctgggattagagacgtgagccactgagcccagcctgatatgttcaatttgataaatgaatgtgttgaaagatataaaatgtgttaatccctaattgcatgtggctgtgatatttaatatggctgattctaatggagtttgtaacttatggggaacactatgaatgggatattataaatatttgtatgaagtaatacaagagacatttcaacagaaaaccatgtgatctatgccctccatcattattttctttctgtgtaacaaatgaccaagtaaaagtagtgaattaaaatatgagtaagtctattttcacagtattcataatttattataaacttcttttttaaaaaaataaaaaaaattaacttctattcctttaacaaagcaaagcaaaccaacattattatcagctaatgccatttgatttcggtttggtttggtcagtctcagggtggccaatcatttaagttttctgggactgttccaatttaagcactgaaagtttcacttcctgggaaaacacacactcctttgagtatttaccgttgacttccaggtgacccacttaagggcttcttccagaagggcaggcaataagactatcaagactcttcaaagcactcttccccaaagccattagatgaggtccaattttctcagcttgatatttctgagaactgctcttcctttatttccaggatttaagaaaaataaaataaactgatatatatatacatacctttagaaggattcagaaaagaagaaatggccgtttcaccccaatatgtcactatagatatgaatgccactcatagaattgacacgtcatgtttttaacttctgtgctttaggattttcctgtttgaattgtttatgtgcatgtgattttggtggaatttcttcccctttcctctgttccttgctccttcttttgctcagtcagcataggaacatagctcccacactaggaagggctggaggttagtaacatcaagcagtgggctttcaagttagtttgcaccttggtttggaagtgtttgctcaggtctcagatacacaggagactgtgtaatcactcttgtggcatctactacacacagcacgtgagttattcctaaactgagcacaggctcctgggtggtgaatcctagtctttttatctcctgcaggctaagccttggtatttccttcagattacaccaaaaccaaaataatgggcaatgttgtccctgaatgttcaaattaggttgagtacacagagccaaagactatcaaaagaaagtgtcctggccgggcatggtggctcacgcctgtaatcccagcacttcgggactttgggaggcagaggcgagccgatcacgcggtcaggagatcaagactatcctggctaacatggtgaaaccccgtctctactaaaaatacagaaacaaaatcagccaggcatggtggcgggcgcctgtagtcccagctgctccggaggctgaggcgggagaatggtgtgaacctgggaggcggagcttacagtgagcagagatcgcactactgcactccagcctgactctgtctcaaaaaaaaaaaaaaagaaagaaagagagaaagaaagaaagaaagaaagagaaagaaagaaagaaagaaagaaagaaagaaagaaagaaagaaagaaagaaagaaagaaagtgtcctaaaagaagtggtggtacctgtggggcgtgtttggtgtcagagtgtttctgctaaggttattttaattagcctcctcccaaagccctccccctattctccttgaggaactgtttgaccgtcacatccttagaaaggccaaaccactactaactctcctgaccctctgccttatcctcatacccttaaagatgtgacttaaaagagaaaaaattatgttgttaatttcatcaactagggcaaaggggaaaaatgttcatttcgatgcaggaagttaatgggagatgggaggaagctacggttacaattcccataatacattaatgtatatttaatataccaccttgatttgtggcctcaagttaaataactacatatgtttgcagcataattcttttcataattgtgtagcctcaatgggataacatttgtattagtttccataatcgaaaatgtcaaatgcctgtttccaccttccaagtattttggttttaggtagcaaagacaattctttcaatgcgtatctgttctcattaagttctgattgctttataaagaaataaagtcttttcccattgttctgctctgtggaagtcaccttcagagtaagggtgggggtgactgtccttgccaatttttaagtaactgccttgcaagggtgattccctacagagttattttctgcatagtttccctctgggtacagaatgtgggaaagtagatgcaacgcattttagagtagtcatttgctctaataattagcattatagtacagtgtatgggctggcttcctgttgaggtctagatttctacatataatgtaggtttttctattctgtcctatattaatttcattggagttactctttatcagagcaaacatccgtaacatttagtctttttttttttttttttggagacagagtcttgctctgtcgcccaggctggagtacagtggcgtgatcttggctcactgcaacctcttcctccaaggttcaagtgattctcctgcctcagcctcccaagtagctgggattaccggtgtgtgccaccacacctggctaatttttgtatttttagtagacatggggtttcaccatgttgagcagagcaataactctgtagggaatcacccttgcaagccagttacttaaaaattggcaaggacagtcacccccactattactctgaaggtgacttccacagagcagaacaatgggaaaagactttatttctttataaagcaatcagaacttaatgagaacagatacgcattgaaagaattgtctttgctacctaaaacgaaaatacttggaaggtggaaacaggcatttgacattttcgattatggaaactaatacaaatgttatcccattgaggctacacaattatgaaaagaattatgctgcaaacatatgtagttatttaacttgaggccacaaatcaaggtggtatattaaatatacattaatgtattacgggaattgtaaccgtagcttcctcccaactcccattaacttcctgcatcaaaatgaacatttttcccctttgccctagttgatgaaattaacaacataattttttctcttttaagtcacatctttaaggatatgaggataaggcagagggtcaggagagttagtagtggtcttgaactcctgacctcaggtggtccgcctaccttggcctcccaaagtgctaggattacaggcgtgagccactgtgcccagccatttgtaatatttacagagcattgctctttttcttatcatggaaagttattccaatatctattcattctatacacatttattaagcatctactatgtgccaatgttaaagaggtgaaagtgtaaccttggccctcagactgactttttgcaggttatgctgaaagatgaatgctcagtaatagctcgtgccttaagacgtggccgagcaagctttggaggtaaaatagctcatggagtttttatttatttatttattctttaaaaatggtcacaaagatttcagataaacaatctgagtatggctaaattatttttcttaggtaaacataggaggcaagaaattaaaagggtgggagaaacattaattaggctatgctcttatcaagtagtgtgaccttagcgaatttacctaatctttttgaacctcagtgtcctcatttataaaatggaggcataactttttatgaagattaagataatgtgtgaacaatctgtgcagtagtagttgctcaataaatggtagtgattttcacatgtatttggactattgtagaatatagaaaagaatatcatgcaaactctagtcctttaaatatgagtgaggaagaggaatcacctgtgtgtatgtgattaaagctgttagctatgatgaaggcagggtgatttttctctgaagggtaattcgagtacagagatattactttgaagaagtaatatgttaaatgaaatcattggggctgaaagtggtaacaacattctgggaaaggagccgtttactctcttcacctctaagataaaccataatgcatgcatgtatttaataaactgtgatagctagagctgtttcactggggcatcagtaagctatcctcaacccccttttcttttcttccagcttttcacttccaaccccctaagttttatcagaattagttaatactgagtccagctgaatacattgcttgttataaatagaatgctttctcccttcctctgcccctgaccaaacaattgattacaaagtttatctgctgagtgcggtggctcatgcctgtaattccagcactttgggaggccgaggtgggtggatcacttgaggtcaggagtttgagactagcctggccaacatggtgacaccccgtctctataaaaaatataaaaattagcccagtgtgttggtgcatgcctgtaatcacagctacttgagaggttgaggcaggagaatcacttgaacccaggaggcagaggttgcagtgagctgaaatcacgccacggcactccagtctgggtgacgggctaaatagaatgaaaaaggaatgacccatacctgaaatgtttaacataataaaatgactgatatcgattgatgacgttgagagcaatgaccagatataagggaacaatgtgtttttacttggattgtagatatcaagaatacaggagaatggaatgggagggctaacaactctagacaacatggctgcaatctatgactttgcattcttgctataatttactttcagtgcttttacaaatgtaagactctcgaggccagcagtgtatcttttacgctattcattctacttttataattattattattattattattattattattattattatttgcaacctctgcctccaggtttccaacaattcttctgcctcagcctcccgagtagctgggattacaggcgcgggccaccatgcccagctaattttttattttattttattttatttatttattttttattatactttaagttctagggtacatgtgcacaacgtgcaggattgttacatatgtatacctgtgccatgttggtgtgctgcacccattaactcgtcatttacattaggtatatctcctaatgctatccctcccctctccccccaccccaccacaggccccagtgtaagaaatacaataaacaaagtatcttttattttggctacgtagttatgttgagggtcattcatcgtcctccagtttagcctatttggaacggtactggttaatctcaataaacaaataacattgtcagtttaattgttcaattattggagggaaataaatatatattaacctaaatgttaaattctgcaggaaaaaaactgattagacatagacaatatcaacatgggtttgttaaataacttgccttccaacaggacccaaccagaaattggaacctatgtttcatagaaacatgattcttagaaatgatctttacacaattgtaaaacaaagggaagattatgtgacgcagatgccaagaaatcagacctaggcaccatgtacaagtatacaagcaatgccgagttcatcagtcccatggctgctgctaaattgggctttatccccagcaaattaacacagttccagcaggcacgataagtttactctgaccagattactgggttgaatggcatatgccgttattttagaaagatgcagaataacatttccatttagagtcctggcagaacaaagcttggatttgggcaatagataaaaacacatagagagtatttgcagatgcatgtgatagatagaaatggtgagtgaccatttagaaatttagaattggaatttttttttttttttttgagtctcgttctgtcacccaggctggagtagtgcaatggtgtgatcttggctcactgcaacctccacctcctgggttcaagcaattctcctcccccagcctcctgagtagctggaattataggcgcccacaaccgcacctggctaattttgtatttttagtagagacagggtttcgccatgttggccaggctggtctcaaactcctgacctcaggtgatccacctgcctcggcctcccaaagtgctgggattataggcgtgagccactgcacccgacaaaaattgtctcttttttgatatttcctagagcagtgtggctcatttagattgaaatatctgtcagaagctatataccagttccattgatttcaacattaaaatgtctccacatattcttccgcatccttcttccagctcatagctgtaattagtgttatgctccatggagtggcagaagaccagctgaacaaacagccatgtacgtaggaacagttccaggcagctaaaagagcttcttcctcacttgccactatcttaaatggtatctggtgtctacagttgctccttctactttcttaagaaaaaaaaaaaaaaaatccaaatggaaaagaggactctgaagacaaattagtcctttacaattataattttatttgatttcaaagcagtacttggtatagcaccagtccaaacagattggaagaatgatattttcattccagctcctgcatagaatatctttgtgcttttcaattgctttagggagcttgcaacaatagaatcctgttaaatctaacaccattttgaactcttccttgccgatattgtgataagaaatttatacctggcccaggtttatctctgttgataatgggcttcatggctatagggacatgttgatatggtgagctagcacctatcattttgacacctactctttagtagacatagagaataatgggtgcttggggtaaagtgctggagaagagtgtcagcagtcagtgtgtatgaacctagtgatggatgtctctgtgtttgtgctgtggccatatctgtatggctatcattctttcttcctcttctcatttcttttaattttccttcaacagtctttcatttgttgcttcaattcactccatttctccccagttcttcttttttctgtcttctataattctagataaaattatgacatgacttaaaatatcctccttttttgtccgtgattgctttcaatggttctaatgaccccattggaagtctggtgattaggccctgaggggccacagtaatggaaaccttgtgttcagccttcataagggtgatccaaaaatgttattacattacttacacctctttctgtaagtattttttcttcattcacttcgaagtatgggatgcttcccatgtgcaggagaattagctcattcataactcaaaggcaagtaatttcatgttttgctatttataagagaggagtctatcatgcaaggatgcaaaggagtatgaaatcagtcacaaatgtaggaaataaaaggcaataagcttccattaaaccaaacaaaagaaaaattaataattaggcagtctctttgcaagtacataataataatactctatttttcaatgaatcaattaggtaaaaatgaaacaaaataaatgcaaagagagccctcaaaaatatatcacttttacatatgtaatataagttgaacatctcattagaataatgtgacttttttaaaatttatttttgcttcctagagttcataaatcttcaggtggtaagtaggggttctttagctattcataatgcaacttgcttaggttaattagtagagaccctttcccttcacagctgaatatgagtgcccctacttactattcaaaaatccccaaaaccagcactcttctatatattggtgcttggaagagattgtatttttcattgacctgcaatattaggtattttattataaataaagtctcaaacaggctttattttatttgtcagattctcttttggtttcgtctcataaaatattagctgaatagttattatataaaaaggaaatgatcagaatatcacatttcgggtggtggtgtttagtttgtgggttccttcatgtgacaggttgaactgggtggtagagaattctgagttctgtacaacagagtgattgatttctcggtttgcatttcttggcatctggcagtgacaccactgcagaccgagagcagaaaatggacagtagggaaaaatgcaacatttctacttggtccagctgcctttgaaggatgctgatgtttcattttttatttcttaccccaaacatatttatttgctgagtcattaaatagggcaagtgttatttctttctttgtatttgccatctcaccacagaagagttttattggccgggcgcggtggctcacgcctgtaatcccagcactttgggaggccgaggcgggtggatcatgaggtcaggagatcgagaccatcctggctaacaaggtgaaaccccgtctctactaaaaatataaaaaattagccgggcgcggtggcgggcgcctgtagtcccagctactcgggaggctgaggcaggagaatggcatgaacccgggaagcggagcttgcagtgagccgagattgcgccactgcagtccgcagtccggcctgggcgacagagcgagactctgtctcaaaaaaaaaaaaaaaaaaagaaaaaaaagaagagttttattaaaccatctcgaatcgatattgttttggcacaaattgcactaataacttgaatatatagttttgtttttttaaaggtgccttcaaaatctgatacgtataatgtatgttaaaattgatatttctgtgaaagaggttaagatcagaccgctttctgattgcagagataaaattgatagttaacaagtatttattaaacatctattatgtgactagtactatgctagggcatgatgaaaatgattcaagatgaaccatgcaagcacccctctcttcagcacctctgtgtgtaaaacataaacagaatgctatgattaacactgaaagggttcagtccgggatacttgggataaaaatcggagcactgataagttacttgtcatgtacttacttttttaaaaatttaaaattttttaattatgggtacataataagtatatatgtatggtatacatgtgatattgtgatacaggcatataatgtgaaatatcacatcaagataattggagtattcattacctcaagcatttactgtttctttgtgttaggaacattccaattccacttttttaatttttaaaaatatgcaatacataattgttgactatagtcaccctgttgtgctatcaaatgctagattttattcattctatcaatgtttttgcacccgctaactgtctctacctttcccttctctccccaatacccttcccagcttctggtaactgtcattctactctctatcttcatgagttcaattgttttaattcttagctcccatataaaagtgagaacattccatgcacttctaatttagactcttctcctctttctctgtcttctttttttccatagctcactaattttgggcatctcttctcatttacagtagcttgctgctcttcattcattaattattacaatatataattctaccaagaagcccaaagaactatagtgtttttatgtcattattctcagttcagaaagaaagcatgtgtgtggcacagggaaggcatttgaatgaatgtatgcattttctggatagcattctcgaacagagatttgatgagagtcacatggataattttaacttttctagtagcaatattaaaaacacagaaatagcttctcaataactgaatcagtaatccatttttaaaatctttttcaattcattaaaattaaatagaattaaaaactcagtcccttagtcttttttttttttttttttttggagatggagtcttgctctgtcacccaggctggagtgcagtggcgcattcttggctcactgcaagctctgcctcctgggttcatgcctttctcctgcctcagcctcccaagtagctgggactacaggcgtccaccaccacgcctagcttattttttgtatttttagtagagacagggttttactgtgttagccaggatggtctcgatctcctgacctcgtgatccaccagcctcagcctccaaaagtgctgggattacaggcgtgagccaccacgccctgcccccttagtctgactgaccaaatttcatgtgtttacggattgacaaccatgtgggtagtgcaggttttggatgcatggcaggctgaagcttatgtagcacatatttgaccttcacattttattaagtctaattttttaaagttttgtctgttcatttacatgtggaaggatgatagaaatataggaagagacatgacagaaagcttgcctaggactcagatcaaggattcagatttcccaattccggcttcagggccctgttctgtaacatcacatcagggaaaggaaaatgagagaaaagaagaaagaataagaactaatgttaattcatgtcagacacagtgccaaagatctttatttgcattattgttattattttttaaaaaataaatagactagcacgtagcctagcttacacacttctcattgtatagatgaggaaactgggaatcagttaaactttataaccacaccaagatcattgagctagtaagtggcaggcttgggatttaagaaagcttgtaatgatgttacatttgatggtttaaactgtgctgtgggaagggaatccaagaagataatcccatgtttctgcttcttgtgatgtttgcaaatctgtgttctggagtaagtctttgagttgactcttggagcttctgaaacgtctattggatatactataaccaaagataaataaataaataaaaagatcagggttcctgaacgttttcatctttacattgattgcaatgattacaagtgatcatttcatcacttggagcattattacctctatggggctttacatgatactgactttgtcaataaaaggacatattaggagcaggatttctgtttgggccagaacaaggggacataccctatttttaaaattccccagtttaggaattgaagtgactgcatactaaagttggccaaatttcatgtggctatggaatgagaatatatgaaaagttggttgtaaaaacaattaagaggattggggcagactattttatggatcccttcctccttagcttctgaaatgaactaacattgattctacaaccacttattaaatacctactttttgccatggctgatgctaagtgttgaggctagaaatgcatatgaattatattttaataagcacagaataaagaaaacttgtcttcctaatttttactttaaaagacttttatctcattgtttaagtgccataattgtacaaagcatgctgttctgagttcagtgtttcttggctcattctcagtcaatactctgcatagcatctttgaattccttactcatcaaagggtaatgagttaatttgtgtactctacctctgccaccttttgagctgtgttgttgaccattccctatacatttgcatctctgtctgccagaagatgtaccaggaaaataaaagcagcagaaaatcttataacttcccacctagacatcagtcaccatcagagtttggtctggaaacagaaaagtttatttaaaacaaaattggtactctgtgaatatttcaaccatttgttccatttaatccccattagtgaatttgcttagattaatttttttgtggattccatttccaagaatgaaagcaaaataattacatcaaaaggccactgaaatcagccaaattctctggcaggaaacttattctattcagtcacattcaaactatcaggtatgaaaaatacctttcaccactggataatacaacaatggagttggaaaatcaatcgtgtggtaaataagcaaaaactacgtgcaaacagaggaaagaagagttgttctgaaaatggtatttcaataaaagttatagtgatgacgagcagtgtgatgatgtaggaagttccaaaactaggtagagggtataatcaaaggtgggtacaatggaacaagcctggaggcaaggacgggccagtcaggaacaggtgggcttatagtgaaagaaagtggaggctttagaagtagagtatttgatgaattcttccgtccattctattttggcttctatgtcaaggaggatgacagatattcattgtgtagttttataggaaaggcgattggtagtgacttcaatgttataaagaacttggccaagtccataaaatgtccatggtgtataacaaatcttttatggtgagtgatccatggaattaggtacttagaaaagtcgattgaaacatattcacagaaaggcaaaggtttgatgacctggtgcatggaatgagacagagacactgagaaattttgattgtacaagtttttcctaatatcccacttacatcctgtagcggtgtgggcccatttattcttttttatgtttggtttccctgtctcatggtaaaatcatggacagatgttacccctcaattttctctttttcaattatttctgatccttctcactttaatcagtttacttgatagtctctgcgctagtgtaatttctccagccttttgaaaaatgtagacgcttgagccagacaaaagcacttcagcaggaacatgactaatcttgaagacatagagcagggctgataatgtacgccaggaactgtcagttaagaaatagtgatactgcattgctgactcacagtcagctcatgggtcactatgctgcccccattctgttgagatttcagtacactttccgtatatggagtttctgtgttggtacacatccagaaggtttcttgggcgcattgaccttcacatattgtttggttaatttacctaacttggtattaatcagacagaaaagacaaacatgaagtaaggaaagtcggcctttgctgttctcccttgaacttggcttcacttctatccccaccatttagtaaggaagaacagccccaatttattgagttgctatgagccagacactgtgtaagcactttctacacattattgcatttaattctccaaagaatgagataactattataatctctgttttatagaacaaccagctaaagtttatcgggttttttttgtttctgtttttttgggtttttttttgttttttttttttgagatggagttttgctcttattgcccaggctggagtgaaatggcgccatcttggctcactgcaacctctgcctccggggttcaaacgattctcctgcctcagcctcccgagtagctgggattacaggcatgcgctaccatgcctggctaattttgtttttttagtagagacagggtttctccatgtcggtcaggctggtctcgaactcctgacctcaggtgatctgcctgcctcagcctcccaaagtgctgggattacaggcatgagccaccgtgcctggccaagtttatgttaaataactcgtccagaaggtgtagtgggatgtttgactccaaaatacatgcttttaccgcctcaactgactgagcttgggactacctctaactttcattagaaacacaaatctttttctaataaactttcttcttcttttcaataaaaacatttcccacaaggtgacttaaattcattcacaattaggtataaatactgataagagcagttaacttgttttaagagtctaatatgtgctaagccttatgccagatgctttacaagcattatcttaaaccttgtaacaattttgcaaaaatgttactctattttatagaaccaaaacccaagactatgaaaacctaaatatcatcctcagagtcatacagcgaagcagaaattgtatcagctaatgagacttagtgccatttctctcatattgtgtgagaaaaatggcaatgctcaataaatgttgttctaactgttccaggtatcaagcagtagaaaaagaatatggcagatcaggtggattttgctgtcagccctggaaacactcagctggtggctacataatccatcatctcctgaagctttcattgtccacattttttttctaccctttagtcatgtgtttgtaaggaataaattactaaaatacaccataccttttaaaatatagaataaaagctcacagagagttagggtgacagaacatatgattcaaccttctgccttctggcagacagtaggctatttcttttaggtgggtatctaggaatagatacttgcatataatattttttttttgaatcccagactggtcctactaacattcttgattaccacttatttaagtgaccatcaaaccagttttatatctgatatgtttaatccaaataaatgtctttttttaaaaaactgtttaaaaaatggtatttaaatccttcccagattttagctgtgtatagtctggaaggaaacccattcacatggttttatcaggtttgatatttaatagatcaaattagtaaaacagggccctcacttcacaggcacggtgaattctttgttgataagatctatcaatgatcagtatggatcattggatggcagtgaacgtatacgtttgtggggaaaattcttatgcaccttcatagtaatggtactgcccattttatttgaggataattaaaacacaaaatacccaacgatgctgtttttattgtaggtatatgttaattcctctagagatagacaagactctaaattcatggaactttaagtgggatgttccacaaaggaaactctttaaaataatatagaaaaataaataagtaaatgtcaaccaaaatggcagaacatttaaaatcagtctgccaaatatcttttctcactttacttcatttgttgaacaatttatatgctgatatagatggccattttaacagtgtatacaaagcatttatatccacacatgtacatttaatcaaacctacatgtctacatacacatacttaagacacacatagagagtgtgtgagagagaatcaactcatcataattgtaaaggtgaagaaaattgattccttaagactaaaacacaccatattaaacttggagtttatattttgaaaataagattcaggaagtcttctaaagcattcgaagattgattagaaagataaatttcggcacacagggtctctgttcttgtaactttccctgtggtagcttatccctctgtataatacattttgtcatcattctttctttcctccctgatacaataaaaataatttccaaggttagattctatcttgcaagagcttttccccaaggaggtgcatgcatcttcttaatttattatattatataataattcctcataggaaaactaaaggcaaattaaaaccacatggagataatgcctgactgtgctttagactgttgtctaccactggctctttagaaaaagatcagagatacccctctcttgattgtccattttcttgatcatgcaatgtggtattttaagttctatgctggctttgatgcttttgttagtcaaggtgcatgtgtgaatgtgtgaattggatatgtgaatgattttaatattagcttaaataaaacattactgggaagacaaattttctgaaattcccattttcctcttccacttcccctacccccaaagaaacttgacatattcgtttcaaagcatacactgcttttttactatttttatttttatcgtgcatatcacaaccccttcattagtagacatcattgagcattaactgtgacttaattctagaaaaaaatatttttgagatacccattaagatatcacccctgacaaatataaaaagagaccttgagtttacttcattttaaataaatagactgtcttcatttcctaactctgtgaatctgacgcttcttatcaacaccccaaattactgtcaacaaattcaaaaccatctactgatgaatgagatgtttaggtccaattctgatatgccatgctcattctcatacagagaaatacctacactcttttaaatatagttgttattgctgtgacttgcacctactaaacaaatgtaaaaattcttacagttcaagaaataccagtgaagtgtatattattgccctcattacacaaaatgctcatggaaaacactctatcaattccaattatgttctggggggaaaaaaaaggaaactgaataaaaagcaatcccagaatatttgactgggctggttggttatagctgctgaacaatatgtaattgtaagaagtgtggcaaaatgataaaaataaactcagtatttgttaaagaaatgaaaacgtggcaataaaagattccggaaagcgatttagttttttgcattacttcttcattacttgattattttactgtttcatttctatttacctaccaagttgattcttttgcatctggattttgcacaattctttcaataatatacggttcagtggctataattacaggattgttaaagttcacattttactattcatcttgttatctctggtaatggaaggttggaataaatgcacataattacatggttggtcttaaattatttttatattgctcttgccaggatatactcgaaaagcagtatttattctctaatatttatttttggtggtagtggttttagcaaaataaaagtaataaatacataaatggactggtcccacgagcttactatctatggtttttttcaaattaattctaacccattcatctctctgagcctgctaggggcaggaggtgcttagagtctatggaagaaaaacgtcatgtttcagagctctggtaacaggaaaatgtccctcatgaggtactcatcatttgatctattattttatctatttgtagcagagtaactcagtaacctacagatctgtggaccaacttactaaataaggtgtcaaataagtttgatttcattctaaagcaatgccatgtcatgaaagtaaagtgaatttttttgtttgtattatactggaaatagtctcattgtactatatggcactcaaaacattttataaaaatcttagcactatcaactaaaaattaactcataagctcccgtaattaactgaacagatgactccctgttggccaaagggaccccagaaaagactgaagaactgagttcgtggccattgatggaagcgaggtcagaaacgcctcattacatgccctttatgttagagtttaggcacaactgaccagcattaacattaaaatagagatcataagattaactaaagggactcattgtgacactaaaataccacattctaaataagacctaaggccatgcaaagcaagggttaaggcatgctctgcaaaccgtaaaatctttttttaaaaaattaatcctgcataatgtggcttactttccaatctgactctggtataccctcacatggcagatagcagaccccttatcttgacttaagcatccctttgtattgacctcaagtctttagacaaagcttaactctttcaatcaattgccaactaaagtatctctaaaactcacccatgacttgtaagcccatgcttcaagatgtcccaccttttcaggccaaaccaatgtatacttttcatgtactgatttataattttacctacaattcctatctccccaaaatgtataaaaccaagctgtaacctgattactttggtaccaattatgcaagacttcttgggtttgcgttttcttgggctgcaccattcatattggctcagaataaacctctttaaaacattttacagaggctgatttttccatgaacagcagcatccaaaaaatccacaggatacatgtatcaagtatttattaagtacctacgatatgccaggcattgggctatatatgaaaaacagtgttatcagacatccacctagtgctcctgattaaaaaatggatgtgagctcattttacctttacggaggtccagagatttaaattacttgactagtccctcagcgagtcaggagaagaggggttaaaacctgattcctccagttatatagtcatttaatgttcttggacttaccagtacttttgagtttttgtgttttttttttttttttccttaaacacaaaactacacccccgcctccagctcccaccccctcccacacatatacccttttttcatagaacaaaatttggaataaatggactttaaatgaatgcattgttttgactctgcagggaaatgacatagagaaaataaggaatggatcgtacatgctcatgcactgtctggggcactcctgctgaagtctcaggagtgtctttggtttgttgtctgagacctgagagttaaaaagcagagtgccttttggaggaacacgtgtctctttccgcagcgggacgtgcacttgatacacatcagtgggcatgccatcagtgcctcgcagctcatctttctctttagggtggctgtgttgttcttccgatgactggcttgccctggagaaaaatactgcttaaatattaagattagattagttttcacacagccccattttaaccactaaatttaaatccctcagcaatctacttcccaaccttccctaggcataatattcagtttaataaatggtttgtatgccattatttctcatcaatatataaaaactaaaaggaattttaaaaatccatacatcttggttgagatgaaatttgacttgatgagaagagattattcttagaaatgtttctaattcccaatcaaggcattctatttcaaaatgtaggagcatggttgaaagaataaatctttagaaaataatgtatgagcatggttgaaagaagaaatctttagaaagtaatgtatataataatatacatatatgtatatatacttatatataagtgtatatgtaagtaatatatatctctcacaaatattgttttagtcatcatcatcatcatatacacgtgaatatatgtacatatatgtattatatatggtatatggtatatatgtgtatatatgcaagatatatatgagtatatatacatgtgggtgtgtgtgtgtgtgtatgtatatatatatatatatatatatatatatatatatatatatatatatatatacacatacatatgactccaaaaacaattcctctacaaattgtgtgtcacttccttgacccattacctccccaatgtatatatcatgtgaatatcaaacaattgaatgttttgttggtacaattggattcattcacacggaaacgtggagtctatttcttccttcaaatcctcatcctccaattaattagctgaaaaactgactgcatctctgattctctaagaagcatggaagagaaagaaatgggaaaccagctagcagctcattacatgaattcaaacagttccctttgaagggaaactttttcctggcatagatgatgtcattgatgagattgcaagggtaggcattgtataaagatgagatcctttttaattctgttttcaaaactataaagctaaaatttttagaattgaaatttcagttaacatgacccatgtattagataaaatgtctctttaaagcctgggagctctccaaggtgtggtgtgtttcctatttgctaggtacatgattacgatgcatatggatagatgtttctgaagtgtttccttctaagtgcactattgccagtcagatttacacccaagtagcaaagatgttaatgccatgcaatcctattaatctaacatgttgcttttgtggattagaactactcagactctaccttttagttgtagttattttaaatctttaatactgagctatcaaattttcttttatgatacaaagctactaagtagaagatacttgaatattccattggctgactgatgtgtttattaggcacttactctgtgcccaacacaatgataaacattctcagcaatatcgtgaaagtttaacacaggattcctggcttccagaaatatgatgtttacttaagaagagataggaacatatgtgaaaaagttaagcttcatgtagtatcttaagatgctaagtttagtattctggtggtggagtttcttatcaacaatgtttcacagaagatattgagctcagcttttcattatcaaagcaattgcatgaagaagaaatttgagaaagtacaacccctggtaatgattggagcctctgaaacttttgtaatgtcaatatccatagcatgactattttttatttccggtactgatgtggcagaagttgtggagtagtgtttttgagttatccgctgtttaggatcctgtattaaaagaagtatgtcggctgtgcatagtggctcatgcctgtaatcctagcactttgggaggccgaggcaggcagatcacctgaggtcaggagttcaagaccagcctggccaacatagcgaaactctgtctctactaaaaatacaaaaaaattagtcaagcatggtgtcgtgcacctgtaatcccagctactcaggaggctgaggcaggagaatcacttgaacccaggaggcagaggttgcagtgagccaagatagtgccaccgcactccagcctgggcaacagagctagactctgtctcaaaaaaagaaatatgtctcagtagtgcagttatccttctgtaggtttgtattggtgttcagcaagtatctggtaaattaatgaattaacaagagaatagtttctatgaagcagaaatgcatagcaaagaagtggggtgttgaaaggaacagctgggatatcagttatacaggttgaaatgtggcattggtacaatgacatattagttatactcttacaagttgtccttgagtgggtgcttgatagaagttggcttgcaaaccaaaaaaggttaaacacttgtcatggcctcaggctaatgaccccttctaatatgcaattctgtttttctcattctgagagcaaaccagatgccccatgatgtgcccactgttcttttgctaatgtgttcatcctcagtgccttcattaccagtttctttcatttgacatgcaaagatcttttttcttggctcatcccagagaagtggccgggcaagtgttctcctgagaaaatgttgatgactctggcacacagaccacatacaatttgctgcttcctcacattcacactgaagttggctaaggtgcccagagagaaaccctgagccctgactgcatccaaaaccagtcattagggatgaccaccgtgggatccctcctactgggtgcctggttaaaactgagtgtcagagaagagactggtggctttgtcattgactttcttgttcagatgtaagagcatcatcactgggagaaggaaatgtgaattgtgaaaataaataatgcagatagaagagtcggaagtacagaggagtgttcctagagtgctttatatggagctctattatggtgcataccatggtgtgttgttaagttagtttacgtgtcagtttcccctttacactgtgaaatttagcaaagcagagactatgtctgattcatctttattccaagtacctcacaaaggtaatgctagcgttgaccttaataagcatttaatcatgtttattcatttattttttgaatgaatggataatgattaaaattgaggtttttatctcttgattatggagcttaactcattgtgagcccattgacatcctgaaatacttgctgaatgagagaataaatgaacagatttaaaaaaaaaaaaaaaccctgaagagctaagcttaagccactatttaggctttgaagttgatccatgtggtcttttgttttggattgattgtagggactaaagaagtacttcatacgttgtgttatctttctgctcaggtcactgtggacgatagatagcctttacttctccgctttctcaattttcagccactggtattcaactgcaggccttctttaaaaatgtacctctttctttcaaaattttctgaaaagctagaatttttttgttttttgttttttccaggaaaaaattttaacttactggagaccaatttcttttcttaaacctgtctctgagctgagtatactgtatagtccctataatgattttggtaaatccttaagcataaggtggtcattgtgtgtgacggtgttttctgtttagtgaagacaaatggtgggatgagtctcctgctaggatgtgcagaaatgtgagcattagtctcaaggtacattccgtaaagtgttggtgccaggtgagtattgaggttgatagcttctgtgaggcctggtttcctggggttgtgcccatgttcatatgacagctgcttccacaataacatagcaggtgcgtagctcaggatttgcccactttctgcaagtggacactctcgcttgtatctaaaaggcctctcccatggtgccagaatgcctctgacagcattttcagagctgtgacggcaggactgtagctttatggtgggagcttctatctttgtaaatgccactgatgtcagctctcaccattaaccattttcttttgtcaaatgggagagattcaggactcatggaagtgagagactggcatgatgaggcaaacagggggcagtttaactggctgtttggccactttcccccactctaattctccttctcctttccataaaacatgctttccaatttctgccaataaaagcctttttaaaaaagtactagtctttcatttttttttttgcataccttgttgttattccttctgaaccagtagtaacacaatatacgaagtacattctcttgggtataaggccagtgtataggtgggaatcccatagacctaaaaagaaaaacaatctaggatttctggatgtgctctgaagtggcaccttctaagctgcagtatttgttcaacagtgtttttccaacaaaaaataggatgagttcacctgtgaagcatcctgaagggaaacaccggtgcactgggcagggaacaggagacctagatatacttcttcttttttttttttttttttggtagatatatttatttatttatttatttttattttattattattatactttaagttttagggtacatgtgcacagtgtgcaggttagttacatatgtatacatgtgccatgctggtgtgctgcacccattaactcgtcatttagcattagttatatctcctaatgctatccctcccccttccccccaccccacaacagttcccagagtgtgatgttccccttcctgtgtccatgtgttctcattgttcagttcccacctatgagtgagaacatgcggtgttcggttttctgtccttgcgatagtttactgaggatgatgatttccaatttcatccatgtccctacaaaggacatgaactcatccttttttatggccgcatagtattccatggtgtatatgtgccacattttcttaatccagtctatcattgttggacatttgggttggttccaagtctttggtattgtgaatagtgccgcaataaacatacgtgtgcatgtgtctttatagcagtatgatttataatcctttgggtatatacccagtaatgggatggctgggtcaaatggtaacaacaggtgctggagaggatgtggagaaataggaacacttttacactgttggtgggactgtaaactagttcaaccattgtggaagtcagtgtggcgattcctcagggatctagaactagacctagatatacttctaacataatctgtgactgtgtgcaggtcatgctaagtatgtcagactgccattttctccttgaggctggaagtgtggggagaaggggataatgtagttgagaatccattactggccccaccttggacagagagacaggcaggtaaagggtacacatgtgcctggatggtgctgctactggactcttgtttacattaatgtgtcaacagtgtgctccaaggttctattaggtgttaacaggtgtctcaagaaaaaaatgtttcttaatgagatcagtttgtaagaattctgggtgaacacgttaattagtttattcttttaatgcgttgaatgttttttttttttttgaaaaataatagaatcccttcagaattcttaatatgatatggtgttctgtatattttcaagaggagaggtatatagtgtttctcaaatttatttgcacatgaaatgcctgtgggacataatatctctgaaggccgatgttccttgaaagactgtgtgaaatattgaactatatgatctctgaaagttcttgaattctccattatcatcagaatacctggcccttccaagcccttgaccttcgtctgtggagtattgactctagctgccttccagacattgtcatctatgcttcttttcctctgaggacgatgaaccccggctgttctctcagtacccctgaaaaatgggaaattgtatttttttcttctttgtacccaggagtctatgtataatgcataattctcagtcaaaaggaacttgcttacttaagtgctcaaaggtttttgtcctgtggtttttgtaaggtaatcccacaacatccagataaacaaataatcacaagacataaccttccagagtgttccataacattgatcacaatcaaataatgaggcacgattccatgaaacattaggaaaattataaaggcatcaggcagaaaaccagcaactagcaaatggtttctccatgatgattttgggttcacatttcacttccatatataatacaacttatgtgcccatatttcatcctctggaagcctgccacattatcctctgaatgaatattaacactccttgtactctgaagtagcctctggtattctggtatttattcaacaggttttgaacaagattagtggattataattttggcttcaccacattttaaactgtgtgccttctctgtgcctcagttttctcctctgcaaaatggaacaatagaatccttttcattgagttattctgaggattaaatgagtgaatataggtaaagcacgtaggacatccctggcatatagcagtcaatcccttgtaaaatgttagctgcagtgggtgcaactgactgcggccagttgtcaccacctgtgacatttaccaagacaattttgggtaaaaaaggcagatttattggagaaagtacaaagataccttgcaagaaagcaatgcgcaggacaatgggctgtctaccaagaggcaggagctagagggaagttttatagggtcatactggaggggctatgtccagataagttgtgcagataaggtcctgctgctagggctatgtccagaaactaggtatttgggaacatgatgttctgtcagtcggttgtctgtgataagccatctcctctctcagaacaattgttctccccaatctggggccccttcttcattcttgcttatcttattaggactccacattaactattgttgttattatcatacacagactatctctgaaaggatatataagatatagataccagccataacctctgcaaaaagatacaaagagactagggagccggaaagcaaagatagaggagtaggcttacttttccctacatatgaatttactctattgaatattttaaaatcacctgtgttttaccatcaaaaaaataaaataaaacaagcatcaatatttacaaatgaagaactgaggttccaactttacgattgactttcctaattcaattggctatttgacttccctaatagttaagttagatttgagccagggatttgaactacaaaaaccgtgttttttctagtctaccaccttatatagagagatatgacagaggggagagatgagaggtgtgtgggtgggtgggtgagggtggaggaggtggtactggatattactgaaaaacttttgatgatattgaattctttccctgagttctgtagattttggcactggtctcttgtttcttctatttctactgtgagtaaacaaccattcccaatcctccagttctaacttgaatttcagtggactaggctgagtggatgtacaagggcaaacctgcatggggtgtagggaaatataaatagattggcactgtggaagtcagcatatgtttgcttggcacccaaccctcctatgcctttcatttgctgaatattaagcatctcatttttatctgtcctctttttgatggaatggacatgcaaatttttcaaacctacacaccctcttctttctcttggacaaagggagtaattttactatgaatccatcatgtgtcccaaggaggcaaactcaaaatttgtctgcaaaaagcctttcattcatttcttttcatgtaagaaacaaaattggcaactattttttcatagcttgtaaattccaagaaacttagtatcttttcttttcacttgctctgcagccaaaagcatattgttcagcattgcgaattcacaatactcactgctcctcagtcctggctacaacataattttgaaaagtttatgcagggaccatccgagtaataaatcacagaggaggactgctttaactgttcaccccttagctactgcctgaatgagctccatgctttatcatctcagaaggaagctgtctcaaatgcatgcttcattttattatccaattgtaacccatctagataaatttaacttcctatagatttgctgcctcttagtattcatatcttctccagacttttcattaatattatgatacttggataggagtattcccctccctttcctttataatgtaacagctttaaattgacatttggtgaatgtatcatcattgctattcaaattaggtcagtgtttttatttcattatgctggaagtcctcttagctgcgaaatcaagtttgaatgtctgttacctgaagcaatgcttctggcaaatgtttcttagaggtttttgcaagccagaaattgtcaggcacctcccccactcccacttcttatttctatgtggtttggttcatataaccatttaacatatttttataaagcggtagttgaatagagtataaaataggaaaaaattaatcatctgccctttaagaggtttctgtccactgtgtgggtgttggagagggaggtgggggaagagaggggaagggaggcagatatgcaaacaaaaatcatactatgccatggttttggtacagtcagttaatgtctaggatataatggaaacgtgggaaaaggagcctcttgacgtttactaagacttgagaatgagtttttttcttaataatctataaattgaaatccactctttctaaatgtgcctttggcactgttcttttgaattaggaaatacagaaaaacagttaaatttggttgaacgatacaggaagtactcagaaaaggcaaccatcttaccccaggagagatcaaaagacattcacagattatgttaacccaaagttttggcctcatttctcaaggaaggggctacatcttttagaccacaggcatttttccccagttttgaaactgtgaaggtgtttaggacctgagagattattaataacaggtttcaatgcctgacactcttggacttaaatgttcacctacactcaatctgatcatggacaaactacttaatctcactgagcccatgtcctcatccataaaatgagggtaataatagttccacgttttagtattgttaggatgattaaataaaataatgcatgtaagtaaaataacccagctattggaacaatcgctgctgtataataaaccatcaataattcttagcttttgctatcattcttgctactgttaattagttagtggttctcacttttttctagaaattgctctacctctgtttctcaactgagatattatagtttaagactttgattatgataactagatgataatttagatggtgtctttttttttattatactttaagttttagggtacatgtgcacattgtgcaggttagttacatatgtatacatgtgccatgctggtgtgctgcacccactaactcgtcatctagcattaggtatatctcccaatgctatccttccccccgcccccaccccaccacagtccccagagtgtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgtagatggtgtcttgatcagcaatctatgctttgagtgttttttgttaagtggctaatgcagtttgcatatttgtcccactaaatctcaagttaaatgtaatcctcagtgttggaggtggggcctggtgggaggtgttagagtcatgggctgagcactcagacttgggcaccatccttgtgacagtgagtgagttctcacaaggtttggctgtttaaaagtgtgtggccatttacctatataacaaacctgcacatagtgtacatgtacccctgaacttaaaataaaagttggatatttttcaagtgggcttcatccctgggatgcaaggctggttaaacatacgcgaatcaataaatgtaacccagcatataaacagaaccaaagacaaaaaccacatgattatctcaatagatgcagaaaaggcgtttgacaaaattcaacagcccttcatgctaaaaactcaataaattaggtattgatgggacgtacctcaaaatcataagagctatctatggcaaacccacagccaatatcatactgaatgggcaaaaactggaagcattccctttgaaaactggcacaagacaaggatgtcctctctcaccactcctattcaacatggtgttggaaattctggccagggcaatcaggcaggagaaggaaataaagggtattcaattaggaaaagaggaagtcaaattgtccctgtttgcagatgacatgactgtatatctagaaagccccatcatctcagcccaaaatctccttacgctgagaggcaacttcagcaaagtctcaggatacaaaatcaatgtgcaaaaatcacaagcattcttatataccaataacagacaaacagagagccaaatcatgactgaaccactcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatctcatccccatcaagctaccaatgactttcttcacagagttggaaaaaactactttaaagttcatatggaaccaaaaaggagcccacattgccaagtccatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcttatctacaaccatctgatctttgacaaacctgagaaaaacaagcaatggggaaaggattccctatttaataaatggtgctgggaaaactggctagccatatgtagaaagctgacactggaccacttccttacaccttatacaaaaattaattcaagatggattaaagacttaaatgttagacctaaaaccataaaaactctagaagaaaacctaggcaataccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctatagaatgggagaaaatttttgcaatctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaagaaacatgaaaaaatgctcatcatcactggccatcagagaaatgcaaatcaaaaccacaatgagataccatctcacaccagttagaatggcgatcattaaaaagttaggaaacaacagatgctagagaggatgtggagaaataggaacacttttacactgttggtgggactgtaaactagttcaaccattgtagaagtcagtgtggcgattcctcagggatctagaactagaaataccatttgacccaaccatcccattactgggtatatacctaaaggattataaatcatgttgctataaagacacatgcacatgtatattttattgcagcactattcacaagagcaaagacttggaaccaagccaaatgtccaacaatgatagactggattaagaaaatgtggcacatatacaccatggaatactatgcagccataaaaaaggatgagttcatgtcctttgtagcgacatggatgaagctggaaaccatcattctcagcaaactctcacaaagacaaaaaccaaacaccgcatgttctcactcataggtgggaattgaacaatgagaacacttggacacaggaaggggaacatcacacactggggcctgttgtggggtggggggaggggggagggatagcattaggagatatagctaatgtaaatgacgagttaatgggtgcagcacaccaacatggcacatgtatacatatgtaacaaacctgcacgttgtgcacatgtaccctaaaacttaaagtataataaaaaaaaaagtaggatattttttaaaaagtgtgtggcgtcttcccccttattctctcttgctcctcctcttgtcatgaaatgcaccagctcccccttcaccttctgccatgagtaaaagatccctgaggcctctccaaaacctgagcagatgccagcatcatgtttattcagcctgcagaaccaactacacatctttaaaaaaaataaattacccagtctcaggtattcctttatagcaatgcaagaatggcctaacacagtggctttttttttcttttaagtatattttatatttagatgctactattagcagatgatttgtgcgtatgtcttgccctgttcagctttgaggagtccaggcccttatgggactccttctgagagtggggttcctattttccttaggaacccaagacagttctttcagaggatttcattgatctgttgccccatggtgctttgtggcacataatgacaaagcatgacaggcaggctcacagccctcgactcatgctagatctcggttcattctgtatccagggactccagttcatcatatcccttacccaggcctctctcctagctatgtctgtgtggctcacagatactctagagggagaggcaattaatttctttttggcggtgagatggtttgcctgggtccccactccaatcttatcttgaattgtagctcccataatgcccgaatgttgtaggagggacccagtgggaggtaattgaatcatggagatgggaattcatgttctgttgtcatgatagtaagtctcacgagatctggcggttttataaatgagagttcccttgcacatgctctcttgcctgcaaccacgtaggttatgcctttcttctccttagccttctgccatgattgtgaggcctctccagctatgtggaactgtgagtcaattaaacctctttttctttataaattacctagtctcaggtatgtctttattagcagcatgagaactgactaatgcagggggttatttcatgtcagacattgtcgtaagttgtgtcttccttggtgtcttagttttttctgtgctgctataacagaatacctgagactgggtaatttgtaaagaacagagatttatttcttatagttctagaggctgagaagtccagatcagttgggtggcatctggcaaaggctttcttgctgttttgttctatgatgaaaggtggaaaacaagagagagaacaaaaggtgtctaaatttggttttatagcagatccattccttgataaccaacaaactcccaggatgataatattaatccattcatgacggcagagcccttgtgacctagtcaccacttaatgctcccacctctcaccactgttgcattggggattaggtttccaatacatacctttatggaacacattcaaaccatagcatttggcaaataacccaaacccttctttcctcatctgataattgggaaaataatagcaactaccttgtggatactttgtgagaatcccatgcttcatgcaataaggacttaataattgtaagttgttaaattgtcatacatgctccttttagttatgaaaacctgtggcttttgtctaagagttgaatatgagaaggttcaaggactagggcttttatccttggatctctgtagcatgctgaattaatgaaaggtctgtctctctctctctgattaatcaaaaactctgactagtactagtgaaagtcaggtttgaacaattctgtgaagaatggatttggaaggaaaatatgaggcaagaattttaaaaagttgtttctgagttgaatttgatttacatttgctaactggaaaaagatcagggtataatcagtccataatattgaaagcagtttggaaataccattgcagatacaggtaatttaaaaaatctacatgaattaggtccaggagcggtggctcacgcctgtaatcccagcgctttgggaggccgaggctggtggatcacgaggtcaggagatccagaccatcctggctaacacagtgaaaccccgtctctactaagaatacaaaaaattaggcgggcgcggtggcgggcacctgtagtcccagctactcgggaggctgaggcaggagaatggcatgaacccaggaggtggaacttgcagtgagtagagatcgcgccactgcactccagcctgggcagcagagcgagactctgtctcaaaaaaaaaaaaaaaaacctacatgaattattcttcctgtgacatatttgtcattcttcatctctcctttaacattcctatcttcatccttcaggccatcctctgcctacctctttctgctgctacagtgtaagttgaatcatactttccaaaatatgtaaatgaaagtcagaagtaaggcaactcatagtgtttcagtgactttgatttcaatctcactcaagactgggagattctcctaaattctagcaaacttgtgcctctttcccagccttataagaaactgtccttctatctaaatactggaatgccactatgtgaagcttcaaatcagggtggttattctgagacaatggcagcttcttgggatgtggtgtaacatgtactaaatcattatgtgcacatacatttatttttaatcaacctgcgtttacctgagtgctgtggtttgaatgtgtcccctaaagttcatatattggagacttaatcctcaaggcaacagtgttggtgtatggggcctgataagaggtgattaggtcatgagggctctgccttcatgattgaattaatgtcattatcacaggagtgggttagttagcacgagagtggcttgttctaaaaggaagttcagccccctcttcctctcttgccctttgcctttggtcatgggatgaggcagcaaggagtcccttgccagttgtaggcccttcgaccttggacttcccaggctccagaatttcgaagaagtaaggctctgttctttgtaaattatccaggctcagatattctgttatagcagcactaatggacttagtcaccaactaaatgtaatggacaagaatggcctacattaaaaaaaaaatgtgattagaggatcttaatatcttattctgtagtgaactttagaatattttagacactggagattttctatcagatgtatcctgtggattcaataggattcattttgagaggcagctttctgaagtggaaataattctgtactccaggcacagtaattgggttcaagccccagctctgccatttactgggatggggagaaactcttggacagcctgttaggcctttttggcttccacttttcttgtctttaaaataaagttaataattttcattctgcttcactcatggcatagatgtgaggctcaaataaaaaaatattttggaaactaccctgaaaactgtagaacattctacaaatattatctaacaaaatatatgaatgcataattagtgtcttcaagggatgtcataaatatcgtaaaactaaagggtgagctgtatcaaaacttggaagggattgggatgaaaatcaaactgtctaaaatagaatggccaaatacattgggacttggctccagaaagaattaatgagaattacacagattcatatcttctccattattccattggtcacgtctaataacttgccatgaaattgcattgatttctacaaagtgattgcatatgctgttgcctcttttcaactgcacatgtcataattcatccatccagatcagtattttacttttaggaaaagagagatgctaactttttctcagaggagagtgtttagaagtctatgttctatagtccctcctagagaggggggatttcttcagtactcagcagctaatcttttttttcttctctctctttttccttttttattatactttaagttctgagatacatgtgcagaatgtgcaggtttgttatgtaggtatacatgtgccatggtggtttgctgcacccatcaacccatcatctacatgaggaatttctcctaatgctctccctcccctaacccccacactccccaacaggtcctggtgtgtgatgttcccctccctgtgtccatgttttctcattgttcaactcccacttatgagtgagaacatgtggtatttggttttctgttcttgtgttagtttgctgagaatgatgatttccagcttcatccatgtccctgcgaagtacacgaactcatccttttttatggctgcaaaatattccatggtgtatataccacattttctttatccagtctgtcatcagtaggcatttgggtttgttccaagtctttgctattgtgaacagtgctgcaataaacatacatgtgcttgtgtctttatagtaggatgatttataatcctttgggtatatacccagtaatgggactgctgggtcaaatgttatttctggttctagatccttgaagaatcgccacactgccaacaaacatatgaaaaaagctcatcatcattggtcgttagagaaatgcaaatcaaaaccacaatgagataccatctcatgccagttaggatggggatcattaaaaagtcaggaaatggccaggtgtggtggctcatgcctgtaatcccagcattttgggaggccgaggcaggcagatcatgaggtcaggagatcgagaccagcctggctaacatgatgaaaccctgtctttactaaaaatacaaaaattagctgggtgtggtggcatgcacctgtagtcccagctacttgggagtctgaggcaggagaattgcttgaacccaagaggcagaggttgcagtgagccaagatcctgccactgcactctaggctgggtgacagagtgaggctccatctcaaaaaaaaaaaaaaaaaaaaaaattcaggaaacaacaggtgctggagaggatgtggagaaataggaacgcttttatactgttggtgggagtgtaaattagtgaaaccattgtggaagtcagcaggtaatctttttacggtctgagtaatgaggaacctggctaatagttgccattctagatagcattaagggtgaagtctttgctcacagaagttggtgtatccagacagacattgtaattacagcagagcaaattaccatactctgaaagagaagaacacagaaagcaacaaacacatttaaagaagactgtcccagaaataaggagaagggcaagaaatctaagcagaatattccacttgccatttacagcatagacaaggacagcaaaatggaaagtcacttatataactgcaggataaagagatgggtgagatgaaatatactttctccgaatgaagttcactgtatgtgtagtggattaaatgagattgactatttttaaaaagcctgttacaaagaagaacaaatttaatagactattaagaggtaaagaggaacttttaaaagcacatattgattaaaacaaaagttatacactttgggaggccgaggcgggcggatcatgaggtcagaagatcgagaccatcctggctaacacggtgaaaccctggctctactaaaaatacaaaaaaattaaccgggcgtggtggcgggcgcctatagtcccagctactcgggaggctgaggcaggagaatggcgtgaacccaggaggcagagcttgcagtgagcccagattgctgccactgcactccagcctgggtgacagggcgagactgtctcaaaaaaacaaaaacaaaaacaaaagttatagttcagaatatttattgcatacaactcagcaaacaaagttgacctagatacaagagtattattggaatttgttagtgaatacattgacaaaattctgttatttttgtttaattatcactaggtccagtagggtggaagtcagaaattttgacttaaaatatcagctaattgaattagttatttcaaatcaatgtctagtttggataagaatattttataaaaaaacaaatcatagtattaggcatagtttatgcttggtggcatgtagagaaatataaaaataaaagatagtgaaatctttttaaaaattgtgttgaaaggtataatcatttgtgttaatgtattattcaaccaggatgtaggaagaacacacatgtcactgagctttgttctggggctggaaggaagtgcaaataacaatgatgataataataacagcagtagctaatatttatcagatatagagcttgttaccaccacagtaagcaatttgcatggagtatctcagttctcgtgattagtcaggtacacttcttacattggtttttcggattgagatattaaagtccttagaattgaaagaacttgctccaaatcatacagctaggaatggtagactagcgtttttactcaggcagtctcaagataacatttgttgagggtctattaacaaccaggcattgagatggtgtttacacatattagttatctcagtggttcttaacctgggatgcatgttaaacttaccaaggaagcattttaaaaccctgatgcttaggacctacaccaggtgaattaaatcagaaccttttgagacaggggcaggacttggcatcagtatttcttaaatataaacattgtatatgtaaatattatatcaataccagtatttttaaaagtatcccaggggagtcagccttttgaattactgtccatttaatattcaaagcaaagtctatacatttgtattattcctattttatttatgaggactctgagattcagtgacgataactgacttgctcgatcaaggtcacttacctggtaaattgctgagctgggatgtaaatgcagttctgtctagctaaagagcccgcattcttcttgatgcctcagtgtctagccattttacccagagcaataaattcacttgttcctgttatttagtgtttatcatagaatttagctttagcctcaatttcattttattgtcttcactattgagtactcacaaagggagccagttaacaacatctttggaacaaccatcctgtgtggagcattgtgctaattgctgtgggaaagaacaggggaagatatgaaatattccctttacaaagatatctactgttctgccagggttcataactttgggcctgtgacttgacatctgggtggcaaaagaagtctcatgaattgtttgggaagtattcatagttttcatcagattgtaacagagccatgagccaaaatatttatgaacttctgccttgcttggtatgtaaggcatttgattccagaagcagtggcatattatcttgaattttcttcataaaggcaaaacagtgccttttcaagagattttgagtttgatatactgtcaaaaactgtttacagctaagcctagtaaaagatgttgcatatgtggagtgtgtgtgtgtataaaaaaaatgcaggctgtgaggccgggcgtggtggctcacgcctgtaatcccagcactttgggaggccgagatgggcagatcatgaggtcaggagatcaaggccatcctggctaacatggtgaaaccccatctctactaaaaatacaaaaaaattagccaggcgtggtggtgggcgcctgtagtcccagctactccggaggctgagtcaggagaatggcgtgaacccgggaggcagagcttgcagtgagtggagatcatgccactgcactccccgctgggtgacagagctagactccatctcaaaaaaaaaaaaaaatgcaggctgtgaatataaaacaatgaaataaatttcattagtggctcagaaactagatctgagaacaaggatttggttgtttctggcaataaaacattattaagaaatgtgatatcatgaggtaaatatcttaaagaattgtattcatttacacacatatatgtacaaataaatttgcacacatatatacatgctatgcacatatatactatatatacacatgtatgtattatatgcatgcaccaatacatgctggcatgttttatgcaaattgatttttattccatagctatttttcctatataatccattatttttaaatgtattaataattttaatatcaccataaactgaaatgagtaaagaggcctgtaatgtgaatattcatatatggaacataatacgggggttgcgtaattataggtccatatatgtattgtatttcctgatatatttatatatgaaattgctagtatgtgtgaaagatatctacatatattttactaataagagatatattcatatatatatatacaaatatatgctttatagagcctaagtttggggtggaacaaatgttctcacccttgtttgattatgagaaccacttgcagagctttttaaaaacctgagtcccttttacccttgattcaaattcagtacatccagagcgggtcctggtgctgtttttaaaacattccttgaatggttgtgttgctttgcttgagaagcagccctgtagtttgtgtacaggtaggaatgaggaaggaagggtaccagacaacagacaggtaagacagtcaaggggaagaggccaggaaaatttctaccaggagggtggcagtttattgatttgcttatgttaaaatagttgagtccgcgctgtatctttttacttgattaatttaatttacacaaaccaaaggtcaatatcaatgattaatgtcagagggaagggtattattattatttttaaccctacttctttttcaactactacatatctgaccttgcagaggaaatcttggagagaaaatagccactttcatacgactatcccttggtcaatgcgctacttattaaactttattttcccactgaagaaagaaaatcctaccttcagggaataaaatagagattcattttctgacctcctagtataatgctaaaggaaaagcatacaatctctttggggagggagctgttaggaaggccagaggcagctgtcttggaaacatacagaaaggtgctattgggacagagcataatttaaagtaggtgagattggaaaatagggatttttccttctcttttacatttttttttcctttcttgaacatatacagttcttcagttaagtgttagcctgagattaaatataacatttatgaagctcctttcaaaactcatccctgcatgtgaatggaccatttcctcctttataccactgcactgacttctaattacatgcatctttcatgaaaatgtttgtcagactgtctgatgttaaattgcaagataattgataacaagacccatgtcttaatcatctttgttggtgctaaatacgtgtttattgaatgaatgaacaaacacttggatgaataaatagactgtaattgttagtaactccatgagacctgcacatttctttgttattggcactttgcctccctgtttctcttgagcttcatggttctatatctacatcacaggtagtctagtgtaaggttgaataacaacactcaaattaaaaagtaaaaatcttaagatgcttttggtacctaagcataatcataaaacaatggtcttgtttaatttgaggaggagataagtgatcaaacccaagaatccataaatttggcctaagtattggtatttatttccagagatgggcaaggaaagagtgttggaagaaaatacaaggtaagttttacaacctgtgagtactcagaacctggactttcatgtcttttagaaagacacattgacaataggcagaaaatccttagctacaactcactggctgaaagcttggtcagttaaattgtgaatttacatggaatccaaatgaagtgttcagacatttcaaacatctcttgcttaatgaggttctgtgcctggctagcaggtcagcagtctgatttcagtttacagatgcagtcttaaaaaaggaccctgagatcatctataacacttccctgtcttcctttgctccagctgcattcatcagcttccatcagggttcacagcaatgaaattaattgacaagaagctcaatcttaagagcactctgaactgtatactcttgccatccacccgctaactccaatcctacatgaatgaatgcaagtgtagttttttgagaaggggccatggctcaagcagtgccatatatgtgccttctatacaactggcttggtatctggtaaaatttccattgcccagttacaaactagccagtcccttgcagacctaggatcctcttagaatgccctatcaggaagttctttgcaagatgttttaactgagcaatgaatttatagaggaggacttgaataaattgtttcaaaaatgaaaccatttgaacacaaatcatgtctttcactaagacccagacaaactaactcatatgtactccacacatctcagtgtagtaagcagatggaaaatattcattgttttttttttttaccaatgagacactagtaacaaagagaaagtgtagaaattcttcaagatccctagaggctgggcaatcatatttctagcaaaactcttgactttcttcctgttctcaacctctgccattaaaataaggaaatagtgctatcaaagtaaaagagaagcatctgttggaggggttcaagggggttgagtctttaggcatcaaagctaggagttggctgggcgtggttgttcatgcctgtaatcccagcactttggaaggccaagtcaggcagatcacctgaggtcaggagttcaagaccagcctggccaaaatggtgaaaccctgtctctactaaaaatacaaaaattagtcaggcatggtggtacatgcctgtagtcccagctactcggtacactgaggcaggagaatcacttgaacctgggaagtggagttgcagtgagccaagattgtgccactgcactccagcctgggctactgagtgagactccatctcaaaaaaaaaaaaaaaaaaagaagaagaaaaaaaaaaagctgggagtttcattattcctcaaagaaggcacctcagaccaggttccatagggcacgcccctaaagagcccaaccttctcagggttctaaaatgtatcttaagcccaagcaaaatccttgactttccatttagatgccaatatgccatcctcataatattcattctcatggaattttgagttcccacactcttacatagctcccaaagccaacttattttactgctgaaaaatacttcagtacacttttattgctgacactggtttctctatacttcccccagagatattcatgttataagtaaatctttttccaaggtgtgcttcatctcctggctggaagcaagaaaaaaaatgttcaaagtattgtagcactttttacagagtgtgtatcatgaaatcaataatcatttattgagtactgactattcactgtggggccagatattgagaatattggagagcaattagatgtggtctctgactccaggggtctacaaacggcatggtggggaacaagctcattagatgaggagaaaaaataataatataagtgagtataaactcaagaactataattatgcattgattaatgaaacaaatactgaagatttactttttaaaaagcgttgtgctcaaggctatggcagatgtaagtttataatatgaccacttacattaatttgctaggtttgccctgacaaattgtgaaaaactgtggctgaaaacattggaaaatcagtttctcccagttcgggagaatagaaggccaaaatcaaggtgctgacagtgctatgctacctctgaaggctctaggggagaattcttccttgccttttcctagcttctggtggcggccatcaattctgggctttccttggcttttagcagcgtcactccagtccctgtttctgtggttgcaaggccttcttccctgtgcatatgtgtgtgtgagtgcatgtgtgcatgtgcacctgtgtgtgctcctgtctttacgtgacctgatacgaacactagtcttttatttggaacccaccctaatccaatatgacctcatttaaactaattgtatctacaacgattctatttgcaagtaatatcacattctgaggttccagggggacattgttcaacccagcacaacccttaaatatcctattgtcttgttggaggttattttatgggattcatttttggtgttccatggcttttcagaggaggctcagtgtccactgatagtctctgggaagactacgtaggcataggtccgaccattgctatattttcttatatctatgaaatcctaagttaacattttaaactacagtctactgtgtgtcaagtgttgtcctaggctcttatttacttaattcaatcttatcctcacaacagcctttgcagtatgattttttccattgtatagatgggaaactagttcagaaagtttacttacttacatgagacttataagctaggcgctgggatgctaaacaaattagttccaaagtctactattcaggctgaacttatgcatttctggtggtgaaagcacagcctacataaccattagtttgtgatttagaccttagcccaaacattcgtcattatcatatttgaagccaggatggacccattgttccagatctatatactgtatatcagttagccatatcaattaataatcttttgatacttgtcaaagagcagagaaccgcagaaattaagagtttattctcttcattaaaccattaaagattggaggtggctattgtgaattgggcatgaattatagcataagcctatatatgttgcatatagccccccgtaacaagcctccttgttgtcttttgtgttcctaacttatgagcagggcagagattatcactgaacacattgcagggtaaatgtaggactctgagtcacccattggatttttacaggctgaaacatttacagtgtcctgcttacaattctcaagcatcagttaggtgcaggaacacacaggcagagtcagtagctgcccagggaactagtgtccagtctaatctcttcacaaactttgtgcgtgattcaggaaggattattacaggccaaattttacccatggacctgttttgtttagtaaaatattttcaaaaataaattttggatttgaatgactttagggaaggcaggaatgatctaggctctcacaagccttagtcattacccctggcctgaattacatatttatgtgagccctctagtccctggaagcagttctgtttgtcaccctgtacttagaaaagtggaaattaatgtatggttcctggacaggcagcaccagcatcaccagggaactttttagaagtgcaaatcctctagtcccacaccagacttactgactcagaaactctgacgtggggcctgtaatctgtgttttaacaagccttctggttgattctgatgtgcattgtcctaggagaaccactgacttagagataagttaagaaactcttcctttcttgaagaatagcgtcttctgctttctaataatgaacttttctgtaatgcctcaagatctacaaagatgtcttattttgcttccagagtcacgtgagaaaacagtaacaatttgagggaggtgttgctctttcagctttatccagagatgtgcggtggcttgttccaggtgttatatgacaggacaatggacctcaaactcaagattctttttcctctacacttcactactttaactctcctgattattttgtggactgatgaataagtacgtgtaaactgattttagttttcctggtaatgaaaaaaaaaaaaaacaatgagtattgttactcttgtaataatcacatcattttttgtctttctttctttttctcattttatttttagacagggtcttgctctgtcacccaggctggagtgcagtggcatgatcacagctcactgaagcttcgaattcccgggtttaagcagtcctcccacctcagcttaccaaggagctaggactacaggcatgtgctgcaacacctggctattttaattttttattttatttttttttatttttgtagagacagggtctccctgtgttgctcaggctggcctagaactccctgggctcaagtgatcctcccaccttggcctcccaaagtgctgggattacaggcgtgagccacttcacccagcctttttttctgtgtctaaaattcagttactctctcattcacttaacagtttagaaaatactaactatacaacatgtactacgctagatgattttttaacttaaaaatgtgcaatgcacatgcatattcataataaaaatccatctttctaactcctgagaggtaagcaaaaacttattttactgctgtaaaaatcacataattggggacaaaaacttgcatgtaatatattttctatgagactgtattgactttgagagtggttagagttaatggtttgaattagcataagtaaaattaatgatattgtaggtcttaaatgtaaatgcaattttacaccaggcccagaagaaattcccctcacctaccttaattggtcagatgaaaatatttggaagaaatacctcattcaattttttaaaagcatattggctacttgccaccattgaagaattagatctcaaactaaagggattgtcgggatgggcttaaacagccttttgatttgttcattaattcatcaattcaacctctcacaaaacaattgtatgttgaatgactgctaggtgctgtgtgctatgctaggtgctgctgatacagttatgagcaagacagactcagaatcttataaatctttttgtacaaaagacaaacaattatttcagtgagttgattaaatttaatattaatatttaataaagcagaagtaattatacctgcaaaggaaaaataaagtgtgtttttagcacctataatttgaggactgtgggatggtagggttatctgaaaagagataaataatttgttgtatatttgtttcttttggggggtgaatgccatgtgccatgatgtgggaattaattggaaaaccataggctatgggagtcagaagagacattagaggctctaatatctgtcccacttttctctaatttagaaatctggaggctgggacccagaaaaggtaaaatgaattaccccaaagccacacttagtgaatgaaagatgtgtgaacggacatatgcatgggcctccttaatcctatgctagggatgaggacatgcctttcccaaaaataggtgaaattaccatatgataaagaacatttttagatattgggagtagggtagggtacaaggctttggaacagcaaagttaatcagctcagtagggggaaggaaaaaggaagagagaaagagcaggacctccagtggaacaagagtctgtggactctgtcaccctgttactccctcttaatcactcagatgatttgctttttctgcttctatttcaaaataagctgctaaaactgagatgcagtgcagtgaaagcacatcatgatctatgttctcatttttgcatggagggagtgagtaaagacctcctacttaggtagtcatcttgctgtccctgcatgtagactaaggctgtgagagagaacttggtgctttataaggcattccctgtgctggtataaatttgacccttgcatgtgagtgatggtgagggacatctctgagaattgttcctggtacaacatgtgtggatttcaacatgggtactgcatgctggagagatcttgatatgacccaaaagcaagaccagaggcaagcttgacacgatggagcaaagggtggaaaggtagaaaatagaatgaaaaatttttctttgctgtcacctcctcgattttattcaaatcttaacccaaacaactagattgcattactgggctcttaaaagttttgttggaaaagtgctgctaaagaataggaagacaatctaggcaatgccattcaggccataggcacggacaaagagttcatgaggcagacaccaaaagcgattacaacagcagcaaacactgacaaatgagatctaattaaactaaagagcttttgcacagcaaaagaaactatcaacagagtaaagagacaacctacacaacgggagagaatgtttgcacactgagcatccaacaaacgtctaacacccagcctctataaggaacttcaacaaatttacaagagtaggatctcataggtttatttacaataataattcaaatgtttcagatttgtaattgtcctttgaaaccattgctttcctttaattccagctataccaaagactctttggaatgggtaaattatttctacttgatagactaggaaagtgagtcacaaaaaggctcgcccagagctactggttattagttgtgtgtttttctctcctattccacactcgagaaaaccccgaagaatagggggtggttaatggtaaaaagaaatctagaagaagagttctggaaatgaaagacagctaggttttgagtttctctaagaaaaggtagggggcaatggatttaaactaggggcatacactgcgattaaatatcgaaagaaacacactgagatttaaaaatgtataaagggcttatgggaacgaagaactaaaaagaaaatatgaggcaagaacatagggtggcgacagaacaaggctgtgagacgtgtgcttggtttgtttaggctttaaaacttgtcaaagtttaccgttttctctttcaagagggatgaaagaaaggatggtgcttcccttagtttgtttgctttcttctttcatgtatctgccctggcagatatgcatacatgtgcaggcccgtgtgttcgtgcacacatatgcacacagataaagtgggaacagagagaagccagtgggtggtggtgagagatgggggcagaattgatgcatcagggggcctaaatccatgcaatgatcaagttcatagcaatttccccaggagactgtatcatattccagtgaaggggagtacggcaggaggttgccatggcaacaaaaggcctgaaatattaactctgactagcaacaggccagtgaaacagcctagctaggatttatggcacattatagtgtgaaaagcaggagaaaattactgtaaaggcaggaattatagcacaacagaacatataaactcccaaatccgtcttcctaattaaaacagcatgctcggaggtagagcacatagtaaggccattagcttaaatggggatgtgctatcatcgctttgttatcaagtttaatgtccttaagactaactgtgtgcactgggagagtgagagcaagggtaagatagtctggagacagatggaagcaagactcttgggcacttgaattcttctcaaactcattcttggtgacataaggtttcttcagatactagtctctgatcccacaggagattctagaagatgccttgatccttctatttgtaaataaatcatcacttctcaggcatgaaggctgagagactgataccacagtcaatccctctggaacccaccaggaagagaggagcaactaatcaatgaggtttattgttgaggaaaaaggatcttggatctcccgactccctagaggggaaaataactcccttgttgtcacagacccaaactttcttttatgtcttagtcaacagcctgcccctaagtgtttgaatttgcaatgcctggaggaagtcttccatgtaattcatactttatgagggaacctttgtcttcttgtgattcttattagaaactcccaatttctcgaactctaatccaggaccttagtactcagtctggagatgggtcagggaaaatgagaaaaccattattttacaagggttcattgttcatcctttattctgccagccattcaacaagtatttaatgaataccttctacattctagtaaatgctgggaacatgtccatgaacattaaacaaacgcacaaataattacttaataaacagttaaatatacaaaagaaagtacagaatgttttgaaaattatgaaaattcttcccatagcactatctttatttccctatcaccatagttgccaaagtgcccccacctgacattcttttaggtttgccagatgaccaagccctacattcccacagctatgtcagcaacatactcaagatcatcctttagacattgcattcccctcccctcccctcccatcctctcccctcctctcccctcttctcccctcctctcctctcctctcctcctctctttcttgagacagggtcttgctctgtcacccaggctgcagtacagtgattcaatcctggctcactccaacttctgcctcctgggctcagatccttccacctcagcctcctgagtagctgggatcacagttgcatgccacagtgcctggctaatttttttttctcttttgtagagatggggtttcaccatgttgcccagctggtctagatctcctaggctcaagcaattcaccctcctcggcctcttaaagtgctgggattacaggcatcagccactacttctggcctgtgtttttcttttttaaagataagacctaaagaggattttgactattttgaaaatatattcatatctgtgtatttttggttattcacttccaggtcctaaagttgcaattaaggagaaaaaaatcattgattattcttagtagttttgatgaggtaatgcaaggtttttctgtagcaaagtcagcatgcgtcgtgaatatggttaagctatgtatgattaaaggattatttatgttttatttataagtatttgctatcaataacagctcccaaaagtaagattcaccagtattactacagcatatgggacttttgctgtagattaataatgccatgatattttctttaatgaaggtggaaatgattgctttattttaacaaagggacctctatggtccccctgagtttgagccttgaatgtagacgatcagggatgctatatcacagctgtctccctgctgataatgactctccttggggtttcataatttctgcctgaaatcctttggtttcctctcaggaggcatggagtgaatttatagggagattcttcaatccagacacaaaaaaaggttttaaaattttttgtgtgtctccatatttgactttctgtctcccattctcatttcctttactttcatgtgtgtgttttcttcttactgtgccaaacacataataaatgctcagtatttgagattaatagatataatcattattattttgtgttattctttctactcctcccttataaaaaaagggattcctcccttcatcatgcttcccatgccttcatatacttcttattggtttgcagaacaggcatagttatgatggagaaagtaaagaataatgattaaaaagaataataacaaaccacataactaactgtttgggtttaaatgacagaactctcaaatccatcttcctaattaaaacagcatgctcagggatagagcacatagtaaggcttttagcttaaatggggatgtgctatcagtgctttgatatcaagtttaatgtccttaagattagctgtatgtgccttgggagagtgagatcaagggtaagatagtctggagacagatggaagcaagattcttgggcagttgaatccttctcaaactcattcttggtgagtactgtcactttctaggtgtgccttaggcaagttatttaactgcttcgtgccccagagagtggtgggggaatcaagggtaggacacatgtgagtcactcagaacagtgcctagtctttagtgaatggaacttcgggtgttcattattgttgatattgcaggtgtaaagaatttgattcacacactcctatcatggattggagggaagttgaatattggttcatatcttgttttaggttctggtttacttgctgcctgaactaggaatataattcgggatttgcagctagtaagttgaaattaagaagaactcaggcctttagattaatcaagtacatatacagtattgaaattatgtctttttatcagtatctttccagaggcccagttaggggagctcctggcatgtgcccggcatgtaaggagtgtccacaagtgtttgcagacctgcactgaacactatttctcttttgatatgatgcagtttaacatactcaaaagagttgagccttatcccctttgctcctcaaaaccaaacacagccagttttggattaacttttattcagtcatgttttatgctgtagggtccaacctaaattttctaggacgcagcccaactaactgaattctttatgtcacttgaaggataacgtcactacagttaattttgataataacatggtttgaaggattcctaactgcttgcaatttatgtaatattctcagtgctctgtgaatttgtagtctgatgaaaacactgaaaagggaggtaatgtttactatttctgattattattctgtatccctcatgcagacctaacctcaagcatttgcagccacccaatgactttttttgaaggaatttttactagtgggttcatctggggcagatgaaaatgtttgcattttagacactccaaatacagatataaaaactttatgtctcctcctccagctctaccttcaactttcttttcactttctttcctactaagagcacatatttccaggctcattcttcatccctaaactctgtccctctccttactcctttgttccgtcttttgtcctctccctggaatttctggtcatttgcattaactacacttataagtcaaactttctttgttcctttgtgggtgtactcagaacatcattacattcaagtaaattcatgtgttttttttctttttttgcccttttatttaaaagcactcctactggccattagaatagttaccagaaatctcctttggtctatggataagaaattctgcagaacttttcaaccaagtaattagatcatattatgtctaaactggtgcctttttctcaactgaatccaagtaggagtatagactgttaacaccttcaactgagtaaactgcaatctttgcaaagtgaattaatatatgaatgcttgctaaggcaagataacacatttttcaattaacaaagtaacaggagctcagggtagcatgtgatatatatatatattctgctacatacatatgcaggtatatttttcaatcaacaaaacaggagctcagggtagcagactacagatatacatgtgtgtatatgtgtatatatatatgtagcatactacatatgtatacatgtgcacatgtacatatttatctgtgtatatgtatacattatgtatatacatatataggtatatgtatacatatatgcatatgtaggtatatgtatacatatacatatataggaatcctatatatgtagtctgctacacatatatattcacatatatatacatgtatatatgtagtctgttgtcctgagctcctgttgtttgtcaattgaaaaatgtgttaccctgtcttagcaagtgtgtgtgtgtgtgtgtgtctatatatatatatatatatatatatatcctcaaaattttacctagagtaaaaaaatgaaatgcctacattacataaagacccatatgacaatattaattctgtgagctgagacatattcatgccaattctccataccttctcccccattgcccattctccagccctttgttgttcactggtcctaactctgctttcttactacaatggcccacttactgcatccttagtttttgacattttgaaatcacaaggttctcatattaagcatggacattttctttacttttttattaattacaaccacagaacttctctcgtcccactccttcttgttttgtctttgggtaaaaggaataaattatatatttatcataaattttaactctacaaaatggccatatttatactttcttcagatttctctcagttctagttaaggtttttttttggcttccatttgccccttatttgattattatactccaagtggctgaagaaaaaatacattcaatataatctgtctgtaattttcatgtcttcctcattaccgtaaaatataatgcttatttgagacacacacacacgcacacacacacgtgcatactcttggcctagatcaaccacacagattcatttattttaccttctcattaattagaccctcaagcctcttaatgttgttttaacactaatttgttgagttctttctggcaccaaactaccccaaactccatgaagaactgaatcatcaatgtattatttataggggcttctttcgtgtgttcgtttaaaatgtagttatctaattaatttattaatttatattgtcaataactattcccagaaggttttttttttttcagatctactagagaacttaaagctttttcttttccaggaatggccaaaatatccagaaggacaatatcaagtaataattaaagttataagctcttggtttgaattcttgctccactagttatgtgaccttgagcaaattacttaacttctctgtgccttacttttgccatttgtgaagtggaaactaaatagcctttatgtcccagtaacaatgcaaagtttattcattgccgattagaaggggcacactgttcaagatgctcattaattcattcactcattttatgtaatgactcatttatcaatcctttgttgagtctcaaccactgtcctaggtaatgctgatacaatcttatgttttgaagctcgccacaaaatttgatcaccactagagccaagatttaacacattatttcatttaatagctattttgagtcttcagggtacaatttacagttttgggggggaagatgtagggaaatatgactcgtcagactcaattaagtgcatttactcagggctacccatctattaagtggcatggttctctaaccccatagttcattctctttttctgtgcaccactagtaggttttgcataaggtaattttgtccaagtggttactgtgtgggtcctgttcacaatcttgatcatgattgtattccaacttctatgtcagagtttgcaagcatgtggcttataaactcaagatggctggtacaatgttgttcaatatttaatggaggggtattaccaagatctagttttctaggttttcttgagaaattagaaaatctggcaacactaagtttgtaataataccagggacaactagccaaactgccctattttgttgaatcatgtgctgtctaagtcctcacagtccttgccacccccaaccctgcaatcatcctacatgtagtgtttctatttatcattgtatttttgcttttatatctcttacatcttgtcacattgtatagcctgtctagcatttgaatttttgactcctgttttaagctagagatatgcttgtcactgaacacgacttgaataaggaaatgagtaataattatgactctacatgccctttatagtacacaaagaactttttaaacaaccatgttatactgctactttgattttacagtagtttgctccaaatgagtcaaatggtatgtagtagagtcataattagaatccagaacaattggtgtaagtctagtgcttttctcatttatctgtcattcattcatttattgacatatttattcaacaagtaaacaattataagtaaatgtcaaatatattctagaccgtatagtggatgctagagatatagatgtgactaagatacagtcccaggctttaagaagctcatagtctatttaggaatgacagataaacggatttttctgagtgcattgtgatgtgaactgagaaatacacagggtatgtacaaggtgccatgttaacatcaaatggcatgtgattgattttatctgtgactcagacatacctctgccactgtagggagtagtataattgacatgggatcctggccagtctccttatggtgatggtggttaatctacatgtccctgagtatcatggtctttacagaagcaggagagtgaaatgtaaaaagtgctggaatggaaatcagggcaccaagtatatatggtcctggctctgacatttgcttgctccttgacgttagaaaaatcgttgaatttatgtgtgcctaaatatcttcaccaaaaaataaggaggcataagaggggagataccagatcttacaaaataagtaggttttatttacaaatacttatggattagtgggggccctttcactaggctacaaagaatttgaggctctatctatgcttagttttaaagaatgctatggtcaaagaagctatgtttgtcataggcactagaggaagggatagaaagattctgagatctaggggcaaaagggattttgagagtgcaagtgaattaaaaagctaggatcagctggctcagtggctcacgcctgtaatcccagcactttgggaggctgaggtgggtggatcatttgagttcaggagtttgagaccagcctggccaacatgatgaaaccccatctactaaaaaaaaaatacaaaaaagtagccaggggtggtgacctgtaatcccaatcccagctactagggaggctaaggcaatagaatcgcttgaacccaggtggcggaggttgtaatgagccgagatcacaccactgcactccagcctgggtgacagagcaagactctgtctcaaaaaaaaaaaaaaaaaaaaaaaaaggctgagatcaagtttctgctgcaaggacattttcattagttaaaataagaaggggctaataccaataaaatgcatagcaagttgactattcaaaccaaaaggcctccagttgaagttgtgttttaatttaagcactagtagggcccagcaaatcaaatattgaaagatgctaaaattagtctgattactttgtgagtcatcaaattgatttgactgtccttgcccttcatataatgtcccaatagacacttaacctgactctacttccttgaatttggcaaagtaagcacgatcattggagttactgcttttgggattatttatttatcacatcacctctgccatcattacttcccactcgtctttgtttggcttactttctactgtgcttctctctatcaaatctttgcacctccttaggaagatctggaagtcacctctctgtaaatctgagaagttattttcattgttgttggatgataatgcttaagccagtgttggaggctgcacaagtaaattacatggttttagaagcacctcctccttccatctgtgctgtttggttgtattctttattggatctgggatgatatgacttctttgcctggggctgttgctgccattacgcagttttggattcactgttgcttcataccaatgttggtgctgtaaatgtacatgataagagttccacagtgagatggactacaagacttctggacccagagccccctaaaactagatccaagaccagattatgcactgctactgaggttggcctgctatggtacagactgctcctccttccccaaggatacaggcacttttacatagagggtacaacagatcttgacctgcaggtgttcaaaaatcgactcataacttccctcctcttatatctatcttatcagtaaacaaatattaataagtcataggaatgaaacatgcgactctttttggttttgttggagtgatcatgccagaactgggactttctaatcttgaattcaaatcatgagagttaagcctgtcatgaactgtgagtgcaagctgacccaggaaccatgtggttctcaaaaaaaaaaaaaaaaaaaaaagcttatggctctttttgtgccacaatggcagaattgagtcattgctacaggcagtgcatggcctgcaaaacctgtgatattattctctgctctgatattaacatagctggaatgtgccccaaatgtatttcaatcaagagctttcatgtattttttgaaataacctggataagaaaatccagattttagactcaccattctgcgggggagtgggggcggcagggggtcattgatcctgtttgttttctctcttgcatgctgtccttggagatcagaggattgatgtttgagtaagaaatgcagaataggaccatatgttaggcagggttatagacagtaaagcaggtcagcatcctataacttgatgactcaatcatcctaacattatgccatctgggcgctgatactgttcagctctcccttttcttatgaaaagtttgactcaggtcaaatagggtgtctttttttgtttccttagaattttgttttctcttccttttagggattagttcttttagtcccacctttgagataaattttataatttcaaattttgaattctgatctaaaccctcaactgttctttctcccacagtaaagaagttaaagcaatcgtagcaaaaaatgtagagagtatttctttccccatccccaactttactgagatataattgacgaataatatcatatgtattcagggagtacaacataatgtttgatgtatatatacattgtaaaatgattaccacaatcaagctaattaacatatccatcacctcacatagctaccgtgtgtgtgtgtttgtgtgtgttaagaatatttcaggttcactcttagcacattttaagtatacaatacattatcattaactgtagtctccatactctatattaggtctccagaatgtattcatcttataacctaagtttgtactatttgacccacacctccccatttcccctatttcctgacccctggtaaccacacttctactctctgtttctatacattcaacttttttagattcaatatataagtgagatcatgcagtatttgtatttctgtttctagattattttactctgcataatgtcctctaggtttatccatgtttttgcaaatatcagaatacccttctttgtcacaggatgaataatatttctatatatatgtgtgtttatacatgcatacatatctctctcacacattttctttgtccattcatctgcacggacactcaggttgatataatgtcttggcttttgtgaataatgctgcaatgaatgtaagagtgcagatatctattcaaggtactgatttcacattttttggatacataattggtcctccatatccatggattttacatttatgaattcaaccaactgtggatcaaaaatatttgaaaaaaatgtgtctgtactaaacatgtacagtttttttcttgtcattattccctaaacgatacagtgtaacaactatttacttagcatttacattgtattaggaacttaagtatcttaaagatgatttaaagtatatggaaagatatgcttaggttttatgcaaatctgatgtcatttcatgggagggtcttgaacatctgaagatttttgtgtctgtgggaggtcctgaaaccaacccctgtggatactgaaggataactgttactcaaaagagggattgctggatcatataaagttattttcttaatgcattcatgtatgcactagtgtgtgtatgcctctatacacccatgcctgtcactctatgacctgttgtcatatctgtacattcatgtaacaatcgccatgtttaagaaatgtagcattgagcctatgtcttaactgatgtatcctgtttcaatctatcttgaagtggccaatcaccctatccccaaagatactgctactcaaagcatggtccctgaaccatctaggaacttattacaaatgcagaaccagagaactcatgcctgatatactgaattggaatctgcatttaacagatttcttggtgactcatatacatgttaaaggttgtgaacactgttctaagaaatgtcttcacttcttattcctttggcttgcagtgattaattgggtagaggaggcagcatatcagaatcattatgaagcttaaaataaagtgtgcctgggttttagacccaagattaaatctgaagcgaaaccaaatgtctgtattttttaatgattccaaaggcaatcctgatgtacccaacacagggcaagggtatatattgcaaggagtcacagaatctttttattcttttcttttaaacctcctggcaaccttctcttttgctgcctggtcaacaaagattatctaatgtggttgatcagcttttcactgtcccgttcattcttatgacaatttgccctaactatgcacaaactgagaactctttttaagggtaaataaatgttctcattcatcctcacaattgatttaaaatattgtaacattttctaaatatgtacaaacagaaagctatctcatagttcttgtatgaccagaaagttattgaaattttacaaatcaaatgcaaacaataccatgtaaatgaagaacattaacgtggcagatgacattttcctgagaataaagctctacttgcaacataaatacaacacaattgctatattttaggttctttagaatttggcacattttactgctgtatgccttgtgatttctcagttctgttattatttgtctctgtttgaacccatgcaaaaccttcatccacacagcttagactgtcattcagccctctctttctgcaaataaatctaatatatgtctatagtcagcccacttttcttctatgcagatttcattaatgaaagtagtaattcttgtcagtgtgattgcaagcacaaactcaaagataacattacatggcagtccttggttggcaattgaatggtcagtattcagttgaaaggtcatcaaccagaaatatggttagccattttttagaagaaaacaaattagaaaaaagtatggataacaactttggacaccaaagaatatttctataatatttcctgctcagtctgtagtggaaggcagtagagaatagaacttacaaacatagccttggagtgagaaagatctggaaactatttatgatagttctacttactagatgcatctcttggaacaagattcttcgcttctctgtaacttggtttcctcgtgtgtatgatggagatgattattatctatttcataggccaggaataggtatgatatgcaagaagcacctgtggccctatcttagcacatcataaggactaagttatcaggagctattttaactattataatgatgttatcattgttgcatctttattataaatgtgaacattaagtttttattaattaaacctgccacatatttcttccatttgcttcattgtactcttaagatgtttattcatttttctcacttcttgctttaagaacctggttattacagaggtgaaaaatcccatcaaaatgctagagaatttggcacaattattgcttatatttctcctattgctgcttttactgctgtagctgcctcctgaactgctgctgctgctaccatggcttctagatgcttctttgacaatttatttattttccagtggaacccatctgtgaagaagcccttcatagcagtaatatcctggggctgggcactactacaataatgatgctttcgttaatcaccccatgtaattttagtttttgctgataaatactacaataaatcgattgaaactgatgaaaatagctcaaaatttagagacatacagtatttcattttaccatcagcgtatttctatgtttatgcaatagggattgaaaaagttcaatccccatgctcaaaaacacatacttccagctctctgagatgatatgccagacagggcttttgattagaagccttatttttttgcctagttctagcttctgtatgagtggagactttattaacaaaggtaggtttggagcactcaacagaagcgtagagaatatatggaaaaaaaaaaagaagaagaaaaaagataaaagggaaccaaacaaaacaggtttacaactgttttactaataagagggaaaagtctgctcatgagttaaaccaagactaaagataaagaaagaaagaacatccaaaaccttcatgtgctttgtatttgtacatttctgacatatgcatgaagcatgagggaaatacagtaatacactgaggtatgctgccaacatcctgactattcctagtcattagatagcctagtgatgtttttcagttagaggggtgctgaccttactgttttcagtaattataagtctataattaccttttatattctttaagtgtatttttgtaatttcaggttaggtatacaagagtggaaaccgtgtttgatctgacgttttggctcttgtatgaggcagctttaaatagctgtcagatttggtttcattttagtgaagggttaagtaattttaaggcgttaaaaccatgggcaataaataaccatccacagtcatcgaaggaagttgcttcttagacaagagaatgaagctagagctgctagggacattagtctgataaaaagtcacatcagagaaggtttacctccaaatgattttggtggcaaagaagcctgtgcatcaacacctgcccttgagcacagcagtcaataaaaataaggtaacacaaagcagctctcttgaaaacaaaatcagagcctatactcttaagaagttcatagccgtcacaaaaggaccctcgtggcagtagaagctaaatggccaagaatgctggaaatggggctgcaagtcataaatggagaaagtctaaactaagagggtaaacagcaggtgacagtaaattggagcacttggccaggcaagccctgcatctgccacagtgagatcagttactggagagtcatcccaggcctatttcacactgccgtctgggaatgtgggactctaggttcttaagtgttaactatgggcaaaaaagaaacaagaagtataaagtcattgagaagattgtctgcagtagggcaggcatggatgaaaatcgaactctactttgtctgtgggtgaattatttaccttctatctgtcctgggtctgtaaaacagttataagaatagacagggttaatttgtgaaacttagatgaatatgaagtatgagtaaagtaccagacatttagaaatgctcatcaacatcttgaaagaagttctttcattgagataaaaagggtctttgtatctctttctgtaattcttctgaaaacagatggtcagggtagagagctggtgcaatagctcaaatggtaaatgacagacataagattcaaaagaagctcaataggaagaatgatcctaagacaaaatggatgaattgcaatagggttacataaaccatttccttaggtttagaaaagtcgttattccatttctaggtaggagagattccactgaaataatgtttctgtgctaaaaatgcaaaagccaatttataacttttaaaattataaattgaataagtgcaaagagtgtgatatggctgctagatattggtagaaaaccatccttctcatttgtgcccttattagatgtcatcaagagtcttgtgtgcctcctgctgccacatttaaagaggggagagagagagagaaagggaggggagagaaggatgaaagagagagagaaagacagaaagtgaggcatgtccagtatggtgaaatcagctgtaatcaattccagctcaaccactatgagtccttggacaagttacctcattgacaaaatgaggatggaagctccctccctggcttgacctaaggattggattacataatgcaagtaaacaactctgcacagtacctggctcataactgggagctctgattattcacaggaaagagtggtgagagacagctatgagataaggagctgcagaagctctcggtgatctgccaatataagagaagcttaaggcaggacatgacaactgtcatcaattatttagatacctgttatgtagagaagcaattctcattaatcagcctaactctaaaggaaagaaccaggaccagtagatagaagttatgggaagagatattttggctccataacagaagtaatgaaagcagtagtggtgtagtagtaggaactgagaatgcaaatagctcttggagtgttccagttcctgttctaaggactctgcattcttatttgatcctcagaacatctatgtgaggtaggtataattattattattttcattttacagatgaagaaactgaggtacacagtgaagtaaatttccaagaacatgtaaaatagaaatgaatgacagagctggaatttgagcccaggcattctgtctcttaacccatttatgctggaggttgtgattttttaaactgatgtatgacagaaaaatcagaccttggcaaatatcttgagcagtaggctataaataactcccacatgcttagtgttccaataatggaacactaggcataagtggctacacacattatctcaactgccccaaaaagtagctcaaatacacagggaaaggctgagtgactgtacaccatggttgctagtaaggggattcctgcactgagttaggaattggcctggataatctctacggtccctcccatgacatgtctgtcattttataaaaccaaaaagcaagcaaaaaacacatggtggcaaaagctaatacaaaacctagagtcaaacattcatgaggttttctcaatgcaaaagaagcctaaaatattcacctgtaatctatttatatcaaccttatactcagttataaaaggatggccatcttattgtcttgttcaaggcagagcagaagaaatacatttgaatctgggagtggtagtagaactaatagcagcaaggagagactcatgaatctttaggagaaaaaggaggtgttaacgcactgaacaaatattaactgagtgcctcttctgggctgagataagaaaatcattgtgaaaccaaataagaacaagcattgcaggccccagatatttagagactccagtgacgtttgggcttttcctgaactttagtgtgcaatgtcattttaaaaagtattttaggggaaatgataaattatagccagtttcataaaagaggtatacattatatttttaaaagactttatatgaactgaatcatttgactttaagtttgggtgtaaaaagggtatacttcaatttctctcaggccagcttgctccccagtaaatgacaaatatgggtctcgccgcactaagatattttaatatacttcagtgggaaaggctctgatccagaaatttgcagttgtgctattgataaaatttatgagaaactttcttctgtgggcctcagttttcacatctattaaatgtgctgatttaactaaactatctttatttcctttaggctcagacatttcctatttcttttatttctataactgtacttattttcattatgtagataccagatggcaaaatgtcctggtagtgtgtgcaggactcaaactgattctgggaaaatggggcacaagtgaattctaaggtataaggagctgaagtgagcagaagcctctagaatctatttctatttctgtcagctacagaatgtaggcccagtttaatattaggagacgttgtctagcttttaatattaggtttcagagttgcctaacaaaacccatagaggttgtttcttgcttagagtaatttaatgttataaggatcaggcaggtgcaacatggcataaaagtattacttgccccaatgccacctttaatttctctcaatctttcaaagcatcaaaagaaaaaaaagttctctctttgtctattgtttataaatataatttattctctgtgcttaggtgattttcatagataagaggacattcattgtattcagtaaaacttctagagcagtccttacactagtaacaagtttcctgggcaatactgctttgttatcagacttcaccatgtagatctcacatccttctcttttctgatcttgctcttatcatttcaaagttacatgtagagtgaggatgcaggtttcatagggtttttgtttttatctgagacagagtcttgctttgtcacccaggctggaatgcagtagtgtgagcatggctcactgtagcctcgacattctgggctcaagtgatctcctgcctcagcctcccaagtagctgggaccacagatacatgccaccacccccagcaattttttttttgtcttttttgtagagatggaggtctcaccatgttgcctaggctgggcttgaactcctgggctcaagcattcctccctcctcagcctcccaaagtgtaggattacaggcatgagccaccaggcccagcccatggtgttttctgacaaagctactccattcatttgctgtttgaagttgattagtgaaccacattttgatgttcactaccttcatttgcttttatattcaactgcattctttaagaatcttccctcagcagttagaaggccaaagataatttaaatgggattgagggatatttccctctcacattagtgctgtagagccacataagaaggtattctatggtagaaatagatttagaaaggtcaaatttgaaaaataaagtaagtccagacccgagtgataagatggatggctgtctagattgagcatgcaattctaatacttcagttccacattcttttttttttttttttttttgagacggaatcttgctctgtcacccaggctggaatgcagtggcacaatctcggctcactgcaacctccgcctcccaggttcaagcaattctcctgcctcagcctcccgagtagctgggactacaggcgccctccaccatgcccggctaatttttgtatttttagtagagacggggtttcaccatattggccaggctggtctcgaactcctgatcttgtgatccacccgccttggcctctcaaagtgctgggattacaggcatgggtcaccgcgcccggcctagtcacacattcttaaagatgtttcagcttttgatttttaaacagaatggtatggagaagggcttttgctggaggtgcttcagtcagttagcttcaactctgaatgaacaccgaagatgtcttggctttcctaaagactcaggctacagattcttgctcatggccaggggtaaaatgcccttcatccaatttaatgctctcccatgtgtagcaaacatatcaactactctgggttggcatatgggggttttagtaaaactgtgtaaagaatttgccatagaaataggaatagtctttcactttccattttgtactctgggtcttctctgattatatatctcttttggttttcctttccaagctccatctttatcccaacctattgggtatacatctgatcactgctttgctaacacgataatacttgagactaattaacaataccttagtgatactgcattctcaaataggaaaatttcaaatgactagaagaagactagttgatgcctaggaccagtactagaatggttaagttactggttggaaacttcagtgtgcttgtttctgcaggaggagaactgctttaatgtgaattgcattagaaagctcccctccacttttccttccccagtgtttgtctactgaatagcagggtgaaagcgtcggttgctctcatcgcctcacaatcaggccaattgggcataactgctttctggtagaattcatctcataataaattgcattcatggaagatgcctagtatgtggtaaacatggcatggacaggccaatactagagaaagatagaacactggctcagaggagacacaaacaaattgcctttctgctggctctgaaatattctttttcagtgtagttaaatataaagttgaaatgatgctaactacaccttgatccaaacaacctcttcattgcttggcttctgatgggaatgctgtaggtagccatttgttttaatgattgatttcactaatactgagtcacaattgcactcctcttgaagttgacataagatctccatgcacagaaaatgaattcattagaatcaaagtgattgtataagaaactcaaattatccaggtgttgaaatgcatgtctactttcttttcagacaatggaatcatttataaaacatatagttatttaaaacacagacacacatacagagactatcatatgggattgtgagagattgctaattaacacatacaaattaagacaaatattcattaaaacaaatattaattcctcaaagtttaattcttaacaaatattaattctacaaagagctaaaaggctctatgtaggtagataacggcattcagatttacctcctaatctttacagtaattggttttaagggttggagaaagaagtaaaggaggtaaaagaatgtacatagacaataataattatgaataacatttactaagcatctactatgtgttaggtactttgctaaccaagcttagcatttcacatatattatttaaaattcacattaactacctgaattacattcaattattttactcttcagggagatttgtataagttgtgtaaggtctaaaactgttaacaggaaagctgggagttgaactcaagtttctctagttcctgagccaagatcttagttgctaagttattaccacattctcagagcctctgaagcaataccactgaattcagggcttatgtttattctagcagcatctttctttacaaaggggtatgtaaaaatagtagtccttctaatttctcctccctccccccaatatttctgggattatgcaggcgatactttgcttttggaaagaatgaaatataggcaattgacagaggcagggtcctgactttcttttttaattttttttccttgatgatgagcataatcatgtgaataattaagcttcaagagctaaatgactgattggcagcaagctgactaactgttctttatttataaggatatagctttcatgggaaaatgtagggtggttggtaaaacatcagaagtctcccttgagatttcataaatgccatagcttaggggttaaactcacagacatttaagtcacatgttcttgagttcaagtccaagttgctggccctttgggacttttaactcccctatgatcgattgctataaattaaaactcagttaatagaatataatgtaagtagttatatatcggaaccaatgatagtacctacttcttagggttgtcaagagcatccagagagctaagttatacaaaggactagctcgatcactggcatgggataaatatttgataaatgtggtttgtaatattttataaaagtgacaaaaattcttatttatgtaccttttttactatgaggagaatcaggttggattcttagaaaaccttcagtgcctctgtcacagccttgcaaagactacttgggatatgtttatgttgataatttctccccttttatttttctatcagtcagatttataataagaatcagctgttctttctaaaagactattgtgcctttatattattttctttaattttcaataatcctatgaattagcaattattatcctcatttttacaaatgaggaaactagagatccgaaaagtaaacagcctcccagctaataaacagatgagctgcaataccaaccgaggtcttctgtctctcacaatccagttctaatattaaaacaaaaggctttgagaccatatgacccaaggtgcaatctgtttttcagatcagaagattgggactctaagatagaaacacggtctgtccagagtcacatagcaagttggagacagaatggacactagaccctaggcctctatttctggtctagagctctttcatcatttccaggctacttgtttgtttgcagcaatttgtatgttctgtagaggaagattgaaaagagaaatggatagaaagagagagcagagatgaggggatgagagtctggagagaaggggagagagagagagagagagagaaatagattcatatatgaaggttagatcaagggccagcatccaagggtggtctaggtagagtactgggaaccaatctcaacctggcaggagaggcataattaaccagtgtctacatctgtgatattatttgtccttgctccaaaatgacaatagtgattacagtagatgcagctgacagtagcagatgacacaacctcctttcacctcctggccagctgcagcgctaccatcaccagctatagcagctttctccctggagattcagctttttctccactgatggaaggctttccctccatcactccaatgtcagagcttggccgatttggttcctcaggagactgtagagaaattcactcccattgaagcattttcttgacattttgacattcaatcagagaaaggcaaaaggcaggctaagggcccaatcatcaggtccatgaagatcaagctatgttttctgagtacctattgatagaatgtgcaggagattattactgtttgccaaagctctattgatcttggctttgtgaagctcaaagtctgtttacagccacctataaaaaccaacagccacttcttttactgaaggttaacgtgctgtgtttatttaattgaatggaaatggccttgtgttttccaaatgtcattgttaataaattttcaagggaatctgtgactagtgtgtaggtgttgaggatgggagaagggactgtcatggggagggacggctgttggaatttgaagttgctggaagcaagagataaaagacaaacacatagatacgacattggaataatttccctgtatagaagtgctataaaatatccttactctatattagtgttgttttttaaacttgtcagtaagaattctcccctgggtgttttattctttagcctgcgtctgtttttgtttgttcttttgggtttccaaaaaatatatattttaaagtgacattgagcattttagtataattgtgagttttggggttgaatatttttcactattatttgatcagttttttccttctgtaagagatttaacagaaatggctaaaattaggagccatattagatagaggaagatattggcaatcctattgacctgctttttaagaggcgtgtttcaactaacaggaggagagatgcaaagagctttcaccaaagcaatcagaagacctgtaaacagcctcagggaactgtaaaagtctgtgagggtctctagtgtaccagatgaaaagcagaaactttaggtagccgtctgaatgtgtcaaatgggaatatcagaataactcactaaatttcctttttcaactttcctcgcaaggtttgtctttttatgtggtaaatgttggtgagttccatttttaagttttactcttcccattctacttcagtctccttagcaaacacacacacaaacacacacacacacaaacacacacaacacacacaaaattgttcttcttgaaagatacatgtaaatgaatggtgagtaaaaaattaaagtctggacgcagtggctcacgcctgtaatcccagcactttgggaggccaaggtgggtgactcacttcaggtcgggtcactcacttgagaccaggagttcgagaccagcctggccaacatggtgaaaccccatctctactaaaaatacaaaaattggtcgggagtggtggcatgtgcctgtaatcccggctactcaggaggctgaggcaggagaattgcttgaaccctggagttggaggttgaagagagctgagatcgcaccactgcactccagcctggcgacagagcgagactccatctcaaaaaaaaaaaaaaaaattaaaaacttattgtctcaaagcagccattcatttattcaaggaattgctaaacttttctaagggaccaggcactggcctgagtgctacatcgagagagagtaataagatcgaggatcccattcccacgttctgcacgtgtgtgtgtgcgtgtgtgtgtgtgtttcgatctgtgtgtgttggtgggtgaatggctatgcaaatacataacaatttaataagtcttatgatactgggagtacctgactctgattagggggcactgctttaatatctggcaatggaggatatatccatcttcattcgctccttcatgcccccatctaaccttgattaaagtctgatttcaaatagcccatttgttgaacattttatcaaggtttttcaggagcctgacagaaaatgtaaagtcgtcgtatgttttgttttgggaaatactacttctaaaacttatttgagtgtctcagctttttctttcttttattttattttttaattaaaaaaataatattatcttttatttgtctttaagagacagaaccatgtctgcctagtaccttcacttggtcaaatacctcttttggtggaaacaacacaaattatgtaggttgtatatacaggatgaactcggtttaaagataagacatgaaattcagtggaaatattctttaaattctaaacagagaaatcaaaacaaaggtatattcatactgcatgtgggtataagttttttcttacatatattatatatacatatataagtgtaacacttttaagaattttattgaccatctaaatatatagcaaaatcagctgggggtacaagagtgtaactacttccttttttcctaagttgtggaaaatgtgagaaatgagaagtaagcaagacggaggattagaatcacaaggtaggtttccctagtatgaattcagtacctgaaaatcttcttagttctgagtttgaagcagattctataaaatcctgtattaaaataaatacagtaggaattagcaaggatgggggaataggagtgggcagatatgttcttgaagagaataaatgcagaacattattctttgtcaattaatttttactttttatagattgttagactatttaacaaattcttatgagaaaagtgtgtttttaagtgatctctgggaagatgttcctgataataaattaaattaggactgtgcattgcggagcccccaccagttgtactccctctggtgaatttaataccagacgcaacctagttagaggtgacatgaaatcacagaatttgataatcttttttttcaaagttaagcaaatatagatgagctcttcttgtatatgtaagatgccagatggtgtttttgagaaatcgattcgtgtatagtaccagtccagacaaatgggtccaatccttctatagataaggcgacccacttttcctattcaaccatagggctccgttgtctggcacacattatttaacaaagtgacattgtggagtcatcagtaagaatgtggcttctggagtgaatttctttttgagtttgaatcctttgctgggtgatcctggccaaatttcttaacctgtttgaacattagtttcctcgtctctaaaatgtgagtaacaagagtttctcgtaggaactatgtaaaggtaaaaagaaactgtctagcatagtgcctggcacataatataatttcataaagtgtaactcttgttattaaactggatagctcaatagatattgctccagaaacactagtgcatgaggctgccattacgatcgccaaatgatagcagctgtgaactgccactccaagccctttgcagatgcatgtacttcttcgcaagggcttctagtcattgacttacccagatctatcgtcacctcttgaagaaacaaccagaaaacactttccctacttacagtgaaataagtgagtatccttctacagaaggacagttagttcttgaaccaagggacttcaatgccatatgagaaaaattgtcttgtatacaatatctttggagagtgaaagagttttaagcatcttgatattagaaattaaggctacaatgcattcaggttgcctataagttattcatttctgtatcttgttgtcaggaaaaaaaaaaagaatacttcaaaattaagttttttccatctaggatctcagatctcattgtataattttcatcattcaactggatttaataggtctatcagtatgtacagtaaattattttcaaaattcttcacctaatagctaaaaagtaagccctaatctggttttctgtgaaattgtcctcgacagaataaatagttcaggtgtctgaaaagaaaaattccatattcctatatctgggttgacacttaagactgcgtttgtgaagcctccttatatcttgaagacaggatgtatctatcttgctggtgagaattttgctgttctggagtctatatcaggtacctcaaacgtgatgagtgatagaggtcatgttttgttgtatcacagtttgttgaatctccctccttagagattcatttgactgaaaaattaacaggtttatttgtgcaaatggtagttgcacacccaattattgcttctgggtttcccatgtgactagccaagactcaaggtgaaagtttggcctgcagctttggcaaacaaaggagaagctaatgaatcataaaggtcacatcttcttgaattttcttctctttcttcactgttctgattacttttaaaaaatctctattccttatatattctgagtacaaaaactcattagcaagatttggttctgttgtctggagaattttctgctcactgcaataggaaggtgatccaggtaccacataactgtctccatgaagatgtttgcaatatgttatgagttttttaaagttattgtttgagaaaaggccatataaggagataatttttgcttattactaattagcttacccctcttctgctgttcttacatttatgactatttacttgtaaataaaagttattgatctttttagaagtccattggattctgctgcttttatttttgagaatcattttaacttacaaacacatattaccttttccaaaaagtgaccacatagctttgtgactcctccctcatatattttgagcacacagaaattaccatcctctcactgagtactatacatcggggcctctggctcttacctcctttctcagatccaggactgaatgcatagctgaaaagatgactttagtctttattcacaacctgtaaactaaagaaggtcattaaaaaaaattcttcgtatcttgcaaacaaaagaactgagatacctatctaagaatggcaagtctgagaagcaaatacctggctctagccctctgccataagtttgcaagcttgtgtagacctttgtctgagaattggttaggtatagaaatacacttcagcagagacttgacctatatgactttcaaatttgttatgattctacaattagtgtttgctaaaatcaaaactgtagaatatagtatagagagtatattaattgttggctctatgctgacccaaaatgaagtcttttaagagattagagtactacactgtctacatttaaccaggtgtcatataacaattaatgaaaattcaatgttttatacttagaatttttaagtaataacagatgatggatcaagattaaaactgtattgacagcctaagcaaagaaataaaatctaacaaaagaagctttaaaagaaatgaatgtaaaatcctatattttgattaaataaatcaagtttgcaagtaccaggtataggagttttggactgacagaactttacactaaacaagatgtaaaagttttagttgtacataaatttaaaatgaacctgccttactgtttcttttaaaaaaattaagaaaaaaaaactctacgcagtattaagttctattaatagacttctaatttattactaaattatgttgactcttcatctgaaatgtatctatctttttactccattaatttctcttcagtgatctagtcacagaccttattatcctttacatgacagtagcttaataatggtatccttgcttttctccctactacagtctgtcctctgcatgtagccaatgttatacttgatgacttaaatctgatcatatcattcccaagtaaataagccaacaatggtcctcaataattaccgaattaattattccctgagaaatggggcccctcagtgtaatatctcatctcaatcattttttttagttttgcagatagcacctgccatttctaaatatgtgtctttaattcatcttaaccacttcggattatgacatcctaaaattgccatatatttttatatttccatacttttgctcaggatcttctttggttaaaataatctttcctacttcacctttgaccaaccactgccagtgatccatgagattcaaatgtcttctcatttggaaggactgcctgataacctgctacctcagcttcaggagaaaccagttgctggcctctgtgctgttctcctacctctaaacagaatgtaaagtactattattttctcttcaattgacaaggcgcttctatgattgttcccatcttctgttggtattatttttaataaaaagatctcatatattgtgttaaagtactaaccttgagaagacccccagtctgaaagaagaatatttcacttctcccttccccattttcaatcacacatattattgaataattttggttaacatccttaatattctaaagtatcttgaaacagttattttttctattttcagaaataaggttttagtgataatactgaaaattctaaactgtgagcttttgtttcagggatagaaatttaaaaaatcatgaggtcttctgtcatgattttgaatgtttaatctactttgtccagtgggcttctgaatcttttgtgattggcacgtgttactgagatgcagacacatgcaattctggtgaccgagttctcaagctacagtttattatttcacactgcagtaaatgtatggactgagggtgaggggactgtcagaagatgtgtgtcttgggtgcctgaataatgcttcttttgctattcactttcatcttaatttagagtcatatatttcttgttaccttttggttttccccggcacctaacaatgtaatcttcacaaagcagtgctacattctaaatttatagtgcagtaaatgaaagaggttggatccattgtgcttcataattcagagggaagaatgtctgcagaaagaaacgtgggtattctttggaatgccatatgtgcaataattgaaacattttgaggaatttccaatttacctcttaggaggaattcaggtttttgttctttttgaaaagaagatgattgttacagacttgggaaatcctaaaagaaaaaagaaggactgttgggacatcctggttgttcttgacccccgcaagaacagctacagttctttcagatcacagcacttgaagtcagaagcctaagtgggtgtccagagaattcaatgccgaaaggttttgcccctcttaactctcctgaccactagcattctctctaccttagtgtgtgggtaggtctttgttatgtctccagactcacactagttttttaaaaaaaatacttaggtaaatagcagtgggaccccaattctctttttcttgtattccagatgaaaaagaaaaaaactcaccagtttaaagtgctcgtttcatatgttcacgatatctaatagatgttaaattttggtaccaggaagtgagagagtgatatgaaggaactagtgaaataagattttaatacctggcaacatttcatagatgataacactggtccacttgaacacttgccattttttattcattatatctggtctagatgggtctagctaaaactttattccgtgcaacacagctcttgcctatttagaagcctttaactgtgtgtttaattatcacctggagtggttcttttgcagagaaaacatagaacgtaggatccagtctttcacaatgcaaaagttgaacctctgtcacctggcatgcttgaggaaatttcagaagctttgtcctcaccttagacccactgaataaggtcactaaggaatggcacccaggaatctacattttacaacctctccatttaatacatatgcttgctagaggttaagcaacactgtgggctcacctgtagcacgtagcactaatcagacaagactcaatatctggccagacttttagatgataatcacaagaagcaataacatttttctgaaacaaaacaagtggcaaatgatactgtgaaatctctggcactggttacccaatatccacacataccccacttagctctagattagaaaataaagaatgagattcagcccagaggcagccatgcgcacaggtgcacaatttggaaaaaatgagaccaattcttaaaaaaaaaatcaagctgaagtcaaagaagcttaataaaaatgtaaatcctctttcaactggctccatgttttctgtctcttcatgaacacctgccacctggtgaataatgtcaaggcctctcagagtgggtcaggaaagcaaaaaggcccatggccggaaatgctattaggcattcaaaaatgaacaatccaggtaacaaaaactcatgtcagtggtgcaggtacgatggcgtattctcttcataagaaacactatgcaaatgaatcgcaaagcgtgagagagcagaacttttcactgctgccttctgtcaagttgggaacactgaggtgaagattgagtgcaggggatttggggtggggagggtcccctgtgaaacagtttctgaatgaaagtgagggaagcaggcatgggatagaaggataatttggtctgagatgcaagtgcggctaaagcctcagccagtcccacggtgagctctgaagttaggttgtcccttctgagatgacctaaattgcataaacggatctgagtctttgtacctcccgtgcccatccaaacatccagtcaccatatgaggccacacccattgactgaatccggttctggagagggactgaggtttggtgcaagttgtccgcagccaggacttccaacatctggaggatgagcaccctaatcttgaaggctgaattcagtagcacatccactgcaactgaatatctgattcaaggccaaaaattgtggagctcagagccacaacgggcttctgatcttccacaggctgctgaatgcccctggcagtccactgaagtgataatgttaaggaaggaaatgattagaagtaatttgctgagggatcagagttgcatttggagctatcagcaagtaatgaagcaagaatgtcaatcgacaggtgaatcaaagtcagggcaaaagaaagggaggaggaaatttgctcaaaaaaaaaaaaaagccattactttcattgaggcctgggatgaggtaagtagagaaagtttgcaactgccagagattgctaaataggaaaaaatcttttgtgcacgtgttgctggtgggattgggacatgaaagatgttgtgggacagaatctcactggaaaagtcaagaatcagagctggtttcaaaaaaactcaaccttcaaataaaggatcccctatctctatattgaacctggcaatgaatacctctttcttttccttattggttggcaaggatgtagaacactaagatacacacacacacacacacacacacacacacacacacatacattctttgtttgtttgttttgagacaggatctcgctctgtcacccaggctaagtgcagtggcatgatcatagctcactgcagtcccaatctcctgagctcaggctatcctcctgccacagcctcctgaggagctgggactataggcatggaccatcacacttggctgatttttaattttttgtagagatgaggtctccctgtgttgcccaggctggtctcaaactctcggactgaagggatcctcacacctcggcctcccaaagtgctaggattacaggcacgaaccaccacacttggcaaatatttaattaaatattaaatatatctaattgtttgataaaaagggagagaggctctccttgatggaagtaataggttctggaatgcagtgagttctgctcggaatgccctctgaccactgcctccatgtgtctaatataacctatgacattacccatagaggtgccgctttttcattgggggacactgctccaaaagtgcctggaaccaggttaaaccattgaggttataaggaataaagggcctttataataaagaccatttctgtgactgtgttctgaaactgataaaaagcacttctttctgtctttggtgtcttccttgatagttgtaataagaatagtagtagttattcttctttttcttttttcttgtttgatttgtaaaataaaaacacttttcctttcctctctggtgtttgaatgcacccagtctcatttcagcagtccacaatgacatactgaaagttgtaatagagctacagctttgctgtatagaggtccatggatatgttttctaattataatcattcttgagctgtttgtaactatttcagactgcttacccagctgtatgccactggcttgtttctatttcaggaatcatctcttcctcttctcctccttccccctccattcccaaatccccacattagtagcggccaagttattttcaagtacagtgtatatgtaagtgatcttgatctgctaagaaaagacatactgtttgtttttattgggcaggcagcatcctagggaaaaggagaattacaagtctaatttggttaggaagcatcctttttcgcaacagtgaggactgcaggtaccactaaaatcattgctgttcattactaattggattaagtcctctctgttccaccaaccctgcttttaaaatttcttctctgcttttcattcagaaactgcctcagcctgcactccgttatctacctccaggctttattgcaacacctcccactgcctctctcctggaccaccttgtccacgctgcacacagttgccaaattcaactttctgtgttgcaaaccttgttgtggctccccctgtgtaaaaaccttttagtgtttctcatctccatgaatcactaatccatggtgcttagtagcatgtcaaaggcccttccgaatctatctctagcctacctctgtggaccttatctcttggctctcccacctgcccccacccacacctctaccccttgctttttgcttttcttttccccaaattctgagctgcttatacgttctttcccttcatggtgttttatacctcagcgctttcatgcatatagttcccagtgtctggaatgatcttttggataaatagtgacacttcaagaaatatctttgtcccaacttcagaaacctaattttcattgtgatgaatagctcccacagttttttccccgggctattttgcaagtattgaggattcacatgttaatcctgaaatgtgcgttctaaaaaaaaaaaaaagctccatctgagaacccattaaacctctagtttaaatacccaggcattcttaaaaatcgaatttgcattgtctttgctgcagtgtcttctcaggtaaccaatgcagccatgtcagattgatacatcatgttgttaagacccccatctgtctctagggtagtagaaaagatgcagctacggaagagaacagaactgtgctcctgaacatggcatggctgccgaacctcacagataatcctgaagcaggcaatctctgcagacttctggggtgatttgagcatgtgtagcttttgctggcagctgagagaaatgggaagtcccctgagctgaaagttgggagcactacatcctcatcaacctaaatctgccacatacaatctctgtgatcctggggaagtcactggacctctttgagtcatgctgtcctcaaatgtaaaatgagttttacatttaaatgttctaaataagttcctttagaatgtttcaattaaaaatttatccatctgtatcagataatattggtgatctcattcaatttttttagttccctttttgattatttttgtacccccaggcctcagcgtggcttctcttgcaatagccagcatggcttgttcttaagaaagttgtcctcagtctactactctattgcctctggctggaaaaactcgggtaggtgcaaggtgtccaccagcattttctcctgggatcgggctgctgccagctctggcactttgcctgggactgtagccttgtctggactcccctttccctctgcgtgggagtgcttccttatcaatcatttgccctcgaatccatgtcttaggatctgcttatgggttggactcagcccaagatattctctatctaggtatcctggttgagtttgttaataaaagttcggtttggatttagacgagacaaaccaaacttggttagggtaaatagaggaggaaggtgccttgtttcctaaattgtgtttgataaagtgcttaataagggcggcttccaaagtggttccaggtaaagaagtactaaaaaggcctctttattaatgtatggattttctgtcactgatgtttgtctgcctatgaatagtttagactagatttttcaagtaagcactttataatatctgtaactctttctaggtgttttataaacaactaactgagtagagcagcaacaacaaagagctgtaagttttctgccagtaacttctagtttttacctcctcaaaagctattttaaacaaatatgtgtctaattaaatctcaagggaatgtgaaataaaaactggaatttgagttcagagtacctgaaagagcatttttggaaaagactttgtttatgccatttgtgcatatgtagatggaatcaaaatgtataagataataagagaaaggtgccattgagcctccaagtagaagcccgatgacttcacttatgcccggctgatcacccaagtgtacagttagtcatgatttgatatctgttgtagattaagcctgttgcacacagtttctaccctgatgtttggcatgggccatgcaccatacattgaaacaagattttgaagtaaatagaaccacattttccactttctttcatgcagttattttctctgcaagatgcattctggctccttttgtgaaacctcagatttgattctacaagctgctgagaaacacagcacctgcatgccacccaccaaagagagtgtttacatagtctgttgtacatagaaagcatgtgggtgtgagtatacgtatgtgtgatgaaatggttcaattgacattgtacttacaagataaactgcatgtatcaccaaattatttgacttctctactcagaaagcattaaattttgaggtttaagtagacattaaacatttataatttaatatacatttaataaaattaatatttatgaacacatttgccttgggaattaaaagtggaaaacagtgtcatttacttgctaatggccaccacggtgccatgcagttacagatttgatggcctgcatcccagtgacattgctccaagaccagagacaagaccattttttgtttgcatggagctaagtattattttcagaaaatcaaaaccaaaaggtatgttttgcttcctagctcagggtctctggagacctgacctgccaggtatcatttgctcattttatttaaagaaaataaaataaatattcaatggagaagttaaaagtctctttccaactcaactctatatctcaaagaattattttctcattctgtcaagccatgttaaaattttcaagtaaagtcgtaatcatttctacattttctttcctgtttgtcttgcatctcttaaaatggttttaatgttagaagctacttgacaatggatgtgaaaatagatttaactcagcaatcaatatattatcaataataatcattaatttatacataaacatcacatgggtagctttccaagtccatcctgttttttgtgggctcttatgctggttcagagatgatatatgccatttttataaggtgaagaagtggagcagtataaattgtaccaagcaagtattgagcactgcgaagttcactgttccttagagaaatgagctatgcatttactgctaaaaacaaacctttcataaaatatttttttgggcaccaacctagtgaaggagtaaggaaaagaagtggatggttttagcatttaccctatggaagcttatagcctggatggcaagatcaaattaacatgagaaggcagtttggtgtaatggttaagagcctttggattcagccaaggcagaaagtgatttgaattctaattgagcccctttttagctgtacaactttgtaaaagccctttaccttctatacctcagttttcttatctttaaaatagaaatgctaatatctacctaatagtgttgttactattgtttcttaaagattgacaacaaggcgtatgaacagcatgcctggaaaatactggatgctcctcataagtagttatttatttattaatatcactgacacaagtgaaataatccatctcttcctaccccagcacacttatcataacaaatttgtaatttgtatgtttacaatatcttttctgatgaattgatccccatagtatatttagagcagtggtgtctggatttgtataaatctctgtaactctagaacttcacccagtggccaatacataaaagattctaaataaatatttgttgttgtcattgtaataggggaagagtatgctccaaaacaaagatactgattttaaaaacgaccacactttcaaaaaaaaattttttttaattctagagaccagcatcgagagtaggagtactcagtacgattatttacggtaatatatttattgggtaaattaggcaccatctggtgtgctagcttagatggctctagttctttattaatagatatatgagactctggggtaataggttgctagatccatatgctattcaggagacaaatttagtatacggtaagcttgctacaggatcaagtcgcataagaaaatgaattgaagtcgaagaaatgcttaggttaacccaacaactctgataattgaccaatgtggcaagggccattctgttccaaaaataattaacaatatgatcagtactgaattaatgttgttacggattataggtttcaaattttcccttgttaggaaaatcaccttttaaataatctcatagggttttgaacaaagagcacagtgtttctttttttttaaatagaaacccatacttgagaaggtagcaaagagtagcaaagagacctggatctctgtagcaagttcttggcctggtcttcattttcaattctaaaaattttgagggaaataaacagctgtccaaacaaaatgctgaaagaatatccctggacaaacagaaaatctttttttttttttttttttttttttttttttgagacggagtctcgctctgttgtccaggctggagtgcagtggtgcgatcttggctcactgcaagctccgcctcccgggttcacgccattctcctgcctcagcctcccgagtagctggaactacaggcgcccgccaccgcacccggctaatttgtttgtatttttagtagagacggggtttcaccgtgttagccaggatggtctcgatctcctgacctcgtgatctgcccgccgcggcctcccaaagtgctgggattacaggcgtgagccaccacacccgaccgacaaacagaaaatcttagaggggcatcaaagcaaatcatatggatggagagtgtgaatatgaagaaaagcatattctttcttcacacacacacagtatgtgtgtgtgaagtaatcttcagccaaagcaaagactaaaatgacctgttcaataagatggaagcaaactttaaaaaacaaacaaacgacaaaaaaaaaaactgtcctccttctccgccaaattcaggatacatgttttatcagcccatgtgctattaatctatttgtgattattctatttcattttctctcccatgcttttctcatttcttctcctcattctaggtgagtataggaagcatcagggctggggccataaaaagcctgtggccaaggacattgcaataagacagagaattttagatacttcattaattatttttcctaccagttaaggattccttgtgtaatgacagaacaaggagaagacagcaaaataatactaatgctaataaaaatatgtaatacagagtacttatgatgatataagcattgttttgtttgcttagattattctgtctggtgttcttaacagcctgtatgctgggcaataaaaatagagtctcaggaaaacagaaccaagtttgctataatttggagagacaaaactaagctaagattctttaagtaatgttcatggggagtttgtgcatatgatttatcagaaagagctgcttctaccagggctcataataataatggttcccctgaactggatgctaaatttatcaactggttattttgggcttctcttgccagtaagcctatagaaaacaaaaacaaaaacttttgctataaccttgattattcagagaaaataaggtttctgctacacagcagggacaggacatggttggcaactgggaaagacactcagcaaatattacagataccagaaggaacctggagaaactctgattctttttcattttgttcttaaaaagcaggcgtctgaaatgtgcccaacttcagctaaagaaaaaaacactattgttgggtctagacacaaagcctgatttgctgattttatttttcttcatttagttattttattgttctgtaaatatggacttaccttttttgcttctttattttatcttttggtagaaccttgagcagggacaccctagacgttcaactgttccgtgtgatcagtgtctgccttaaaatgtctgaattcctgtactgcatttcccagtgaagtttagtgtttatggcaatcctcccgatggggagagaaatgagccggcgaggccaaaagcagcatctgtgacttgctaggatcagctggctctgtgtgcatgatttccacttcaaagggtacacagacaacttggtgatagtccatttattgcagcctggtcttgtcaattagtcaaagttatcttctatacagctacagtaagtaatgtaaaatcatttacaatataggtgttagaacagcagagacccttagagttcatgtatttgacttcctccttgcacagttgaggaaattatgaaatgcatgtctttagcttcttcattctacagtatttattgagatttttttatgaagaagaaggataaaaagatacaaacttgtatgaagttagggaactggagaagctaactcattttctcttttttttcctgtgtctttggcacctctattagatctggtccgtagtgggtctaaataagtatttattgaagaagtaatacatgctttataaatgatggccaaatagctgtttgaatggataaaaaagcttcataaagaaagtgatacttgtactacgtcttgcaggatgtgggagaattggaaaatgagagagaatagagaaattaaccaatattatagtccagccaacagcaaagattgaactaaaattctggtctggtctagaggtaaaccaataggctcactttccaaaagaaaatctgaagcatttaagattatttaataaggaagaatttcctctggtgtcctgaatgaggaatctttggggcaagaagggtcctgtcctatttattatccttaagaaattccttgctatttttagttctcaacatcagctacttctcattactaagtaaaagccagattacttaacttgcactcaccctaattcatcttatccactggcagcaaattccttccttagaatacttccccactggtttttgagaagtgaaaaggattaacatatatggcagtggagtgttttatgtaatagtctttttattaaccccattatccagctgttggggtgctgggtagagaaggaagggaggaggaggaaagtagttgttggcactgggggttcagagccgccccagctccttgagatgaagggatgaaaataaatcctctgtattactgaagcatgtgaatgccatgaagtagtgggacctgaatcaatacattgcatttacagcagagcaaaagaaagaatagggttttcagagtttatttatcctgcttctctgaaaaatacccgtgtgaactattgggctgagagtgttgagtccattgaatttgactctttcactgccatatctttggagagaatgccttcccaaagagtcatatccaaatgtaatgtccctcccttctcttatgagtgacttacttttggtattccactgggtggaaaaaagcttttcttacaggatatatgaactaataatagttatacgactgcttcggatttgtcgcgctccccttggataagtttaatatgattttgtacacattaattaattatcttaataacagacaaaatagaaggaagccactaccgtcctttccagtgcatcagatgaatcaaaatgaatcaaagggctgggcatggtggcccacacttgcaatcccattactttgggaggctgacaccagtaaatcacttgaggccaagagttcaaaaccagcctcagcaatatagtgagaacccatcactacaaattcctttttttaaattagctggacatggtgacccatgcctgtagtcccagctacttgggtggctgagtcaggagggttgcttgagcgcaggggttctagactgcagtgagttatgatcaccactgcagtccaacctgggtgacagagtcagaccttgtctctaaaaaaataaatttaaaaataacattaattaattaaaatggatcaaataaacacatacatattgtggagattgtgagaaataagccttgttctatgtgtctcaggtttacctgaactccaagtagccctgatgactatatggcagttatcacaataagcaacagcataaaggactttgagaaatcaacagatcttatttttaaaaatgaattttcttaaacatgtattcactcagctggcagtggtggctcatgcctgtaatcccagcaattttagaggctgaggcgggcagatcacgaggtcaagagatcaagaccatcctggccaacatggtgaaaccccgtctctactaaaaatacaaaaattacccgggtgtggtgacacacacctgtagtcccagctactcgggaggctgaggcaggagaatcacttgaacccgggagtcagaggttgcagtgagccgagatcacgccactgcactccagcctggtgacagagcaagaccccatctcaaaaaaaaaaagaaagaaagaaaaaaagaaaaaaaatgtattcactcaatatgattaagtacctactctgggctagatattaattagatcattgagagtgtaggtgtaagccaggcagccagacatcaattctcatggacttgcattctagaaggagattgaagagatgaggcaacagttgtagagaacaccttactgctcatgggatagaaaattaccactgggatgagggaaagttgctacttttgattgtggtcaagaaaagcttttcaggagatcacccttggcttgaggctcattgataagaagaggccagccatgcaaacatctgggggaagaggaaagagcaagtgcaaagatcccaaagccacagagatgtttatgtgctgggagaacagaagaaatcccagtgcttgtagtgcagtgagcaaaaggaagtatgaggccaggtaaagtaagaaaggttggcaagggtcagatcatggagggcctttggggctgttgtaaagagtttcatttcattctaaggcaattggaatccatttgagaattgtgagcgggagagtggtagggaccaatggccagtatgtgatgacaggtaatgtgatctatgctcctatttttaggggcaggcctccttaaagatccatttattgatttaacaatattaaatgaaagttcactatatgccatgctatagtgttctagggtttcagcagtgactatgacaggtctccagctttattgagcttacatcttattgaggagaggcagacaaaaacgaataagaaccgtgaagaaaatatagagtttatatgataaaaattaatgggatgaagtgctggaaatttcactggattggagaccactagggctacttcagtaattagttttgaggtctcctgttgttgtttctcagccctgatggtcaagaaattctttcctgttttgcttgtttccatttctgtctactgctttttattctgttgtcctcttaggtagtacacagccctttttctgaaagtcttatctctgatgaagaaaacactttttctcttcaaacagtaacttagtcttttgctttatttcctagagactctgatttcctaaagtttttcatatttgttctatgtattcattcttttcattatttttgttgctctccacataaaaatataaaaacttatcctgtaaagaagtattaatttagacatcatttagccagaatatagcagaagaattattttacagttcttataaggtacctactaatcctccctcctccctgccccctccctgtcttctcttttctcctttccttcctttctttttctcctatcccaaaatactagttaaatagtttctctcctttaaagtactttaaagataacttcttcataatgaactcttgtgtgcataagcatttcttttcctgttaagaagcagtggacaatttttttgttttaaagacattctagaagattttaaaaaattattgtggtaagaacacctaactgtgagatctatcttcttaatagatttctaagtgtacaatacagtattagtaactgtagacattatgttgtgcaggagatctccataacttattcatcttgcattactgaaattttatacctgttgattaaaactaaagatccttttcaaaaaatacttcttaagccatggcttcccctggttgtggactgtaacccttgatgttattgaccatcttgggattaagttccattaagaaagacagtgttagacattgtggagaaataatagcaaggaaatgtttgttctggtccaccaaaatattgagggaccaattttaacctccacatcgttccttctggggttttcaggataagaaaaaaggagctgtggcttgctgctatttcagtagtcaaataaatatttttaaattgcttgtttcattagtaggatgtttttctgaaaagacagagtatatacccctcaggatatttctgccaatgtgttaaagtatttgtaaaaaaaaataaaataaatggctttgtagaatgttcttgtttcccaaatggctactgattttcttaagaaaaaggtagcagcaatttgctgaaaaacaaaaatgaccttttattagtcaagagaaataagataactaatttagattgaatgtgtttatcctaccagggtccaaaatttctattttcatgtattctccttttcttataaaggctccctttggaactatctaggaaggacctgccaacatccttgaacagtgaccattcagtctctactatactagaacccatctgatgatgaaattttgactatatttttggagatttcattctgtcattggatagctctaggaagtgcttttacaccttttgagctctggtcttgagtccagtaatttttacgtatcagtccttgttctgccttccaaaaccgcataatcctccttcaacttgacgtcctttatgtgttttgagatggcccccatgggcttccaagtgtttctggctaaatatcctgagctcatacatgtgttcttcatacagcagcactttgaggcctctctccatgctggttaccttcctcccaagtctgagttttaatgtcctgtttaaaatgttatgaacacagctacttagaaagctgtgcagtcatctcagagtagaatcagacaaggacctccttcacacgaagtgcttcctgtgaggacctatgtaatctgctctgtcttctgctatcatttgtttcttcccttctctcctttgcatcatccactccagcgacactggtttccttgctgttcctcacacaagccaagcaccctttaacttccttttaaagccctttacccttatttcctctgccttgaactctcctccttcagaagacatggggcattctccctctctgcactcagattactattgctgtcccctcagaggggcctgcccttcccaacccattctaaacagccctcccccatcatgactaccccttgtcatgcttttattagcccttgaaattcccagacattatgttatcattccatttatttgtttattgtctgctatcattattagagtatgatctctattaagtcaaggactttgctagttcctgaatgtcttttcagtacccagaaaagggtctagcatatagaaggagcataataaatatttgtgaatgtattgactaatttactatccatgcagattatctttaggcagaggatagagaataagactttttagtacatatttaacagtgtgtgtagccatccatacagtaaagaattctgcaactcacagtcaccccaaacagcatttgagcttttagatactatagagcaacctgtgtctgtgtgtgcatagatatgtgtgtacatgtacacacttatgtatatacatacacacatacattcgtatacatgcgtgtacatttatgtatgtattatgtgtatatctctgattaaatgggtgaacatgtggtttggggacccgtgtccaagccctctagattgtagaagctggaaatgacaaaagtgaatgaagtgagggaaagtgagccagcaggactgctcactgcacatgaatttccaaggatacagttgttcttgaacaatcacagtcagtatatcaaaataagcgctttattgagtagggtaaaaggagttgctggaaagactgtaaattctctcgcagaacaaatgataactgagcccaggagcccttttgttcttgggggagggggcataaattccctgaaagtatctgtcgcagggaattgctctgcattcatcatgtccgcctcctgcatcattcatgaatgtcataagactctaaagaattggcacttcatagtgaagatgattaaatagccactatacttgtcttttctgctgcacagtgctttttaaaggaattccatttaggttgtagcatgccccttcgaatcccttcgcatttcttgcaacctgaggtctctgacatcagaggaaggcccttgcttgttgggactggacagagctggtgggctagcacttcagtttgcttattttcctttgatggagacaataggatctggaaaaaaaaatgccataaagctcaaagcaaatcattttttagggagtatagaaattgctgtttagattctgcagtgaatgagctgtaatttttttcagatattttcacttctcttatcacttccttgtggactaagaataatgaatcagaacaagacacttttatatatgatttgctattttatatattcaaatataaggcctcaagtcattttgtagccaataaagcctatgtatgcagtgtaaatactgatgtaacagagtataagatatagaatcggccaggcgcagtggctcacgcctgcaatcccagctctctgggaggccgaggcgggcggatcacctgaggtcaggagtttgagaccagcctggctaacatggtgaaaccccgtctctactaaaaactataaaaattagccgggtgtggtggcaggtgcctgtaattccagctgcttgggaggctgaggcaggagaatcacttgaacctgggaggtggaggttgcagtgagctgagattgcaccactgcactccagcctgggcaacagagggaaactccatctcaaaaaaaaaaaaaaaaaaaaaaaagatatagaatcttacttctgtcctctcccctgcatgcatttcttgtcatgtatacatattctctttctctctctccctctctccacacatactcactccctctctctctctaagtgccctagagtaattcttacttcccaaacagcatccttaagtgacagagtgcaaatgattgaattaacatttatctactcaggtatatgtagaatctaaaacagttgaactcctagaagtacatagtagaatagtggttaccagaggcctcaggttgggggttggaaggagcagatgttggtcaaagggtacaaaatttcagttaggagaaatacatttttgagatctattgcatagcatggtgactacagctaataataatggattgtaaattgcaaaattgccaagaataaatttcaaaagttctcaccacaaaaaataataagtatctgaggtgatggatgtgttaattagcttgatttacatcattccacatagtttacatatatcataacatcacattgtaccccataattatatataattatgatttgtcaattaaaaataaggccaggggcggtggctcacgtctgtaatcccagcactttggtaggccgaggtgggaggatctcttgaggtcaggagtttgagaccagcctggccaacatggcgaaaatataaaagttatctctactaaaattataaaagttagctgagcatgagggcacatgcctgtaatcccagctacttgggaggctgaggcacgagaatcacttgaacttgagagacagaggttgcagtgggccgggctcacgccactgcactccagcctgggcaacagagtgagactctgtctcaaaaaaaaaaaaattaaaattaaattaaaaatataaagttggtcaataaacaaattttcataagcacttatgttagaggcaacagaaagtatttagagagaacagcagactgtaattaggagagaggagctctgatttgtttccaccagtcatcactgtcacctcagacaaattctgtaacttcccagggcctcaggatttgcatctgcaaatgaggacacaaatggtggctccaggattctccttccactcttatgacacatggctttatgtgtcaggaggggctcagccatcaggagggaacagaaaaaaaaaaaaaaaagctcaggatatcaccactatttctgaggaactcataatttaatgatctctgcaatctctaagctctgctgggaaatgagctccagcataacacgggttctgggtctgtagtggcatcgctgactgaaagataggtcatttttaaaatagtggtatgacctttggctgtgatttcctcataataaacataatatgatttttgtgccaattttctgttaattatgggcttctcctaaaagtttatgagtttaggaagaatgttctttttaaagtagaactttggacacatgttaggagatccaattaaatagatggatcatggaaattgggtcatcactggttgttaccagtaagaggatcccttagagataatgtgttcacctgttaccatagaagtcttatgagctgtgcctgtaagttaccagtggcttcaaggcaggtagaccttttgagctttaatttgttcctagaaggaacctcttcacttctcattatccagactttccctagaagtgggagggctgatcaaaatgccagccttggccctttgcattctgctgctccagccatgtgggtctgatttgttcttactgctggtttaagagagattaaaaggagcaaagctgttctctaagtttcttgatctgcaccgtggcagccagagtcagaggaaatggagacaatgggaaagggactaaatcctagagagtgatgtgtctgggatctcgggaagcagacccagcgttcaaatgcaggcttcaaatactaggtcattgctttggagaatcttcttgcacccaaaacaacttgccacaacctatgtggcccaatgtgcagcaaaagctgagcctgagataaggacagacaggatatatggctgaataaagaactttcaatttccttttcttagtagacggacaagtatcccatcattaaaaaaaaatagccacataaaaaagcagtttccaatctaagtgcacatggggtatgccaaaatctttgcacatgattgacttaatcagaaggcccaatctaatggagagaagtactgtattaatttaaatatggcaggtgctttctaagtttattgcaagagttaaagaccaattatcttgtatttttccataaaattgcattttctaaaaagagactggtgtgtctgaatacatccatcataataaatcttcaagcttggatggaagtgactgctgtttatttgcagcatgtcatatctgtactattgaatcaatgctaaagttatcatattagaactaagatgagggcccggaaaatgagtttttatagactcacagcgtgattttgtgaataaaagcataagaccaggaccaggtgtagaaagtgccttattccagggcctgatgacctggaaggcaattttcaaatgtagggattatgcagtcacctctcacaaggtccagggtgaagaacaagtaagaaactttctattttctggggaataggcacactttcaaaggaggaagaggtattgagatgagacagagaaattgagatggaaagtgtatttgaaatatgtgtaattaggcaggagaaatgagaatcacaaaacactagcaaaagtcattgtcttgctaaaaataataaaggaagaaaaacaaagtataagctaaggctttgaaggtgataaaatattaagaaattttgcttctgtatttataggaaatcagtttttaaaagtataaactaattactaatatattacataataatgcagtgatgttgcttgtccatgataaaaggtaataaataaaaatttgtttaatgaataatgaaaaatagctttcacatttggagttgattttgattcattttgatctcttatgtggctcttggctgtagactatctttgttttaagaagagcaaacccatttgtcctaatattcctggagaattatttcattcaaaagaataaaaatatcagccaggcgtggtggctcacacctgtaatcccagaactttgggaggcagaggcaggtggaacacctgaggtcaggagtttgagaccagcctggccaacatgctgaaacagagatggtgccactgcactccagcctggacgacagaacgagactctgtctcaaaaaaataaataaataaaaataaaagtaaaaatgtcatgtatataatatagagagaggttcaaatacgctaagagaaaaagaagccaagatcatgtaagcattatgattacaaccacatgcagactatgtttttcttctggctgaaggccagagagaaaggcaagtagctgtatattcagtgggtgttatttggtcaaatcgatttacatagtcttgcaggtcttccaaatactaaatattaagtacttggaaaatagctgagcaaaatctgagtgcattctatgatgatacagtagcacagtcttgcttgggacttaaaatcatggttgtttatggtcatggagttctaaccaaacccttgaacacaaaattcagtgagctcaaaatgaaactaacactttcacattctaatctgtatttccttttctatctactattttatttgtccaaatttgaaaactctgaaccaaccccagatccttctttttttactccccaaatatcaaatagatcacaaaaggcttttattcttcatgtctttcatatctgcttcccctgatttctcatgctcactgatccaattccaattttcatctctcgtgtctggggtattgcagcagtcttcctctaaatccccatggtcacacattatcctccctccatcttctctactgcagacaaagttatttttctcaaactgtgcattttcccactgatcaatgtagtcattctccaactttttaaatactaaaatcactctttgaaaaattgatatggaactttgtttttttttttaagacagagtctcgctctgtcaccaggctggagtgcagtggcgtgatctcggctcactgcaacctctgcctcccaggttcaagcgattctgttgcctcaaccttccaagaagctgggactacaggtgcatgccaccaagcccagttaatttttgtatttttagtagagacggggtttcaccatgttggccacgatggtctcgatctcctgaccttgtgatccacctgcctaggcctcccaaagtgatgggattacaagcatgcaccaccaggcctggctacttttgtatttttagtagagacagggtttctccatgttggtcaggctggtctcgaactcccaacctcaggtgatctgcccaccttggcctcccaaagtgctgggaatacaggcatgagtcaccgtgcccagcccaatcatatattctttaacattgttgtattatttcccagcagtttgtagcttattttgttttaatgctttattttcctagtaacaaattctaaaacgatgttgaataatattgtgataatgaacatctctattttcctgattttaatggcaaaggctatataattttgccatttagtatgacaatactttgctgttgataatctctatcatatttagaacatcttaattctatcttaattaaattttagagggaatggctgctgaattttttccaatacttaaaaaaaatcctgagtaaaattatattcaaattctactttaattaggtaaagtaatgaattttgttaacagatatctttaagctgaaatacactacttttcatgtttctgaaatcatatttttcttctaatataccattgaaatgctattcaaaaaatgtttatcaatttttgtaagtgaaattaaagtgttttgtttttgtgtagcatatttattaggtattggtattaagattatgttggatttacaaatgaattggaaaatttcttagtctgtttgggccactataacaaaataccataaactgagcagttttgtaaacaacagaattttgtatttcatagttctggcggctgagaagttcaagatctaggtagattgtattggtctctggtgagaatctcttttctcttcataggcaacatcttcttctataacctcacatggtgaaaccttacatggtgatgtctgttttataagatcgtttgtccccaccatctcccaaagaccttaccctataataggaacacattgaaagttaggatttcaacataggaatttgcagggggatcataggcattgcagtccatttcatgaagatttctaaccttgcctgtagtatggtataaaatggagtaatttagaaattatctcttatcttaaaagttatgttgaaaggtagatgaaaattacctgtaaaatcacctagatctgtattttttaattattaaaacttgaatctcctttccaatggtgtctatggtcattagcctattgagtttttctactttttcttataaatctttgacaagttatactttttcctagaaatgatccattccttctgactttcaaatatattgctttaaagttgtacaaagtatgattttatatttgtaatcttttctattgtgatggttatataatttctaatgttctatttttctcctttagtttttatttctgtttttttagaggtttatatattttctttgacattttaaagagcaaactttgggatatttttaacttttatattatttcaaatattatcgggtaaatttcagcttttatttttaatcatcaaaaaccatcttatttatcttatttttgtaatagtgcattaaggtgaaagttcagtttatttatgtttattttccttattattatttgagacattttcttctgagtttctgagtaaagctttatctgaagtttatatgacttgatatataaagctgtctcttcattaatactctaattattaggttttggtcttttttactgtatattttaagattgtatgtataaagagtactgtttgttcaataacttaattatagaaatcattaaggatttctttgtcaacaagaatattatcagtttaacaaatgttccaatttgaaatatatacgaattactgaatatgcttctttggtaaaattcctgagttgcttatcacccaatcatcatggtcattctttgccaatttatttaagcacttactgtgcccctatgtgttccaggcactgtgataggtaccaggaattctttcatatccaaactcttctagttgtgaaagaacccaaatttgaactagcttagactacatgagttagctattaaaagttgtgtataagaaagacctggccaggcacagtggctcatgcttataatcccagcattttgggaggccaagacgggcggatcacttgaacccaggagtttgagaccagcctggacaacatagtgaaaccctgtctctactaaaaatacaaaaattatccgagcatagtggcgggtgcctgtaatcccagctactctggaggctgagacaggagaatctcttgaacctggaggcagaggttgctgtgagccctgatcaccccactacactccagcctgggtgacagagcgagactctgtcaaaagaaaagaaaggagaagagaggagaggagaggagaggagaggaagagaagcagaggagaggagaggataggagaggagagggacaaaggcacaacttcacaatatagattataaaaactaggtattttaaaaatgataagatttttctctctgtggccagatctaaattcaacagcttgtctttactctttcagtcaggattgattttctcatgactttctccccataagcagaaatgtggccacggcagctgtgtgtctcttatgtcacagttttatcatcagagaggcactgatggagtgtttctctggttccaggtttaaaaaaaaaaaaaaaaagttcattgaagttctctagcctagcttgggttaattgattacaccttagtccatctgctgtatataagagcagaatcttttacggacatgacaatttcagttcaaatcacatgataaatatggaggaaaataataatttctttgtgaagaggcttaatgtttcaagatagagacagaggatgtgctgcgccgatagaataatgaaagtctcctatagtcaaaaaacaaacaaataaacttgaggcagattcttcacttcaaggtgctcaccataaaatggcaatactaaactatttctagaactctatatagagtgcctgttagttattttgatcctgttacaactctttcagatgatgaggtagaagtgttgtcgccttcttaatcatggagaaactgaggctcagtgaagataaatgattgttttagaacagaagcatggactttaatagttgggatttgttcttttcatccaattctgacctgggttctatgattaagaggtatgtgtctcatagaatcaaatcatcacccttcaaaaatattagccagcttttccagaaaaatcgtgttgtatgaattaaagccacaaatacaccaaagtcatccgtttacagcccctggcctcttgtaagtatgaggatcatataaatcaggcatttaaatcaaagcactggaaataagcaactgctttttatgtgtattgtttttccagagaatattcaatacttagctaccccttcattgttcttattaaaaaaggtatttcaaggctgtgaaataaaaggaggaaaagaagacaaatgtgtatgttccaaacttctcctttcctctaatcatgtctcatgtcatcagaaggaatgcacttctgaaaaataaaatgctacagaaaaggctgctgagtaattataaaatgattacttttgtttttcctttattcatttatattttgcttatgaacaaatgtatatatggtctttgcttttagttaatgctctgtaaaatagaataacgtggctatccttaaagatgtcacgttgcttttctgttgtacatccctgttaggttaaatctgagatgcacttatctatttatttttacaaaaacaatttgcaatgtgatttagaaatggaggagtaacataaaacaatttgactaaaaatgggtgtgattttcttatctgagactgccaaaaattcaccaaagaaaaatcattcaaatgtctttgtggttaggtttcttttataaattgaaagttgtgttctatttcatcatgagagatgctgtgagctctaactgatgagcatttataaaatatttccacgttgagatgaaatgacaaaaaggcaagatgaattaatgaacattgtatattcttattcctttattcccattctactccatgcctgaatggcaacgtgaagatatgtaagcataggtaagccaggtttcattgattagttcaacagcatttatttcctgtgcattcacagtgttgagagataaataaattaaacagccctggcttccaggagctcgtagtagagaagcattctggatttccattttgtttgacaataaaacttaatatttattttcttaagcctgaatactgtgcaatttcctagaacttattttgttttgctatataagaaactagcatggttatgaaagttaagttggctgtgagttaatttctcacatagacctcattataaatttacccttcagaatttagagttgtctgagtgtggtataattaatcaggaatggactattatctgaccttactttattcactttataagaggacaacctcatgtaaaaccactgtcatttaagtaagataaaatgagtacctctatactgccagttgcattgtgaaaggattgggttttcatcttgtttgctgtttttgttttgtttttaattttggccacatattagaaagccattgtccttctttccatcatcatcaggtaaatggtgagaatattagagatacagtttgacataatgaaaagaatgtagattgttgagttagacctggattaaagtcctaattccattcgatatttggtaaaagatcttggcaagtagttttaccttattctatagcttccctcatctttaaaaccaagatagtaactgttatgagctgaattatgtcccctctacaaattcagatattaaagtcataaccctcagtatctcagaatgtgactgcatttgaagatagggttttctgaatgtggtgtaattcatcgggagtgggctatttctgaccttgctttatttttcagtttcagaggttattttggtgggccctcatccaataagactgatgctcttataagaaaaggaaattagggcatagattggtacaaagggaaaaccatgggaagatacagggagaagatgattgtctacaagccaatagagaagctgtagaaaaagccagcactgctaacactttgatcttgaaattctagcctccagaattgcaagacaatgaatttctgttgttaaagttacccagcctgtggtacattttacacagccctagcaaactaacacagcaaaaaatatttcaagtgaaaaatatagagttttgaaatattatactgtatactaagatatataataaataatatatacacatagctggtattagtattaatattgatattaacattagtctagagttagtattgccaaacagtaccaaagagtttgtgaaagaaataattgtcccaaaggaaaaacaatgagcttatgaaaattcctttaagcaagagggaatttgagtgtgtccgtggaagctttatttttaggtcaattttagcgtctacagcattgcgtattctaccactaatcatctttttccttagcggaagtatcctgaaatttgatgagtaaaaatgactttcttttatatttttgtgatataacagcttctaaagtaatgtgtttctgaaaatgtcattacccctaagacttacttacaaagggtcatgatgtgtttgtcaaaactcatcagtgtgtccagaaactatgtgcgtgtgtattttagtcaaactttctgggagttaaagtatatataaggtaacacagcaatggaacatcgcaatagttggcatcagatttgcaaatggcacaattatttgtttcctcttcactggtccttgaaaaatacataatgttcccatcaaaagttccagccaagcatatttgtaagaacagggtttgaacataacctattatatcatgaagaatggctctcttccatggtatttaccaccagaattaagtagtggtagacttttttttattcatggaaaacatttagtgaatgggtagaatgttatttgttttatatttttctctcatcagctcctttggagactttggcatcgggcagaaaaagggtctcactctgcacaccaatttgagttcccatgttatcaaacagatttaatgctaaactaaactggtgtttgttctgcttataagtctttgagttgaagccttgtttctggaatattgggacatgctctgaaatgttgcctctgtagatcctagaaagtaatgatgttttctgctttcatgcgatttagttttaattattcttccttcaacagagagaaatagattgccccacagggagggaaccctcaccttgcttgagcattgtctaagaaatggctttttctcatgatgtacttaactgttaggcaatgttgtcagtttctcagcttactgagcagcaaatctgctcatttctttgccaaggaaaaagaatgttcttaaaaatagatgaactttctctcttaatgttcagtgcattcaatgttgctttatttaaggctgctttatcatcagttctggtgtttatttcaaaaaattcaaagtagataaaacagatcattcactaaattccatctattcaataaataatttgcagagctgtttttaaaatgtgtatcatttaccctgtactccctagtggctccctctgtaatgcagaggccttgtttgcagtttttccatctgttattcacctttctcccctccttttggagctcttgatctctagggatgtttttagggagtctttatcccattagtcattgggacagctttggagaagagggcatagttaagaaagggaggatctgattctattctcaactccactacttagcaacagatcaagttgtttaatctccttgagcatcaattttcttttttattaaaatagtaaccaaaatatttgccattaatatttcagtgagtgttgagggaagaggcatcagatgagacactccaaaagaaagcaatttgaaaatcatttaattctatggcaatataaggcccagctgttataaaatagtgaacattattcactcctaaaacagccagagagatgagcggcagaggaaaaccatagaacaaactaagtaaaagaaattgagaaaatgtattctttggaaaatcagatattacgagatccttcagttaaatttatgtctctatttgctagaagagatatttatcagttccaaagcaacaagcctttcccttttggttttattagctacatggtaattgatatgaatttaaaagataggtttaatttgatagcaataactacatctactggcaggatatattttatgtcattgatagtccttttattttccaaaaggatttaccagtttatagtaaaaaaacacgaatgtggataagcttgtgaaagagtaataaaaaagaaataaagaataagaaacctgaaatgatagaggaagaccaacataccttaccattatgagattttatactaagtcctgaggcaatgatcaaagagaactagagcaggagactgacatcttgtttctcatcctagtttatctatcatgtactttgcacataattgttatacttattttattacttaatttattgttctacttgttataattgtccacaagtaaattatccagttctccttaaatttaactctcagaggccgggtgtggtggctcatgcctgtaatcccagcactttgggaggctgaggtgggtggatcacctgaggtcaggagttcgagaccagcctgaccaacatggtgaaaccccgtctctactaaaaatacaaaattagccaggtgtggtggtgcatgcctgtaatcccagctacttgggaggctgagagaggagaatcgcttgaacccaggaggcagagtttacagtgagccaagatcatgccattgcactccagcctgggtgacaagagcaaaactccatctcaaaaaaaataaataaataagtaaaataataaatttaactctcagatttcccctgggagatgcttccaaaacttgttccattttaacatcaatagaattatttgagggaaggctattttgatatatatatatacacacatatatgtatatatatatataaaaaaatacatgaatgagaaaaaattatattcctcattctcttaaagaaacgatagatcactcacttaattagctatatatatatatacacacacatacatatattcacatatatatatacacacacacacaaccaatattgtattattgtattttagtacttttattaagccattttacctgtaattatttgatggggtaaataataaatgaattctagtctattgtattttttaactgaaccttttttgtttttcacacacatgcatgcacacacacatagacaaatatatatatgcttatgtatatgtatatgtgcatacacaatgaatgtatatgtatatgtacatacacatatgtatgtatatgtatatgtacatacacatatgtatgtatatattatttgtatatctaaagtgaatcttaagacaagaattctatttctgttgatagtctcccagaaaaagtaatatgctatttggctataagactggaaatagaacccatgccataaaggcagggccagggggtttctaagtcaaaacaacaacaacaataaaataattacctaagtgatcctaaataaagaaaaagtaaattgccatcaacaattatattctaatacaataagcaataaaatgcacccaaaatttaagaaccttggagaaatatgtggatgagaaaaaattatattcctcattctcttgaagaaactataggtcacccacttaattagcttgttccgtaactttcacccaggactcctttatgatcgcatggaagactgtttgatccttttcttctgctggatcaccatcccaagcacacactcacagaacacataccaaaacactctgtcaatatcaccatcagctccatcacagtaagtagttagccaattatgaaaacaataagccaggcccattatttgcaggttgtgagttaaaaaaaaaagagtcatccttgttgactatttgaagatgagatgtatcctcttaatctttgttagtggtgactgtgtagagatttcattcctggaatactgtgttggttaaaactcagcaaagcaacctcagctgcttgcaaacttgcaaatcctgcagtgttaaatggccaaaatgctactatagcaattttttcttcagttgaattggtcagtttttgccaacaaggatgaaatttacatgattctgaatataaacataagtagtatgatcttgcatcagcatactgaacacggtgagaaaccagcaatcagaagtacgaggctcaggggagaaagcatgtaatgtggtatagcatgcctcagaaatgaaaatctttgatgaattaagaggaggttcttatagttcccaggattttcccaagaagttgatttgtaatccacattttaaagtaacacaattaacttttttatttgaatatgtaaaacaaaataattctatgtttcctgtaggactctaggcattttatattaaaattaacacgaagtatgtatttacctttaaaaaccatgcaagatggcaaagcatgaaatgtaaagagaaaaaacaataacaacatcagagtagaaagttataattgttaattaccttcctctaatgtcccacagtattggactatgggagcattcagggcctttattcactcttaccagcaaatactttaccaagaatagatattttcatatttttttcttcatagcaaagtaatcatatgccaggtactttgtatcttttatgctttcttcacctataaagttagaatcatctaacatagtgacatcataaattcagaataacaaaagcaatacaaataattttaaatcaaatttttagtctatcctatcaaatattgtcatagtgaagttttgttttttgtttatttaaagattaaagccactgtgactttctaaccatatataagaaattatatatttatgtattaaaatattcttctcctttgtattggagcactgagaattactggtaggattgtggatgaaaactacaagtaaaatgcttaaagttgttgatatggtgagatggccagacaagcttttgaaaacatgccaaatttgggggctgtgactttgttttcattctgctttagtctgataaaaagatgtgaaaagaactaagtacagacaactgtttgccccattggtgtagtttattgatacagtttattgtgtaattacattggtatgtggtgaaaaaaggctttcagaggtagaaggctcaggctggagacttgaaagtggtactatttaaatcagataattgagtctctgtttccaaatctgtaaaacagtgttaagatataaaatatcccatacaattgttgcaaagattcagcaaatgaatttgaaaatattttgcaaactgtaaagcagcatgtatatgctgctatcaattttttgacttgttatttttgtagtgacaaaattatttcctgatagagtatgaatttatctctgtagcagaatccactatatatttaggatagaaaagtaaaagatttttataaattgccatgaaatgtcacaggctgatttgcattttctggtgattctatacattaatcactgagtaaccttcagttttccaaataaagaataaagagagtggtgatgacatttgtaaccatctacagaggaattatttaaattcttcacagatggagcgatatcaagggtaaatcattatagccacatttctaattttaagaagctttgagggtgtttgtggatggtaggaagtaaacattgttttgcatatagaattaatcatagactttgcataccacaattccaaatcctccagatgagtgtagagggctttcgagacaccatcccctaaggatcgagaaattcataaaaggaaaataatgttatgctacatgtaatatacaaattgagcaaattggagcaactagaatagtgacctttcaaagaagacaaattagattctgtatgcctcagaatttaatgagtcttagtgctttaggaaggatgacatatgacacatattcttaattctagtctcacaagagttaactttattatttctcaacaagatgaataactcacttcttctttggtcaacataattctacctaatattctctgtaaactagctctggaaatacatgcggaccagtgcttgagatttttagtaaatgtaaaaggtatctgaatggttgtataatgctgctttaaaagagttttaagggttggaacatggtcactgagaaatacacaagaaaatctgttaccaaatgtgctctgaattttgagatgagtaacccgtggaagtattcgctatgggtaacaccacttgcctaaaaccacagaggcaacaaatggcatagcctttctggtcaccaaatctaaatgattttctccaactgaaattaaaaatgtgtttcttgaaatgtactttttataatttctgaattacaaatattttctttatttttattcccatttgctttgtaagtagttctaaattaatatattcttagtaactcctgagttcatatggataatagtaaaaacacaagtaaagagtaaacatactggtaaacccactaatcataattgacaactaccacttgtcatgttcaaatctcattatcctgtgatgttttttctgtttcttgtatcttcttcctaagatttagtttgaaaaaggaaaagaaaatgtatttaatgccagataaataccaccactagggaacaaaaaaaaggtccatttttaaaggactcctggaggccaggtacggtggctcacgcctgtaatctcagcactttgggtggccaaggcagtcagatcacaaggtcaggagattgagaccattctggctaacatggtgaaactccgtctctactaaaaatacaaaaaaattagccgggcgtggtggcacgtgcctgtagtcccagctactcgggaagctaaggcaggagaattgcttgaacccaggaggcaaagggtgcagtgagccgaggttgcgccactgcactccagcctgggcaacagagagagactccatctcagaaagaaaaaaaaactcctagaaatcatttttgttaccatgtttatagcaacacaatagtgaaataggcaaatgcatttagtcacataacttggttttcttgggccactgctttctttcctgtgggagtgggagaaggtacaagcaggagagacatgatgcctttggactgctctgttaccttcagttttgtaaggctcctggctccactgaccagattatgctgatagataagagataggggactagttttctaccttgtgcctgtcctggccaagatgcaaaattaagcctactgttgaggaagaccagaaagttgtttattgcaatgtacccaggctcccagacttaggatgttatttaccctccaccgttatgcagcgggaacttaagatgttaagaacgactcttaccaacatctgctttgttatgcattcattctgcctgcatctttaatttggggtgatagctgccttcagaagctttgggagccgttcctctcagtaaccaaatactgtcccatgggggacatttcctctctgcagctgttctgtgtagggtctcaacagtgtgctacagctggctgtatgcaatgtagtgccttgatgtctccctctctccttgcttttgcagctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagtgagtacagggccttggcctggattttcttatgttactggtggtctgagttagtgattcaggtagacgcagcagaacattctagatcaatatggcaaaggtgcacatgcttataaaaattgttttcagatgtgaaccatcatatttacagggttcctgggggaaaaaaacttaaaaactcttccttcttccccatgtatatagggaggaaaaagaaattcattctttgcaggctcccttcccaactgtgtggcttggcctgtggcagaatatttagcagacttctagggtatatttaagagatttacctggtgtggatcttacctggtgcaagcagcaaagccaagtggaatgttaacaatctcctaggctgggatttggcaaaccttctgtaaagagacgtatagtaaatattttggactttgcaggtcagatagtctctctcagagctactcagttctgcctttgtaatgtgaaggcagccacagacaatacatttttttgaaatgcatgagactgtattccaataaaaatgcatctataaaaacaagctgcaggccgtaatttagtgacccctgtcctaggcttcaagcatcactgtaagagatgtaataaatgtgtgataaaaactgagaccagagtgccagagtgggcggggcaaaagggaaacagaacagtgatcaagagttgagtaattcatgtgtattgcatactcaacattttgcttttggtcttgtacatatgcacttaatagcactgcacccttaatccctgtagatcataagaacacagcaaaggctaagaaattaaaaatgatttagaagaaaaaattcttttgttataaggatggaaaatatttttacagcaacaattaacccattttatcacctgtgcagtctgcagttaagaaagtaggctaaagagagatatgattctcatccataagtacccaaagtgcagtctccaagagcaaagagaggaattgttctcattagttagcaatgacaaggctagaaagaatggatttaatttggagcaataagaatttagtttaaatagcaggaggaaaaggcagttaagaaaaaagatcaactggggattactaccaacctccaaaaaggaggaaaaggaacattgattaggaatctctgaatcagagttttgctaatgtgcaggtgtatagagagaagcagaggatacaatttcattgctggtctctggagttggagatggctggccggaatcatgcatgacaagcccagctcccacagcagtgcgcatgtctgacacttgctcttccagcatgccttggaaatgagagcagcttaaagtcctaggcttgagctggaagtcggtctagccccagtataagccagatcagggcaagactctgcttaggagcttaaggaagaactggttagagatgatcaccttcaaaatgtggtggaggagtcttgaatagagttgtgaacttttcaattttttctcagatgcttcaggaaccatatggtgctatgagcctgagctaacacattttaaaaagctatgccaaggagcaaaaagaaaggcagccatacttactacactttatctttatttggcctctaagaaccaccataatttacaaaactctgtgagatttatgctacatataacttaatgactatttcatggcagctataactaggctgttattaccagctcacttgcatttccacagtgatttatcttctttttttgttcattgtgactgcctaagaaaaatatgatttggcacagacatgagcatctttttgagtcaaatagtgtactattgttttatccattcctgctcattcatgttttgtagaacatctccacttttaagagagaggttttcctattttctgatggtttacttgaaattagcagtgttttaataaaattgtcatgcagattgtggtaacttctaggaggaaccagaacattccagtatattttaatataccattataaagctctgtcatttctttggggtctttgaaaagtgaatactctaaacatactttgagattcaggtaacatccattgtgtgcatttattagtgtgtgtattctgtataagcatacccattagatttgacatagtataatattattttctttgtatgagcaaaattaccagacattttatatcaaaatgtaaagagccccctgggatactgtagacacttgggtgatacagccgattgcttaaacgttctgtgaaagcccagtagattttcctccaaatcttagattaggaaatgatgtcacctgaccctttcagaaaaaaggaaaaaaggatcctatgctgtggggaatctgtgtgattctagagtgaccctgacatgttcatggccctctcgagcaccaggccccttcatgggtctagtcatttgaagccatattttatttccttgcagattatctctttgtctactctgaagaaggcaggtttctcatcatacttgaaagtaaagaaatctaagtagaagactaaatggcttaattatgaaaccagctttttgttttggacatttaagtagatacatcagggaaacaaagccataaatacttattaagatacttttataacttttacaatctgtaaaaggtggttctgtttgttgaatggtttgttttcttgtactaaagaaaattactgaagagagaaagagctttggggccattaatgaaagtggaagggattgagcataaggcagaagatgctatttctccttacagtttgcctagaagagaaacctcctgggaaaaagaaaaagtgatagaagacacaagggggagatgaaggcaggtggttttctcagtttttttactgctataacagaatatttgagatttggtaatttataaggaacataaattaatttctcacagttctggaggctgggaagtctaagatcaaggtactggcaggtctggtgtcttgtgagggcccagtcttcacctctaaggcgagcactgcatcctcaggaggggaggaaccccatgttttcacatggcagaagggcagaaagagtgaacccactcttgcaagccctttttaggatagcattaggcagagccctcatgacctaagcgctttccaaaggtcatacctcccaacactgtggcatcggtgatcaagtttccagcacatggaattttgggagacatattcagagcatagcagcagaatatatttgcagcagaatatattccagggataagggaagaggacagggctctgcctaccgatgtgcttcaacaagggattacatgggggcaaagcttcattctttgaatatgagtgttctttataaaataacaacaacaataaaaacctaaagtactttggtgctacttgtgagtggtggtcaggctagtaaagttggtcaaaaacaaagtacaaactccaaaattagccagcggtgtatatgtgtgtgtgtgtgagagagagagagaaagagagagagagagtgtgtgtgtgtgtgtgtgagagagagagagagagagaaagagagagagagtgtgtgtgtgtgtgtgtgtgtgtgtgtgtgtgtgtgtgtgtgtgttggggagaaggagaagagacaaagaaagtttgtatttttttaactttcaaagaagacaattcctagaaattcctgaagtgttttgagcaacatcaacattgtcgttggaatatttcctttttacccccaagtggacttatttgaaggaagagaaaatgctcttccaagaacactagagagcctgaccctggggtaagcacccactctagaatagccccagggcaggagtggcaaataggcttcatcttgcctgaaaattctcagtgcctcactctctctcttcaagctttacaccaggaagatttatgagaacagcgggcaaatccacaggtaggagatctagcttccattagtcatgtctgccacatgtgccgatgtgaggttttgtgaacgtgcactacacattcatcacatctgctttaagctccacagtattcctccacacgtgctccaattttcccatttcttttcctttgttatcctgaaatccctatgtattaaaatttctttggaaaagcagtatcttaagctcatgttgcactgcaagtcctggaatgatttatcaattcatctgaagtagtcaatcttattgccatccttctcataccagcctaaagtcagctcctgtgacagaatttaagttttgataggagagttggacagaaaggaagaaaagtggccatggctagtttggggatgtgcaatgttgtgtgggatggtagaaatgagtgggaaaacttgggcaaaatgaaggcatttgtgtcctagattgagtaactggggcaaatgaagaaagggtcaccaagacagttgagtgctatgagcacttttcttcttttatgtatgtattttaagttcaggggtacaagtgcaggtttgtaggcttgttacataggtaaactcgtgtcatgggggtttgttgtacagattatttcatcgcccaggtattaagcttaatatccattagttatttttcttgatcctctccctcctcccaccctccaccctcccaaaggcccagtgtgtgttgttctcctctatgtgtccatgtgttctcatcatttagcttccacttataagggagaacatgcagtatttggttttctgttcctgtgttactttgctaaagatgatggcctccagctccatccatgtccctgcaaagaacatgatttcattcttttttatggctgaagagcacattttttctatttcatgatttgctcagattgtctttcattctggccaagggagcagaggctcttatttctcttgctactttcttttaaacctaaagtcttcccactcatctgggccttataaaagttaaataggttttgacaaaaagtgttgaacaacacaggcctttggtcattttaaaaaatcagagagggccaggagataaaaatgatttagaaattgcttgcttcaaattaactaacatttctttgtttttggttcacattccatgatgcaatattttctgaatgaattataaactgttatattaataaaattttgaattaagcatgtttgaaaaaggcaaagagatctttattgaagtatatgtgcatgaaatgagattctgtagagcgagggtgtcttagggtagaggaattttttaaaatctatttcaaatgttagtttccttccattgaaatcgattgttgaggaattaaagctcaattttggagaaaagctgctatcgcttgcgagtgacatctgcctattgaccccacatctaggctttaaggagcggtgtcatgttacactcaccttcatttatacaacagggaaaaaaaactgaataggactagagaagagattggcatgaagtgcttgttattactatcatgaaactcttgtcaacctctttcaccatctgcaaaatagaaggtcggggagaactgggcaataattagcttccctttatgtagttaatgctgagtgtaaaaaagacatcctattaatttctttctctctgtatgtaatttacagtaaatcctcttggattcattttttaattatgagcctttcaggaacagtgaaaatttatgtgttaagatatctgttttgtttgacaagaatctataaccttccccaactatttccttcctgacttaaaatgtagattgttacatacacgaggatgaggggcagacaaagaactgctgtccagactgacccccatttcacggtggcaaagtgttctccttccaaaaactggaactttgaaaacagattgataatattctatcagtgtcatatttggggaaactggatatttattaagtttcacttgtatattattgtttttacatagtttatagcacccaacgagagtcctgtagaataaatggaagtaaagctgaatgatgatgaatggtctgttcctcccatctattgcatttataaattgccagcctggatgcttcatttgggctgtctctatgtgggatatttacagtaaacgatcagcatctgctgggatagtccttagtaaggttaggtggctgttagcttagattcatctctgggtttggccagtgacagaattggatttgagtcaagaactgtatttggggaactttccagtggagtacagaagaatgttggtgtttttgagactggtaacgcaaataaaaaaggaacgaacaagaaaacaacagaggtatccaacagatgcaatttcgtttcccatggagtgctgtgcactgcaggttgactccgtatttccttccatcgctatttgttcttagtgaaaaagacctctttgggatttctgagcttaggagtttttccagatcattagccacttatacggagaggacctgctgggcattgtctctccagctttcagcttagccatgctatcccagcagagtcggagaagaaggtgggagaagggagtagaagtgatgattggatgaagtgactgcttatgtaacctggactagaggcagctctctgcaggggagctggtgtgtgttttctcagatctctattattcccatgatatttctatctaaatctgtttactttgattccacacatggttttgagaggcagcaagccatagtagaaagatgtgcttaatttgaaaccaaaaaaaagttggatttgagttccatttttcaatccatttctgtcagtgagctatgtgactttcagcaagtcattctactacttggagcttcagcttcctcttcttataaatgggcataaaatattatgttgcagggttttctcaaagatcaagtgaaataaaatatttagaagctgttcattatcagcaaaacactgcactaatggagaatggtggttttcctaataaaatgggtgctgtagaggtgatgactgcattagagaaacatatatagaaggaaagttttagtttaattgtttgtataagtctgcttggactttttaggcaaaattttttaatttctgtttcatctgatcaaatgtcaattttatgaattaaccagattcacaatgaagacttttggagcatctctttagcataaagtgaagaagcagttacctctgagggaatttaggtcatgaccttggttaggtcaataggataagtgaccctatagcctccttggtgtctcattatatagcgttgtgtctctatccctgttacaagatgataatgcattgcgcttctattctctttagtataagcttccaaagggctctagactcagcagtgaaattgtcgcctgccttgccctgaagtttattctttaattttatcgaccatgggaaatgggaatatgccactttgcatgaaaacagggaaagaagagaagaaggaagagagggaaagaggaggaggaaggaggaggagaataaggaaaataaaagagcaagaagaagatgacaatagccatgaccatcaccaccaccaatagaagtagtagcagtaggaaagcaaaacctttctagataggcctagtatcaaaatggttttagactctccttgggtaccagataaagtcacaaagagcttggtcgtatactcggggatagagcccccacaaaatgttgctagaaccaaagtcctaatggaggtacagccagactgtggggagctaagtaggtcttgccaccaagtacactggaaacctaaaaccagaaatataaacagaaatacttcatagatttggattccccaaaatatgaaggaaaagtgaattataaatttactatgcaaatgaaatgtacaataatgcaatcataaaaatcaagctgacaaagtgtgtggaaaataggttatggctgataggaaattatgagaaggaaaggccaaatggctatatctttctcatttatggttcatacaagagcccttagactgttagttaatgacagttatgtttcagaatcctcaatgcatacaaataagaattttgaaaaactaagatgaagagaatttagctcctgagcatcattcattttatatatatataaattgagtttttattatgtgtcaggaaaagtgctgtgtgttgagggtactgtgaccaaccttggcttgcatagcataaacaggcttgagaggccacgacaattacaaaaacaagaaattaggttttctactcattatgaggtgatgtatatacaactcttgcacaactcctggcatatagtgagctttcaatcatggatagattttgatattattggtactcaaagatttttcttcaactaactcattttaactcaaaaacttgttatattttattttcctaagcaatgaataaactttaatcaggcctctgaaatttgaaatgaagcaatataaaattctaaggagctgggatattactgatttaaagacagctgggtggcacatatactgggttattgcagttatcaagctagctgaataagttctgaatagcagaagctttttagatatatgaatctaaaatgcaacaagcaaggcaaactctaagtgccatcacgtgaatgctggggctcacaggacttaatggcaagcctcccttaacaccatcagttggatgaattatctcattgacccaccgcttacactgctccttgtcattactcctggggtattgttcagtgcaacagggcaagaaataactcattgactccctgaagctatagatgatggattttagatccctagctgtattcagaaggcataggagctcagtgtattgatgggggaattcattagccacccactccacagaatcagtttcttagatcctggtgctgtcactgctgctgttgcaacttgttagtgtttcagggacagacgtcagagggaactgtataactacattagcctcacagatagtaccgacagccagacctgtcatttcctggcctgcgatgacacctctggagcctagaatcacttaaagatatttagataggccctgttgatacgaccaagctaaccttcatcctgaaatcaattcatactcaggatgacaggaaatgagttgtcattaaggctcatattctatttttgagtccttagttaacctcttataattcagtttatttttcctcctccatttctgtaaaatggcaggtaatttaatgacatagattattacttcctacatttactcgggagcatgtgtttcagagaccatcttacattgataccattactatcactttccgctaatattgattgacaaaataccaggtaccagacactgtgcaagaactttgtttacactgtcttataatgagctcatgaccactcagtgaggtagtcactattaatatcctcattttataattggggcaactaaagtttgaagaagctaaagcattttcccaagatagcactactaataaacagctgaatgggctttcaaatgcaattctgacccttaattactattacacccctaatgaaagttttagagtagaaagcatagtggtaataattttaactcaattcatacttatgaaacagcaatttacttgggattgttggagatgtgaagaaagttaatatctagccggggggtagaggggaatgaaaatcatatgtacgaatctttttaaaaacagaatcagctatataccaaagaaggtaaaaatactgctggttgctgagatttttttttttaatgtacatagatgggatgggacagattttgactagtggaatctgaagaaagagcatacctgatgaagataccagcatgagtgtcatatcaaaggaaatacaggatgtgttctcaaattcatgaattcaattggaccgtaatgaatggcataagaaaagaggcaggtaatatggattagcacaaagaacatatgatttaggggcaattggtctctgattcaaggtctagttctgcctccaactagttctgtagcctcggatgaattatttgactactccgtaaaatgcagatggcaataatgccaatttgtagctctgtgaatatttataacctatggaaaaatgcccagtgaattatctggtacatagtggatgttccattaatgatagccatgttcttgtgttttcttcccaggtactttagggacatagtgtagaagatttgagttttataccaatgatcgattgtttctgaaagcaaaaggaagacatttaaagatttttttagaagaagatgaaatgcccagcacttaatttttagggagattattttggctctgttaaaagaatgttgttcagtgggttcaaggaaaacagcagggtcttgagtaagtgtttctagagaaacgtctttaaagacttattctatgatgatgcatataggaaggtaatgaggataaaaccaaagaacagttcagagattgaatcggcaggtgttgtcagcaggttggattaaaaaggagagaactgagaaatgtctagattgggaaggttgtgatttcattaccaaaaacaaaacaggggacagataagtaaaacagataagagtttgactttagtgatgcaaaacataaggcatccaagagccaggctattgaaatttccaattggaaatacatgatgaactcagaggagagataagggctagaggtgggggcctagagaattcacagcttggcagtgacagtggaaggtttaaggagtgctaatgtctcaagggagatgaataggaacttgggaaatatatacatatttttatatatttaaatatatattattttatatatttatacaaatatatataatgtatattaaatatatacatatacaagataaaggaggaaaggaagagaactaaaaaggaaaggctagagggtaggggataacctagatagtgaagttttacagaaatcaaaacaaatgagagacttccaaacacaagttgttccagagctgttttttctatacctgttaggcctctttcatctgaaatcagtttacagagatgtcttcttcatctttattggtatttattatggtgtaatctttgccacttcagtcctcttaccagtattctgcatttcttctctgtcacgggcatcattaactttgagccagaggacccagcatctactcctagagagctgccaccaattagcagttaccctatgtaaatggtagaggtgtagctactattctgccaccctcgtaatattgtgggaaaaatccaatgacagaatgcaagtgagcatgccgtgtcatcattgaaaagtcctacaaaataaataaagtcgtttttatatcaatattggtatacctaccactcagcacagctcttggtacctaaggagatggtgattggagacctggaaatgaagaccaaagagatgctgagatggttgtagtttccaataggaagattagcaaccaggcaagtggcagatcagagcccaaatgtgagtggctcaactgctggaccctgtaagctgttgtggttctcaaatgatgtccttatcttgttcatctctcagctcttggcacctcaccttttggagcttcagtttggaaagggcaattcggatttaaatcatactgcagtttcctaaatagaacaaatcccctgatcctagtgatcatgtgcaatgaggcatggaatctgattacccttatcattatcttagcttggatagctacaaacgttactaaatggttatgaaattatctagccctttattaagtgcaaaaggtagtacttaggttactaaacttttttgaaaataattccgctggctgacttttcatggctaaaaacccatattcttatctgtggagtgtatctttttgtaatcacatctgtgtttgctgtttttttaattgtccaggcagtatgttagccattttgtgtctatcagcccatttggtcctgacaacactgttaaactagtggcattacctctattttatgaagtaaaaaattaagcctaagaggattaagtaaccatttgttaaaggtgttaaggaaagaaaagaggacttagacttaatcattgatatgtttgttttcagtgtcatagatatagatatatactgcttttcataattttctattcaatataatataatatatatgtaatatatgttggatgtgttgaatttagcaggacctgtaatatttatttaaatccacagttaagaatgataaacaggactagagaatggaacacagaattttggctaaagcagcatacataacttaaaataagtcactttctttttggattcaaagaaactcattttacattacattttttgcttcccagtatttgtttttctcaatgacgttaaggcacctaattacccccaagccactttcttaaatactcctatgcaaaatgaaaagattggcctggagactaatctgaggttttgaatgcagtgcggtagaataagtgttttagaggtaactttagttcccaaatctcaataaaaacacttccaaatttagtgtatcaaagaaaagattattggataatgcattctcatctttcggtgtatgataaatgccatatcagaagtcctcaaatactcttgattaaaaacgctaaatgatctcaaataacacaaaaacccatttattcctactggagtcagtatttaattttctatatttgtaatttaaatccagatgtgggtgtcttcacagcgaccatggcctgtcatcccttggtctgttagcttctaatgtctagcagcagagtatagtaaatacttgaaaggtagaccttcacactgaaaatcacatttattgaagtgggagcagattccatttaaattgtcccttacctgatgcctaattcctaaggttaacaggttttcatgtttgctacttatatcagcagtactggagctggtttttttgcatggctaaacagcaaagcttaaattcaatactagagcgtgaaagaggaaaatgagttttggtgtgacgtgtgaatgacgtggttttcctaaataccatgaatgcacaatgaatgatccacaaagcacagccgcctcttaaaagaagacaaaaatctccctgaggtttagttgagaaaagatacaggagcatatagcaaaaactacaacatgatacacttacgtaagatgcaggtgggaagaatagaatttccaaattaaaattagccaggccagcagaaatgagtaacctaatgttatggcttggatccgtgtccccatccaaatgtcctgttcaattgtaatccccagtattggaggtgggccttggagggaggtggttggatcatgggagtggtttttaatggtttagcaccgtccccctagtgctgtccttgtgatagagttctcataagatctggttgtgtaaaagtgtgtagcaccttcccctctctcttcctcttgctccagacatgtaagatgtgctagcttcccctttgcctcctgccatgattgtaagtttcctgaggcctccccagccatgcttcctatataccctatggaaccatgagccaattaaaccccttttcttataaattacccactctcaggtatttctttatatcaatgccagaaaggactaatacacttactttcgtgaaaacaacttttctcttaaccacctcctactgtctgtcaagtgtagttctaagtgcttgggatccaagagtgaaaaggatagacaaactccctgtcctcatggtacttacattctagtgggggagtccttaatgggcacaagcaatcagaacttcaatttgcagaattttgtgaaaatgtgctatcatatatattttattaattaactagttaacaggcagggaggatctccttcaaacttttgttttcatctttgtatttttctttctttgccaaatttccactttaatctctttcattctaatatgctcacgagtcacttaatgaggaggatatgttctgggaaatgccctgccaggcaatcttattgttgtgtgaacatcatagagtgtacttacacaaacctagatgttatagcctactacactcctagctatatggtatagcctattgcatccaggctataaacctgcacagcgtgttcctgtgacgaatactgtaggcaattgtaatgcagtggtatgtgtgtagctaaacatgtctaaataaaaaagcacagtaaaaatgcagtattgtaattttatgggaatgtaacaacccagtgggttctgtttgtccactgcccagatggagccaatttatcaagacaggtgaattgcagtagagaaagagtttaatacatgtagagctggctaaatgggagaccaaagtttgattatcactcaaatcagtctccttgaaaatttggaggctagggtttttccaagacagctcggcaggtaggggtctgggggatgggtgctgctgattggttagggatgcaattatgggatctggaaaatggtccttatgcactgagtctgcttctgggtgggggccacaggactggttgagtcaagagttgtgggcccaggtgggggacatctgattgtcagaagtgcaaaagcctgaaatgacatctcaaaaaggccaatcttagctgctacaattagggatgttcattataggagtaagtgggaaagttgcaaatcttgtgacctccggaataatggttggtaattatttaactctgcctgcatcttagcataattcaggtgtctctcatcctcttaacctggtggctttcattagttttacaaagcagtttagtttttgtgaatggttattatcatttaaactctaaactaaatttctcccaaagttagcttggcccatgcccaggaatgaccaaggtcaaagaagtttggaggttagggcaagatggaattggttagatcaggtctctttcactgtcataattttctcactgttatatattttgcaacagcagtttcaggaccaccttcacatactcagtctatcattaaccaaaatgtcactgtgttgctcatgactgtaatcaaaaaagcacagagagctctctcgctatctggttctatttctaccaccctgacaaccactatagtttgttttcaacaccaaaagaaaataacaaaaaaatagcatcttcaccctcgattctagtttcttttttcttgaaatgactatggccatttctattatttcattttgaaattgtgcagaattccttctgaacatccatctacatttcacagacaacaaattgctaaaaacacctaaacaccactaacctgggggggagaaaaaaaaacaaccaaaaacaaccaaacaaaccaaagaaaacaaatcaaccaaatgaaaacccaccctctctggtggaaagactgcaccatttttggtaaagactttgcaatcctgcctagactggatgactgcctattgccctaacactttccttcctacccccagttatttacaagatcaccccttatggtaacagtattagtacaaatgaggtttttccctttacttaactgaatgctagaagaaacagaatggaaccacatgttccctttgattcacacccaaacactgcaaaacacagagtattcgcttcctttttcaagctgtgtgtgcacattaaacacatgcaaacattggactgaaacagacacagtaagtcagctctaggggaaaactatagaagtctttttattttgtttctctaaatctcaatcttttatttaagctaggtctttgcagagattcaaagaatgatattttgtaatggttctccaaagagcagttagatgtgtctcatccaaatttgtgtatttaccttatcatcacagatactgttctggaactgggaacttagcattagctctcttcttagaaatgactattaatttttgataaaaagaataaaaaacaccacattacataatggatataagagaacatagacggcatgataggaatattctgcctgtgtttccatgaattgcttctttgttaaaaagtgtttggtataaattaggccagtggtgtcccagcactttgggaggccaaggcaggaggattgcttgaggtgaggtgtttggtataaacagtatattaacaaagaattctcctatggtataaaccctaactctagcaggaagatcaaatttctctttgaggcatgcagtctgagctccagtgactctctgcaagagaaaagctgatattgtcacattgtgagtcatagtgactcccaaggatgtatttgtgtggatgtggttggtcagaaggctttgtgtgcactgtgacatctttatgctgcagatgccaagatcacagggtccacacagagcagttcatttcacacagtgggaaatgatgcgtgtgtgtgtgtgggtgggtgtgtgtgtgtgttttaaaaaacctaaacagagcaacactgttctgtgcactcaaactctacagctaaccgccaagggccatcttataaatttggacattgaattgctaaaatttgaaaacacagccactcctattcacactctaccatctggaaataaaccctaagtcactgtgggtgtccatatggaagtcactgttctgcttccttttatcttcatggtagttcaaggttcgatttcctcctagggagactttctgttgttcccattgagccagctctgctgtccccactggtcacgaaccggatcagtacatggagattcctgagcatatgcagggcagcggcatgagagcatctaaaatagagtcattcccattgccccagcacatccttccttcctacattcctgggagaaaagagcagaaacaaaggcttttctttcttctctcttttggatgtttggtgatttgcatacagaagttaactcacttcatctactggattccaatcattcccttcctggttcctgatcttagagtacagggtgcttcttgccttccccttgtcaatataagggctttagaaaacgtgcccagctggtattctttaaacctcctccaacgcacaaatatatttttaaatgcagatatttcatatacaagttgatatttctagtttctttttgaaaatcggaaggtttaactctactgggccagtgttattcatagcattggtcaactggagctgaggagccattgccatttttatggatattcttttaagccccccaatctccaccactccctgtcacctcactcagcttcatccatctgcctgacccctggagacatttgattttgtgcttcctctcacacagaacttgtgttcacaatttggggtcataccttcacatattatatgtaaacagcactctggaacgttttcaaagtcacagctattttaggtatttagtttagaagaggttagaagttgacttttacattagtatcttaaaggaatatatttgcctgctcagaaacatctggggcccacatattcagatctttcgtacatataatttgctatatagcataacacattgaatgattttgactcagtagctcgacttattttttgtgttcttttaaaatctttcatattaagcatagaattgtaatttattgatgaatattttattttctgagaaaagttggttattattcttaaaatacattacctataatgttcatgtttcctatgttttaatatataatattacaatattgatgtgtcgtgattttttttggttgttctctaattaggggtctttatatgaatctctgattacttagcagttctctgaagggggcagtctttcagagatgcatttaagagctctgaattctgttaagaatattaaggaacacaatttttaatctttactttttactccagggctttgggctgtctgtatcaaaatgcttcagatacttcctctagggattgctttgcctgttccatccttaagagagtaaagaatttcttctccccaccaccccccaactcctgacaatttcagctaaatttttttcttccattgctttaggccattgcttcaagttatatcaccttctgagactatgaataattctttcccttcaattatattgttaccttgaaggtatttataggctgtgatcaaggcccctggagtcactgctttggcagactttataaatttagctcttaccacttctcctcacattttttatcttccagcctttgtagcactccttttgtgtgtgtgcgtgcctatctgtgtagcttctctgatattttaatatccttcctaaactagggaggtcagaatagcacatcatattccaggtattactgtgagtatcagattttagagagtgaaatcaagggagaggattaccttgaaattgaacttaatctattttgtgactcagaaaaatagacaaaatggtagaaaaagctaacggggcactgtcaacatgttttcatatattttaacgtactgttagagcaatcctggaagcttaagggggaaatgatgatttttcttagagagaattctggcttccattagatgcttgaacgtgtcctttagagtaagattttctttacaaatccaggcttcaaatatggctatgtaataagatgggttttttccatagtacatgagctcttaaatctgtattattgttattattattattattaatattatcagacctgtctttgtggcttaaaattaagaaacatcattaaacatttaattttacaatgaagaaaacaaattgctacgtaaaccatcttgctactagctttaagctctagtccaggtcattctgcattttgtcaatatagtaaattgagtaacagcctctgagggccctgcaaagagccaaggcccaatttaactccctagtgccagggtctccaaatgtttttggttgtctatacatactagaaaaaaattaactctgcaccaattaaaaatatgtatatatgtatgtagaatacacacattgcttatattatcacacatacagaaacatcaggcattttaaaagataagattagatacatatatatcccagtattattccctgaagttcccatgaaccaaccttggcacccctgtggatgcccaccccaacttggagaccactgctgtggtgggaaaaccatggtgacaaacggagccaccaccctcagcagttcccaggaggaaccccagtatcaatggttatgtactgcagagcctataagcgaatatttagttcagacactcattttagatatgaagatatggaggtgcagtgacttacctacctatggttacagagttggatgatgagaaagctgggtgtaaaatgccagccttctaatttatcagatttcaacacatgcagaaaatacatagtgttctgttttagctggaatctcaggaaaatggggactgaggtcctgaatgaatgatgaagaaggagagggtgaatcaatttccaatcggtggtcttaaaggtgaaatattgttagcctaagtaatctctactcttttgtgtcccttctattaaactctctttacaggttctctctctctctctctctctctctctctctctctctctctctctctcccacacacacacaccccaagataaaatccaaagcttctgattcaatagccaacctcttcagcaagaagagcaaaggttctgcagccagattgcctgggttcaaatcctgatcctatcactgaatagcagactttaggcaaattatttatctatgactcagtttcctcatccgttgaaattggggataaaaaagttccataggggttgatgtgagcattaaatgacacctgtaaagcactcggctcactgcctgatcccacgctaatggccctttatatgttagctatttttattattttattctaattcttcctaaaagcttaaagcacagtccttcatatcactgcatcgcatttcattttgtaacatgttcttgtgctacatgtttcaccatgtgctacatggtgaaaggcattttcctacccgctttacaaaaacagacaccgaggcccatgtttagggccaaaatcagtgctgaatgccaggacagactcccaattcagtgtctcgtatcaaactgcatttcctttcaagatgaaaattgttactcaaaaccctatgcagctgggcgggaacacagattccatggtttcctttttcttcctgtttccccaaagcaaagcatctcctctctttgcatgggggatctatccctccagaagtctacccagcctgaggataatggcagctgcagggttacaggggtaactgtccatctgtctgaattctcagttgtgtgagagcctgtgttacaaccttagtagcttctgcacctcactagcttttcccactcccttggagtgcttccattttctccagctttcggtatcagggagtgttattaaatgataaggagctggctggctggttgtgtattgtgagaggctgagaaacaatgagtgttacaacacattagattgcatgttagctctgattttgggaactttgtatcacagagctcatcatgcaacaggactgcatctgggatactgcctcccttccccagagggttattaatgggccttcatacctgggaggacagattacaggagagatgtgataattagagatacttcactgatcataagcaggcccccgagcaccaagggctagcagctgtgttacacatatgaggcaagctccatgctccagagacaaaagtgaagtagaatttgctgcagtgaccttacctaaaagaggtcatctcaaaaatggtcacccatggacattgattggcaattggtttgaatagagaaagagtgttctgagctgaggatcagaagacctgagtttcatttctagttctgccatcatagagctatagggtcttgatgaagagtcacttaacttgtgacagtttttttatataagaaaaatgggagctacatatgtcttacttatcacaagagattgcaactcaaatacttcttcttccaaggtagtagggtggcaacaagagtgtgtgtgtgttctgacgataaaggaaatataagaatattttgaagcaaaagaaggagccagtacaaaggcagaaattgacaacgcatgggagcagaagtggataaaattaaccaagctggggcagaagaaggcagggaagggtgagagaaaaacagtagacggcttaatgtcatcaccaccacaacaaatgatggtgataacttgatgctggtgatgatttggagctcttcctatggagtaagaaagaatgcaagaattgggtcattgaccagaaactctgaggaggaaattaaagaaaattcatatctaggtgtcttaaacttctcagtaaagaaagttttaagctcatcaatcaacaggggcaggggtagatttagggacttgaagaaagtataagatttttagaatgatctctttgggggatcccaaaataagtcaacaaggcatcttttcaatgttgtcttgatctcggagtcagaacaacttgggtttcaacctagctctatcttttttcctcctagagcacccttaagcagatagatgcccataccttacccatcagtactttagggttataatctatatcttgcaggcatgttatgaaaattaaatatgatcacatatgcagtgtgcataacatcatgtttggcacatagtagcctgtcattattttggaaaagtgaccataatgaaagagaatgcatcaaatatataggattgttaaataacaatgtccaatttagaagctgagttgtgttggcctatctgcttgcaccaagattaaataatattctttacaggtgtctacacctttttctctccaaggcatgtcttcagcctcagtgctttcatggctcatattttctcctctcatgctttcctacctgctcatatgatgaaccacatagaggaggtgattctccgaggatttataatgtgtttcctgtgctcctgaattggtgccaatggcacaccaatccagtcgggtgggcctcaaggcacaccttgctcctgactgagaaggaaaaaatctttgtggagtttgcacaggtataccaagtaattgagcatttgcattagtatggaaccacctactacagacaccgggctcgtttcactcaaaggatagcctagaataagcatgaaggacctcctttcagaatcttgtttatgtaaagcccttcttggatttcctctttattatattttacataattgatcacaaatgtgaacatctatggaaatgagttggagtataggcgataattaacctggaagggaagaaaacccttcaccagaagcaaatagatacccctgcaaatatctggtaatttcggccgggcgtggtggctcacacctgtagtcccagcactttgggaggctgagatgggcggatcacgagctcaggagatcaagaccatcctggctaacacgttgaaactccacctctactaaaaatacaaaaaattagccgggcatggtggcaggcacctgtagtcccagctactcgggaggctgaggcaggagaatggcgtgaacctgggaggcagagcttgcagtgagccgagatcacgccactgcactccagcgtgggggacagagcaatactccatctcaaaaaaaaaaaaaaaaaaaaaatctggtaatttctctttcattagaaagctccaagtgaggtacaaactcaattcaaatattctatgagaataaaaacaggcttatacccaaagataggcaataacaaatgctggtgataacatggagaaaagggaaccactgaacactgttggttggaatgtaaattagtacaatcactatagagaacagtttggaggttcctcaaaaactaaaaaattgagctaccatatgatctatcaatcccactgctgggtaaatacccaaaagaaagaaaatcagtatatcaaagagatatctgcagtcctatgtttgttgcagcacttttcacaatagctaatgaatggaagcaacctaagtgtccattaacagatgaatggatagaaaaaatgtggtacatatacacaatggagtactattcagtcataaaaaaagaataagatccagtcatttgcaatcatatggctggaactagagaacattatgttaagtgaaataagccaagcacagagagacaaatatcatacgttcttacatatttgtgggatctgaaaatcaaaacaattgaactcatgggcatagagaatagaaggatggttaccagaggctgggaagggaagtgggggttgggggaggtgggggtggttaatgagtattaaaaaaaaaatagaaggaatgaataaaacttatctggtagcacaacagggtgactgtagtcgataataactcatctgtacattttaaagtaaagagtataattggattgtttgcaactcaatggataaatgtttgaggggatggatactgcattcttcatgatgtgattattgcacattgcatgcctgtatcaaaacatctcacatacttcataaatatatacacctactatgtacccacaaatttaaaaaaaatgaataaaaacatccttcaaacgaagtggctattttgttgcaaaaaataactattacttctcaagcactgactgagtgccagggtgtatatgtatgtgagtatgtgcgtgtgtgtgttttgttctgttttttctcttgtaaatccgtcaaagattgcaaaggtaggaactattatcctgatttttcaagtcagaatccaaaatttagtgaggttaagtgacttgccaccatgcttgctgctcacaagtagctgaggcaaaatttgaatccattttgcctggagcccaagcccaggttctttctcctaactgggatgtcctgatgcctacacaatctgctcagtgaattactcagcctccatgtttttctattctatggcacccctacgtcatactagccactagagtgaaaagtgataagatgaaaccaagagattgtcttatcagcttctccattcacatgtcttaaatgatttctacctttactaacaagagaaaaatccaggtacattctggggaaaccattagtgcttagttggtaaaatcttgagacttttatcttactagtagaccctcaacatttttccaaagaggcactaatgtaccctgtaaagaaatgacatttttcgtctcaaaaaaaagcaaaaacaaaaaagaaatggctacttttcaccctaaaataaaaaagtgtgtgtgtgtgtgtgagagaaagagagagagagagagagaatgaatctatctccaaatgccaatgagcatgatggactagtggcaagactttctacagaatatgtaatttggtttaggcagggcaatctcctttgtatgaagtaaatagtaaattcagttacagtatatataaacattaagaagaatcttcttctgtttaaatattgcttcttaaaatttgttttgctatttaaaaaattcattttgaagttacaagtgtctctcctaaggagacaattctctgacaaacataaccaactggcaattacaaatcataattgtgactcagaccaatattaagtgagcaccttcctgctttctcgtagatgaatgtctataagttgttagtgcacatactgaactagaaagcccacatcaggaaggtactgctctttttttgttactgttaaatttgcttggccaactcagaatgaatatccagatttctcaactcttgagttagtggatatataaactccaaaaaaattaattaaaattgaagtttaaattttaatactgagaaaaatagttgattagctagaaaaatcaccctaaacataattatatgtatcagtaagtcaaggaaaaaattaaatttgtcaataggtccctattctccagtgctgtcttttcaaagttactttgcaaggtattcagttttagtgctaacgtatcaatcttttttttttggtgggcgggggatgggggcagggtctcactctgttgcccaggctggagtgcagtggcgccatctcgccttaccacaacccctgtcacccaggttcaagtgattctcctgccttagcctcttgagtagctgggattacaggcacgtgctaccatgcccagctaacttttgtacctttagtaaagatgggttttcgccgtgttggccaggatggtctcgaactccagacctcaatgatccacctgccttgtcctcccaaagtgctgggattacaggggttagccaccatgcctggctaatgtatcattttctagaatacatttatcaatgaaattttcaaagaaccttattggtatggtgaattatgtaaagtctcagaagattacttttgactttccacggccagatactcttgactcacttctatcaatcatgcattggaaatactctgacatcgtcaattctaccgtgatctactcaagcatctcacctgtttccttccagaaagcatgttttaatgttggagattcattggctagtaaatgtatagtgtcttaaatgatgtcaaatgaagaaatgccaaaaacatgcccaacaggaacagcaaagtatttaccttcatgtgtaaaatgccagtgtgagatagcccaatgtgatattgaactggatcaatggtggggtgccagcacatgaggaatcgacattaattcaagttgggacacagaagttggcattgtgaagatttttaaattctaggactaaatggatgatccactgggaggcaatgtccagacagatcaataccacacaaaacgttaattgcttttcttggtgaatcctaagaaagtgctggggctttagggaaattgagagagatttcttttcttccccctccacaaaaggtaattaatgagtacaacagacaattcaaagcaagaaaatagaatctgaaagcttgaaagccatacattcagaatccatttagagatttacagaagggctttagcccagaacagtgcctacaggagctacagtggtgacagtgtctccttgatagatgcatcctggaatcttctactgggcaagcatccaaaaatatttgaacaaatgaggtatgccttccagcatagctgggtagttagaaaagagtcaaacatatagaaaaaaagcatagtgactgaagtcatcttaaagctagtttacaaatgtagtctgaaatacactctatcacgggatgaataggtatggattttattccaactatgatctactgtgctttctgggactgtaaaaagtgactacaccatccattaataatatataggaaggcagtttgggaatgtcaacccaaagcctcttcgtaccttgaaattcccatgcaatttggttacacagagtatatcattactcaggttaatattataagacaagtattagcattatgtttgaacaaaggttttcacaaggtctatattaactttacaaaggttctgctgtatactgaatgacaaaggctgtcacagtagcgaccaatttgttccaatttgcttacttctccagatctctctgtcagactttaagttccttgaatatagggtcctagtcttcttgcccatccttgtatacatggtaggtgttccatcaatgtttcttgaatgaatgtataaaaagtgtattttaattgaaatcttaacaagtatgcattaaatgtatagttggtgcttggtactaattctctcaccagtttattgaaatttgactatatttgagcttgaaatggtatacctacagatatagatcattaaaaccaaacaaaaccctttctttatgatatcaagagatttgcctcctaacataaaaatgaataatcactgtctaccctaatggattagactttcttcattagcctcctgtttcttctgagaaatggctacattttcagaaactctgactcctaaagggggtcagtaactctgggaagactatttctattacgtgaaaatttcaaataatctcctagaaacttgaaaactggttatacacagaaagcaaaagaggtgaaaagtgagttgcagtttcattaaacatggtcatcctccaacaccgtctttcttaccagccttgcatgaaacgtcattaagatgcatcttttatgcaagggaccaaaaagggtactacttttaaaatatagcaaaaacaggggttgcagttgcccttttattgagggtcagtttatatatgtagtctgatatatatttcatccagaaatatagttttttaaactttttatcgtgaaataattttagatttgcagaaaagttgtaaagattatatagtttctttaaacccttcactgagcttccactaacgttaaaatattatgtaaccgtgatacatggtttgaaactaagaaattaacatctgtacaatacaatttgctcagataatcccagtttttccactactgtcctttgtatgtgtcagaatccaatccaggataccacattttatgtagctgtcctgtctccttagtttcttctaatttgtgataatctacaaatactttttaattgaaagaattatctaaacgtatatttgtcagatcaataccgtcctttctatctttcctttctccactgaacttgggcgtcagtctctttcttggctactaactctaatttatgcattggatattttactactttgggctcattattttaaaaatctgcaagcagacacagtagtctaggactgttcctgaggctggagggccagggtatagcatgtgcgcaggccaccaaggccagccttgtcattgattctgctttgttaccaagcaactgagatcgctcccactaaagaaaaagaagcaccacttccacttcaaaggtaaatgtgttgaaaaaagaacagaattgacacagcttcctttatcccttaggtacaaggatgccatgcctagtcagagttctgaattcaggttctcaaagcaggaacagggagatgcagcagctgcagttgggaactcttctttctttctacattttttttttctttttgaaagtccacatctctatcaatccagaatcctaattacatatgatataaagggccctcaaaagacccattacccctgttaaagtatgtaaattcaggggcaaattatatgaataatggctaacatttattgagcgcttattacatgtcaggcactgttcttctaagcattttacatttaatccttacaacaaccctgtgatgtaggactgattattaatactattttacagataagaaaactgaaatacacaatagataggaaaattgctcaaagttgcacagctagtaattgaataatcttccaaaatcttttttatttaggtaatagtatttttgataaataatttatatattttatgaagacctttacaatgatggtgttattccatttccaccctagattaaattagcatcttgagaaaaagccataaacccagtgatcaaagtcgatggtatttattttatgtttaaaaggtgtcatctctatcgagtagtcaagtgctaaaaaaaaaaaacaaaaaacaaaaaaacaaaaaatccagtcaacagaaacttaaacacttgagggcaaacattgagcaatgttggggttttgttaccttgcactaattttgggtttaagaagggaaggaaatgatgttcgtaatccagtgttctggaaggaggagtgcttttggtagattaatttacaaagttttctgctgacaaaagaaagggaaaggaaaaaaatcagataataattccctttacaggcctaatttgaacttaattctctctctctctctctctctctcacacacacacacacacagacacacacacacacacacacgacaactgtgagctgtaaatccatggtcatctagttactagcgcagtaagagcagttgtctgatctgatcaaagagtgtcatgctccaaaaaatctgatctgtggtgaaaatagattccccctggatactatccagggattagatattttcagagaccaaaaatacagtgaagtgccctcagcaagatagaacacagtgtagtcattcttggtgaattggaaggattttgccgcagggctgtcattatgaacatcagtgatcattgtaagaatatggaaaagtgctagtgaataggagtcccaattacagaacactgggtgatacagcctttgctataattatagtgtgtttagattgatgggcctaatgagcagtgttccttaatctaaatgttgattttggagcgagttaaaattagaggtaaaactgtgatagtaagtttgtttactagattgactatgtggctccacgtagaattcagattagttcaactaacacttcctcagcaccaaacccttgtcaggccttgggctaggtcctggagacccaaaagcagatgaagtcctcagggagttacagcccagcatgggagagggcatttcaacggcattagtaatagcagtggatatgaattgagcctttgccagatgctaaacacttgttctaaaccctctgcgggtattaatccatttactcactccaccataaccccacaaagttgggactaggtgagaggggagccaacaggcctggaagactacagtaacttttccaagcttatatgtgtgataagtggcagagcagagcttaaacctggtccggaccttgggttcttaactctaaccttagtattccagagaagatttcaatatacagtagttcactgtcctgggaccaagaagaggtacaattaaccatgttgcctatgctgctggtgatgaagccagaacgtaaacagaatgatttatcctcactcctttgttcgtgaacaaaggaaccataatcccccatgaaccattctggcctctttactatcctccagacaggttgatcttgtttctacctcagagcctttgctcttgttgacctgagtgtcccatcccagataccgttgtatggcccttccactcaatcctttcccacctccctccaaatgttaccttattaatgaagacttccctagctcattctattttatctgcctttcttccttatcccacctccctgcagttccttctcccttaccctgccttactttttcccacagattttaccattagcaatactattaatttctttttacttgggtttttgttggtttgtgtgtctgcctccccacactagaacacaggctcccaggggttagtgactttttaaatattgtttgtcactgaatttccaatgcctaaaataggacctgaccacatctgagtttaatatatacttttagatttagtgaattaaaaagccagaatgaggctgggcacggtggctcacgcctgtaatcccagcactttgggaggccgaggtgggtggatcacgaggtcaggagctcgagaccagcctggccaacatagtgaaaccccgtctctactaaaatacaaaaattaactgggcatagtggtgcgcccctgtagtcccagctacttggaaggctgaggcaagagaatcacttgaacccaggatgcagaggttgtggtgagccgagatcatgccactgcactccagcctaggcaacagagcgagattctgtctcagaaaacaaacaaacaaacaaacaaaaaaaaccaggaagaacatattccaaagtgtttaaaatagttatatctgagcgtcggaattatactattttaaatacacttttaccaagtttcctataatgagcatgcgttctatgagaaaagggctaaaaatagatgaaagttaaacattagtcactaattcatctcataaacctacttactcctgggaactattaacttctgtgttattattgcacattgggtttttatacatggtagatgctattatcgaggatcccttggggaaggtttgtgtatgaaatgatcatttctttcctgcttactccagattgagattgccagccttgactcacctgagcgggagactcacatgtgagactgcccgtgtgaagagcttccactgtgatacccagtaggcatctgaaaagcatcaggtccaaaatggaattcttgatcccccaacctgctccttacagagtgatccttgtctcagtaattccaacatccatcagttgtgtgatccaaaaacttagaactcatacctccctttcctcatgcccacagtttgttcatacaaagttctatagaatctacctcccgaatacattcaaaattagaccacttctcactgcaactcaataccatgctcctcacttccatctctactactcgaagccactcgagtcatctcttacctgaattgctgcaagcactttccagctggtatgtttgtttccaatcttttatttcattattttttaagagacagggtcttgctctgtgtcccatgctggagtgcagtggcacaatcatagctcactacagcctcaaactcctagagtcaagtgatgctcctgtctcagcctcttgagtagttgggactacaggcacacaccattatgcccagttaacttttttctttctatagaaatggaggtctcactatgttgctcagggtggtcttgaattcctctttctagttttctctgacactctcactccctgccaatcttttctcctcaaagaagccagaatggtattttttaaaaaatataatcagcctttattaccaaccacccccaattaaaatcctcatgtagctttatattatattaccaatccaatctaagtgcattaccaaagctttgaagaccctgtttgatcctacctctcaataccctccagaacatcctcctcgtctaccactttcctccacatctaccacaccctgggctgtttgtcaaacatgcctggtttgttctagctttgagcttttctctgtctgggagacttcttccttcagcaccagagctgacttttccttgttttatacatagtgagatgtcagctcagatgttacctcctcaaaatgatctttttgatcatcataacttagtaagctctctccctccaccagtcacactgtcccacatctcttcattctgtccagtattagtctgtaattaccatgtgcttacatgtttaatatctgcctcacttttgaatgaaagtatcaaggggaaaaggaatgtgactgtttaaatcactgctataacttcagtatccaaaacagtgcctggctcatagtgaacccttcataaatagtcactgaatgaaggaataaaggattggagcaatgaatgtttttgtgacatctagatgaaaattagagatgataaccggtgcaattttgatcatctatctcccttcataccagccaccctaatctaggggactagaataccgaaagaaaatttgcttctacgaacaaggtaatgtcatgatatggactgactcatttatttgttcatttgttcattcattccttcatcattcttcactcatcagacatgtagtgaggactttctttatattaggccccctgtgtttggttttctgtcagttatcttagggtcgtgtgtgtgtgtgtgtgtgtgtgtgtgtgtgtgtgttaaaggacgaataaagtaaataaactaatgcaatgtaagaagtgttgtggttttttagtaaaggttataaatctagacttatgtgcgtattgttttgagaatacaaagaaaggtgcttctgtttctgtttatgggaagtcactttacagacatttatctttaagtcatgatagatgaatttctcatatgggcagttttcctaaatctgagttttagcataatgagatctggagaaaaagaaggcaaaaaaaaaaaaaaaaaaaacccataggaaatgatacagagactaatgatcatttacccaaataaaacagataccattcaaagttagacactgagcctctggtaatccctgttcttctccttcatcttgagcgagggatactgaaaaagactgggctggctactgtttaatcagggaatgatgaatacttttcattagcccaagaaaagttagtttctattccagaaatattttgtaaagaccagttaaaattattaactattatgcatcacttgtcaactataggaagcattactgcaacctctccatagatgattagaataattgctgtcctttcatctttcccatctaacaatactcacccagtacctcccactttcgtttgtgtcttagtatgctgcatgtatctgctttgctaagagaacatcaaggcttggcataattgggctatttccctgtcatactggtttgcttctaaatctgcctcctctgtgggttgcagtgaggtcaatcagatgcagtcaaatggcagagaagatattaaaagtacatatatcctagaactaaatatacaccatctgtgaacttcagttacaaagggaaacttctcttaatatgaccttaggtaaagccattggcagttttattgtatctgtcagcaatcaccaatagctttgattaacaacatgactaatacataagttatgttggtctctttttttcataaataataagagatagggtttctaccaacacaacatttctcatacttgcctgatcattagaccaactgtggcacctgagaaaaatatgccacagacctactaaatcaaaagttccaacaggcctagggatctgtatagttcataaaaactccaggggatttgattatcaggcgaagtttggggagctttgtatgaataatattcaatgaattgtttgtatgtctgtccgatgctttccagactgggttaatgcctgggtctctttctttaattaagctttgattaagatgctcccagcaaatcccacactgaacatttccattgccccctccctcccccgcttctactatgagagaccgagatccatgtgaggtattctgtgatgaagatcttgttctgtttttattattaagcgtacatcttccccttttctgatattaccactatgcatcatcagttaagctgtcaccaacctgacctctgaggcattggaatcattcacttgatgaagcttactttggcataagctaagggttaggaaaaccaacagatttctaaaatattgtgcatggaagggccactggaagtcctccatcacagcctgatagctacaaaaatgagggaacaaaggcccttgagggacttgccaaagtcaaatagtcaattacagtgagagtttggactaaatctcctggttccaattattacattcttcctatgacaccattccctgattcctacaaccaaattagcctcctctttgagctttagttttccctctaggaaaaaaaaaaaaagcatgttagacgaggtcagggactctaaaactgagaccctaggttcagttaaaatgctgggaaggctactgtgataggggtggatgtcggagaggaaggacagaggtggggcttcccctagttatatttttatctgattgggatattgaaattatattaagaatttatttggaaaagccacttctgttactttttaaaaaaagatgtagaggcacaaggctagatgttgatccttgagtgcagatctgattcttacatttggagatccttagaaaagaagtctgtgaaggcaagcatttgtccttttttgtcataaaacctgattcttgggtattcagtgaatgacactcattgaccaactgcaggtctggcatgatcatcacaaagaattggcactttgaaagtgagagaacagtgggaagagaaattcttaggaagcaagctatcttttctaatcctctttaaaaggccaaaatgttcacaactttcccctaaaacagaaaggtgacattgctccttaagcagcagtatcatgcatgctgtcctctgccttcctaagaagtgcagacagagggcagaccctccgagtgaagtacctttttttcttatttgagcctgctctgcattgagggagagtttgacacacctctttagggttctgagaatagttaacagctctaagaaagagatttttgttcataagaaaaaacaagagaaactggaagcagttctcattcatattctctctctcgccacaccccccaccccacctcctcccgcctctccctctccctcttcctctctctccctctcttcagtatctaatgtaaacccaggctttctttatgttctgtgcagttggcctgagttctcttctgttttggtcaagattcaagtggaaaagacctgagcctgtgtctgcctcctttctcctaattttggtttctaatgttttacccaagaagggactagacctttgtttccctactcctttatcatagcatgctggttctcagaccttttctgcacactgctaacatccttctcacctttctttgcttggctttttttttcactgcaagctctcccatgttcatttctcatttgccatcagatttagagtaactggcttatggcatcaaagaatgaatcagatgggagcagctaagtaaactgaatgaagctgcttcctttctcttttcccatccacaaatgataaaatagcctgcccagccaagtgacgtggcattcaggggttatggtggcttggccatttgtttaagtttgcttatttgcagtcacagttctttagtatttcagtgatttggttatcactcaacagtgcacacatttcttctataaaatttgatagttacttatctatctctgatttttccctctgtgttttattatatctagtttaatttttcccctttgttgatttctgttttgtatatcttgttgcgggatatacatggaagggagacgagtttccaaagataatatagatcccagtttgcctgtaaattgataacaccatttggaaacaaatcttaaaacctcactgacacagcataaatagaatttacagatcttcttgaagcaaatccaaatctccagactctactttctccattctcccccactcatcctaaccttcacgtacagggaccgcgttaccaagtgagccaactagactctttcacacctctctgcctctgcacatgctgttccttggccagaaatgccttttttttctgctttacctgacacatttagattagtcttttaagacctaatagaaatgtcaagtgctctgatatgccttcccagatgcccatgagcaaagtcagatgttctgccttctgttcccctatggtactttactgatgtccctgtgacagcttcctgccactccagcccactcagttgggagaacttcaagaggtgaacaaagttttattcctttttggattcccagtgtctcatagaccttctgggacatatggcacattcagtctagctgaatgaggtgatgaatcaatccacttactctctccagtgcctgaaacttctcaaggagcttgtgctctcctttgctcctctcttttcaaccaatctgaaaatgcttttaaaagataatgtctgttttccagtgcagtcttctcacttggcatgtaatttctccatttttatttcctttgtgaatatcaaggtacaatttccatagctaccagtctaacctggaatcttttcatctcagttttggagttccacaacagtgtcctggtggatctatcttctatatattcctactataatgtacactcttaccaggtaccaatcagttgtttcaaaccacatttctactaaatgacctctctgaagtgattctgaactggcttccctattagatgaagaccaaacctctactctaagcacttaagacaaatggttgcattcatctcaatgctccttactcctcaatattatccattacatttttttgagacagattgttattctctgacagattgttattccttcatcgtccaaaaggagtcctcactttgcttagactggaacacaaaattttatctattttaatgttccgtcatataattataattatattctgttatctattccaaattttcagaattttatctattgcaaattttaagtattccaagttataaacttacgtcttccaaaaagactaccaggattaaaccaaccactgaatcatcatttcattacttcatattactacaagttagatttgggacactgtaatattttagccctgattttgccctttttatagtgtccatagataatttaacttctttgtataaacttccattataaaatgaagttttttatatatatatatgtatatatatatatatatataaaacattacacatttaggacatttcatgatgaaataaaagtgtttcaaatagaaaatgatggtttatttgggtttataaatcaagaattctcaagagggtatgaaacccacttctcccttatcaactctagggattttctgtagttttgaaatttgaaaagcataaagtaaaattattatcattttgatttgcttgtagtcataatatttaattcacttagaaatatcaaataacattaaaagaaaggtgtgaaaatggctgcgctcagtggctcacacttgtaatcccagcactttgggaggcccaggtgggcagatcacctgaggtcaggagtttgagaccagcctgaacaacatggcgaaagcccatctctactaaaaatacaaaaattagccaggtgtggtggtgcatgcctgtaatcccagctactggggaggccgaggcaggagaatcgcttgaacttaggaggtgaaggttgcagtgagccaagatcatgccgttgctctccagcctgggcaacaagagtgaaactccatctcaaaaaaaaaaaaaaaaggtgtgaaaaatagggtagaccacgtgtgctgttacagtagaccccaaacataaaagatgtttatctcactcatatacacagtccaatatggttccagttggtgagggttagggttgtcattctgggagttggccagtagagatgctaccatcttcagcatgtcttccaaaagcttcctggtatcaaaatccaattgttgaaagcagagagaacatgaataagttcatatggaaggattttatggactaagactaaaagtagtccacattaattcagttcacattccactaaccacatggacacccctaacttcattggtgactaagaaatgtagtctagactattcccaggaataagaggaaatggttatactggagaactagatgtctaatatatattaccttacatagttatcaaagtcatttttagtttggacatggtctttactaatgggttgcaaatgctctttatgcagatgttttatgttttatattactttcctatgcccaacagcataaaatatagaagtctggatggattaggcacttgatgtgtgtattagcttttgattgctatgtaacaaatgaccacaatgttagtggcataaaacaacatatgtttattgtgtcacagtttctgtgggtcaggagtctaggcacagtgtgactaggtccccagcaaggctgtaatccagtcgttgatcaagactgtatttctcatctaaagactcaacaggggaagggtctgcttccaagctagctcaggttgttgtcagattttactttcttgtggcagcatgattctttgaagaatcaagaattcatggttgcttgcttcttcaaagccagcaacagagactaaatcaaatctagccagatggtcttatataatgtaagataactacaggagtgacatcccaacacctttgtaatattggttaagcaaattacaggtctcatatacattcaaggggaggggattttacaaaagaatgactaccaagaagcaggatcactggagcctgtccaccacagtaaatgactgaaaaaatctgggtattccagagaactaccactttacctgaacatagctctttacacaaaactacacagaattatgaaagatctcaagagaaaagtgttccttattgccaagagctggttattatgctagtaaaatcagcagtgctcaggaacaatatttgctaagtttcacagttatcaaccttaacccacacaatcatctttagaattggatccagaacaagatgggaccatcttaaacctggtacattctcataaggttcattctcataagaccctaaagccttcattatatggcatttttgaaactcctttgtcattttaaatttttgtctttcctagctcccttttcctctactattctatctaacttaggcagcattgaatttcatttttttttctccttagtctttctgtttgacattttcccttctagcttcatttgtcctttaagacaaccccataacctttcatctaggggaaagaaatctaaaagaaagctctagaatgagattttagttgacatattcaatttgctttagaggggcatcacccatacctcttcttccactagtgagatctcctgagaggtgaaaatatgagagaatcagagctgcttatttatatatcaactatggaaagatctttcctgcctaatctgacctcttctttgaaactccaaaagtgactttttgtggttaattcttccaggatatctatgatgcagtcccacagatattaaaggttcagggcatcaaactgaaagatataacagctctaatagacagagtcacatttctaaaaaggaaaaccaaattctgaagatattttctggctctgtgaacagctaaaaatacaaggataatcgttcctatagtcctggacttttaacacggaagctaacttggaaggaaaaatgacactgagctataggaagagaagaatagaacagacttcagtgaaatcggccgcttttcttttcaaggcacttattcctagattagctcatctatctttaagtttcatatgatttttactatttggcatgacttaaaactaccaagttggtgaaaggtacataggaactctctgtactattttgcaacttctatgtgtctaaaattattttaaaataaaaggtagcaaacatacaaacaaaacaaattattgagctgggaagtgttccccttgcaaaagtctagcaactggggtaaaattgtttctttgaatacaaatgcctagtctctgattaataaaataccaggaagaggaaaagaaggagctgaagaaagagagaaagaaatagagaaatggggatttccagttgctgtagatcttgagtaggcaggaccttagcacatggtatctaggtgcatattgcctgtcacttttcaattatctttgctggccctgcctcaatcaaagcccaaaccataccccaagggcactctgcatcgttgaatttatagatgagatctttcttttgggataaagagctattctcaacttgactattataccttggccttcattccctaaagaaaatgggcagggaggcttgcagacagaagtatatagtgtggaaaatgaaccacctcttttgactctttgcaagatttgtgatgtcctactgggatgcctgggcccaggcacattcaccttgattctacatcagagacttctgtgtcttctttctcatagtatgggttattgggttgagcaaatactttgtcatcagtgtgtcttatggagtaattgagagccttggatttgaactcatatctatttgggctctattttgggctgtgtcacttatgaactgcatgaccttgagcaaatcactgaaactctctacagtccagattcgtaatctattaaatggggctaataatacctcatgcatatggctgccaacgggagttagtgaaataatgtacatgaaatatttaacactaaacttggtgcctaatgtatcttcagtaaatgataactattgtcatagtcatcattgcttttatacttttcggcttccagtgatttccagtgactacagccctaaggccattgggggatatcttttttataactgaattttctttataaaacaataactgattttttttttttttttaagacagagtctcgctcttcttgcccaggttggagtgcagtggcacgatcttggctcactgcaaccttcatctcccgggtacaagtgattctcctgcctcagcctcccaagtaactgggattacaggtgcctgctaccacgcccggctagtttttttgtatttttagtagagatggggtttcaccatgttggccaggctggtcttgaactcctgacctcaggtgatccgcccgcctcggccttccaaagtgctgggattacaggtgtgagccaccgcgcctggcctaaaacaataactgattttttaaagaaacatactcatgactatttgtcattttagtcaaagaggatggagaaaaacagggttcagttttattttcagttcaatgtttcgaccatgacatccagtgctggcttgattacattttaggaaactgaattccttctctaaagaaatagtccaaaattaaacacatatggttactgtaatcaataataatgctaaccaagcatgctggctcatgcctataatcacagcactttgggaggcagaggcgggtggatcatttgaggatcacaggagtttgagatcagcctggccaacatggtgaaaccccgtctctactaaaaatacaaaaattagccggttctggtggcacggacctgtaatctcagctagtcagatggctgaggcacaagacttgcttgaacctgggaggcggagttggagtgagccaaaatcgtgccactgcactcaagtctgggtgacagagcaagactctgtctcaaaaataataataataataataatgctttgtgcatttcaaaattactaaaagagtgtaatcccaggacttttggaggccaaagcgagcagatcacttgagatcaggagtttgagaccagcttgccaatatggtgaaaccatgtctctactaaaaatacacacacgcaaaaatattagccaggcatcatggcgtgtgcctgtagtcccagctacttgggaggctgaggcaggagaatggcttgaactcaggaggcggaggctgcagtgagccaagatcccaccactgctctacagcctggccaatagaggaaggctctgtctcaaaaaaatatatatatattatatatatgtgtgtgtgtgtgtgcatgtatgtatatatatatgtgtgtatatatgtatatatgtgtatatatgtatatatgaaaagagcagaatttaaatgtttttaccactaaaaaagatatgtgaagtgatagatgtattaattagcttgatttaatcatttcacaatgtcaacatatataaaaaatcacatcatactccgtaaatatataaaattgtaagtcaactaaaaataaaattttaaaaagggaaacataataacttttattattttgtatttttaaaaatcaaagttaggacacatattgagtttctctgctactcaatgaactgaaggttttggaaaacaagaccaaaaaacaacaacctccaaaaaagaaataaaagaagatcatagttaaggcctttcatgcagtcagctcagggatcaagggtagatctcaacccgcctgtcactgagtatgcagtgctcacagatgtggggaatacctatgtacatcacagtcctcagggaactgtaaaaccagttgcattgaccaaaccaaaacacgtgccattagaaagcatataattgtaaaccaagagcttcttttccgtttacctaagataattgcagaggctttagtctaagagaatcaaagttaagtgatagcactgtcaaaaaggtttcttaaggaagaagatctaggggttctcgggattcgttgaatttgatgccatggctgaaaaattaagtggagatacactgtatgccattggagtcaggcactcatgtgaaagatcagcactcacatttaggaattggatacagctaacagcaggggaattgataggctcatgaaaagagcatgggtagaggatgacatagaaaattaagcacagttagggaagacttaccagccaggttacaagaagcaaacacctatcccaccgattcagaataccttgcctcactcctgcatgacaggacatgtgtgttctttacgttaactgagaaactgaggccagataggaagacagatgtggccagaagaagttgacattagtaatgagagaaataaacgaagtgattttggggctggcgttaactatctagaactacccaggagggtagatttagagacacttccatctttgaaatacccagaagtctgtttctccaatgccttgactctgcctaaagcagtctaccattaatctctgaggaatctcttcaaacagctttctgccaatgtatcactgaagccttttgagaaataagtgctgttccagcttagtcatatctcaaggcagcgtggcatgggaggtggagactacgagtaattaaaaataactcccagctcaagcagggagagggctgtccctgcctcatctgtattcccatcacaggctccccagtgagaccccagctgttgagcaagagactctgtagtgtctgatgcactcaatcttgagttgatcacaaaagaatgttaacaacgttaagggcatggagttctaggttttggaagaattcttaatgattctgttaaagaggaagaaataggaaaaagaccaaaaagacagggacaaacaggaaaaacggacccagctctactgcagtaatagccattgatcactttacctcccttggcagtctgatcagtttcactggaaagatagcaagtggaaaaagtgtgcagagatatgatgtgaaaattatattcaagctttagctccccagcacgtctctaaggaaagcactataggaacagctgctggagatataaacaaaggcccaggaacatctctgccattcatgtcaggatctgagagagccaagggaaggacaagaggggaattagctcccagacatgcttgagtctctaagctgttactccgtgatccccatgttctaggtgcagaagcattgcgtctctaagcaattcccttaccaccagctatctaatgctgtcagaggaccaactatttgctgttaacagtaatgctcatttgaagctattcagcctagattttctttgtattaggtaactgtttaataaattaattccaaacagtacctcccatctctctcagtctgaccattgagcgctcttagtcaatctttgcaaacttgtccccatttagttgttaaacctgctccatcaacccaataatgaatcaacctatatttgaggactatggtttgtgcctgctccaaatcctatgttttctctgatttcagaccccttgcctcaactggatgaacttttcaagctcagaacaaataagtgttaaaaaacattattaaacaaacatattcacctttctacaagtttggaaaataacagctaaggaaaaagcttgtaatcaatattttttgttgttgttcttgttgttgtttgagacagttttgctcttgttgcccaggctggagtgcaatggtgcgatctcagctcactgcaacctctgcctcccgggttcaagtgattctcctgtctcagcctcccaagtagctgggattacaggtgtgtgccaccatgcccggctaattttgtatttttagtagagatggggtttcaccatgttggtcaggctgatcttgaactcctgacctcaggtgatctgcctgactcggcctcccaaagggctgaaattacaggcgagagccactgtgcccggccttataataaatagatgtatcaattgtagcttaccagcaccaaaaacaatagttagtaagagtgtggagtctagaatttgactgtttagagaaattatgcctcatcttggggaaaatttcctaatgtgtccaatctcctgtttccttatccataaaatggagataattgtaggacctcctccagatgactattaggaagagatgatacatataaaactcacagcactgtgtcaggcataaaataagtaatctataaacaatgttatttaacacttttatgataaaaatatagaaatagaaaataatagtttcagtgacagatcaatgttgaagcctcaattcaaaacataataaaattgctctttatggttcttacgatgtacatttatttcaaatagtaacaatgctgttcatggtgaaacgtattgattttaagattgagaaattggacaaacaaggctagtccacaatagtgggattgcagtagaccctagaatatgtataccactttggaaggtataattaatatgtttatatgtgtcgtccccaatctttccattctttattaccaccattatacctccatttactccacagtccgtctcttctagaatgaaagctcccacaaatcagcaattgcatctgtataacctattctgtatggcataacacctatatacttttccaaaaagaggtggagagaatatttattgacttaggtatgtctgtgatgatctaatgaaatgtcatggaacaacttaaagtcatagccaaaggaagaggaatgttaatatgtaagaatttgcagatagattattaacatggaatgatgccaaaatagcacagtagaaaaactaaaataaattaaataggcctggatttgctgggtaacctggggtataaccccataaggatggtgtatgtagaagaaaagtcagtgaatcattagtaattcataaactgtgttttttctcaggtgttcaaacattggaaagctatcttttgcaacctgatgctttccctggaatatgcagtgtttcttgactcgtgcagtaatggctgatggagtaggtgttcagacattttatttgttggttttatgtatccaggtagagaactcctgtctaaaattatcaagagttggtggtgcattcaggacaggaatttagattttctgactccaaggacatttcaccacccactaaaccaccctttgccatgagctcccaggaagagcaattgttcagtctggtacagtgagggaataatctgtccctagcacaggaggctgaacacagcagtgaataaaagaagacaaaaccagttctacaatataaatgacacattccattaatacaagtggatccaaatgaactaatttcattcaatagtactttcacattctgtagctatatgggcttggatacaaattgtaatgtcagtctgtcaggagagtggatggcagtgcataattacaagttcttgttcagcacttcaggagctaatcagagcaaggatgtgaatctgtaatttgcaaatgtgcaaagacagaggttactatggcactaacgactctgctgataacattcttgccaccacatcataggactgtgagcacaaattctacaaaatcatttgacctcctgtttagtcgtttgcaagaaacagcctgctggcagtacctagggacatttataagtttaatgttgttcaaaaatctaaaatgtcactatacaataaattaatacttacattctaagggactatacacaatcgtaaagcaatatatagagcaaattaatacataaaatacagagaaatatagaaaattaatatactacatcatgcaacctgcttctaaacaagtgtttctttcataggactgaatcaggaaagattaaataaggagttgagtagaaacatatatagatatgtagagatagagatataggcaatgttttctttttttttatttttatccaccaccccctccccccgctccccaccatagcatttctgctttaaacacttattctctttctctaacaattttattcattttcgttcttggggcagtagaaaaacaaagcagcattttagagttcagtactggcctaaaattcaagcctctctctaaaagattatagaatttcgctgtcctctcagttcacagcagcaagcagaataatttctgcttgccattttcctcaacttagtcctgcaaaagtaacatcattggtctctgcttctttcctcccattattacctgatcctgctctacagcagatgcttcctcagagaaagaaatacctcgaacatctccatcaacttcttcatggtagtaacccttaaccctaaacttttcttgtgtagagatgggtgcatcatgttgaggattcattgaccattctgttaatatatgaatttaatcaattttaattttaaagaatcaggagtgattacgtgcatcacaactttcaggttaaataattttatcatgggtgctaagctagaaccatggctcacctggtcagatggctataggagagtcagcacaatagaagcttcaggcaatgtgaatcctgctgctccctaccagggatcaaaactgaggtcactgtgtggtatgtggaagtcaaatgactgcttctctttaaaaagtgttggaatgatgcgttttctctcaccgattctgtctagggggtaatgtgctagggtgcagtaagttaagtgttagtcacatatttgcagggttaaatcttagttccacagctgactcactgcacactctaggcagaattatttaactccttcagtctttgtttcctcattcaaaaaagaaagagagatactatctgtggcagagcctcagaggattgagggagttaaatgtaaaaatgacacactggtgcctgttacagggagggctccctgagaagcagacctgtgggctaagtttagcatgcaggatgtttattaaggtgtgcctttgagatcaatacctgtgaaaagtagggaaagaaagcagatgaggcatagggaaaaggtggactgccacaggcaacccagcgaacctcaccagcagctctggagctaaaatagctcttcagaattgtccagagttgggctgaggaggccagaattttatttgtgttcccacgatgatgactcagtggatggggtcatttcaggaagagagcagggcatcaaccttgagcaagaaaggtcactgcagcttagtctaaccctgaagaggctggcagctcagggcatctgttgacagtattccaaggaggcagggcgactagaactttagcaaaggaagatggcacatcacagtgatcatcacagtccccagtcataaagagtagtttcttacatgtgcataccccttagccttgttttcatttctcctcctcccgccttcctgtcttcctcttcctctcccttccttttcttctttttcttcttattttgattttgttttactttatggaattaaacctccataattctgtagtgtgccaagtatgagggggaaaaagtctctttcccccattaatagataatgacaccttgacagataagtgagcaattctgcattgattcattggggaaaactatggcaggaagtgggtagcagtgtttagcgtggcataaaatacatatgctatctaaagaggtggcttctttcccttctgggggatttatgtgcttaaatcagggcccacaaactcaaagcacgcatttgggctaaaggaagcttggctaagagtaaaaggagagccaacagggaaagggccttgtaggctgtgacctttcaagctaaactgcccctagagaaagagagacttatttgaatttacagatgccttaggactccagtgagccacagctctggctcttttcctctggggcactacaaagcttaggtctttgcagatcaattaaagtcattagcgctccatctaatgaatgttgatttccatgaggaggctgagccagctggcctgccctaaacagcgcaaaggcaagcagggtaccagagttagagcaaatggcaataagccacttgaattagaaggcccccagcttgcagcagagttaatgctgcctgttttccaggtgacctcaatcactgcctggggcagacactggactcagatgctctccagtcacaagagagtttgtaaatatgatttaaaaattgtcactggctgctcaactagcaggagtgttcagaaagctgcaaggtatgagacactggatgcacagatgtgttttcatctggggaatgttgcatttttacaattttctctcctggctattatgatgggagatttctagtttttaaattcagtgtgctttttaaatttttgaatagataataagatgattgcaaaaaaaattaatgctgcctctcatttctgttcttcatctactcaagaaaccagttattctttttgtgtgattctagagttttctgatatatgtacaagcaaaggaaagtgtatagtctcatattctcatagtcccacctactaaacaaataacaacatactgtatatataattctgcatctcgcttttcttctcttttaatatatcacagctgccttaccgtatcagaacaaagagaaattctttttttttacagctctgtcatatttcattgaatgaacatgccttatttacttaactgttcctttactgtttgcagttacaaataatactgcaggtaacctcaaatatgtttcattttttacgcatgtttgagagtatgtgttgaatacaatctcagaagtagaatgacttctaggaggtatatgcatttgtaatttcaatagatagaaggattgccaaattgtccttgagaagtattacacaaatgtacagccccccccccctcaacgaatgggagcgcttccccacacctcaccaatagagactgtggtcacacttttagaaatttgtccatctggtatgtgaaaatggaatttcagtgtagttttattttctttttcttatgatgagtgagattgtacatctgtttatatgtttaggaactttttagaaatcgtttgtatgaactttctattgatattttttgaccacttttgtagtagtttgctgcttttgtttttaattgatttctactagagagactaatctccatgatatgggatgcaaatatccttttcctcccctagttttttgtttgccttttgattttccttacagcttttgcccctgagcttttagattttataatgttgaagttatcagacttttcttttatggcatccttatttcgacacttaattagaagggaggacttcatattctagagtggtaaagtaattcttcatggttttctcttagcactaccatgttttgctttatattattcattttcataatttttaatgtattcctgtagaggacgtgaggtattgatacaaatttaatattttttttcaggtggctacccaattatttcaataactatgtttctataagtcatcatttcccatttaagcctctgttatgatattttaaattcatttctgcacttttattctgctgtattggtctgtcagtgcacatttttcaattctgaaacctgtacaatagatttcagaatctaaaagggctaattctcccttattactttttctttcagagttttcctgactttcctttttttttttttttttttttttttttgagacagtgtctcagtttgtcatccaggctggagtacagtggtgcgatctcggttcactgcaacctccacctcctgggttcaagcaattttcctgcctcagcctgctgagtagctgggattacaggcaagcgccaccacacctggctaatttttgcattttagcagagacagggtttcatcatgttggtcaggcaggtctcaaactcctgacctcatgtgatccacccgcttcagcctcccaaagtgttgggattacaggcgtgagccacggcacccagcccacttttcttttatatttttttatagaagcattagagtatataagcagtttcttttaataatttgtatatgttagcatatgtatatataaattagataatgttaatttacaaattaaggagagctataacttctatgacctatatgtgtctttctatttagtgacatgatctgtctctccttttgcttaaattttattttatataatttcatatgtctcatattttgttaggtttatctctaaaagttttttcttctctgtacctaattatgaatggttcttttctgttattacttctactaatgagctgtgtgtgtatatatacatgaagatcatgaattaaggcatactaattctgcatcctgcttccttacagaatcttcttgttaatagtaatcattttcagttgtttcttctgagaactccaggtgctcagtcatatcatctaaacataattttatcactctctttccagttttatatctccaatttctcttgtttaattgcattagataataatcctatctaataatatagtaatgatattgtggatactttagcctcgttactgactttagtaagagtgattctgatgtttccacaatcattatgagcctggcttttgcaaacatatacatccctatggtttcttaacactgaatggtctggtccttacattctcaagttaaatcccgttagcattgagtattctttataatatagaactagatccttgtaaacaatttaattattttctttttctatgccacagaacaattaacttggcattaaaattctctactctttaaaagcttggaatgatttatctgtgaccttttctgggcctcgtgctttctttttctaagggtggctcaggtgacagacaacttcctccatttcatcaatggaaatgaataggttttgaatatgtatcccctttagaattatttttaggcaattacacttttctaggatattctctatctcccaagttttcatatatatttgcacagagttagccaagactatttttgtcatttttctgtgcttattttccacttactatttttaaattttatgtatctgcaattttcttcctctttttcatgatgagataatctaatgtttaccctttttaatttttttgtaacagaaactttaaatatattaattttaccacttttgcatttcctagaatattaaattctccttttccctatatgaattggccctttatgtttttcttaaacatattttatgtttgtttaaaaattttgtattaaaaatattgaattgattttgttattttctcctgtcaatataaatatgtaagaccaaagatttcctctaagcatggcttttcctgtttcccatagattatagaatatgagtgcttttacatttttattgttctaggaaacctgcaaaatgggctgtattacattcgacccaagaattaagagagagttttaaaatttctgattggaatgggattctgtttccgatcttgttgttaacatctagttattacactgtgatcagaaaatgtgtacaatagtatttcttttttttttttttttttgaaaaagttgcagttttctttttggactgcatacagttacatttgtgattatcatgtggattcttaaaaagatttttttaattttcaatgcataagtctttaagtgtactgtttgatataccttataaattatgctatttaggtcaattatagtcttacttttgactacttcatctatcattgaataagcaagatgatttaaagtgtcttatttctgttttttggctgaatgtttcttcagataactcttaagttttctgttttttgaatgttatttttatttcatttggttcataactagttataattctgacaccttcattgcgaatttcatcttttaacattttaaacaaaaaggtcttttctcaattatttaaaacctgaataccactttctctgattttaagatccctatcgctgatttatttttgtttgcattcttccggcatgccttggttgaacctcttattttcaacgtgattaacaaatttaattgttttatttatttacttatttattttaattatactttaagttctgggatacttgtgcagaacatacaggtttgttacataggtatacacctgccatggtggtttgctgcacccatcaacctgtcatctacattaggtatttcacctaatgctgtccctcccctagccctctaccctctgacagtccccagtgtatgatgttcccctccctgttccatgtgttctcattgttcaactcccacttatgagaacatgcagtgtttagtttctgttcctgtgttagtttgctgagaatgatggtttccagcttcatccatgtccctgcaaaggacatgaactcatccttttttatgcctgcatagtattccatgttgtatatgtgccacattttctttatcactggtcattagagaaatgcaaatcaaaaccacaatgagataccatctcatgcaagttagaatgacagtcatcgaaaagtcaggaaacagcagatgctggagaggatgtggagaagtaggaatgcttttacactttggtgggagtgtaaattagttcaaccattgtggaaaacagtgtggcgattcctcaaggatctagaacaagaaataccatttgacccagcaatgccattactgggtatatacccaaaggattataaattattctactataaagacacatgcacatgtatgtttattgcagcactgtttacaatagcaaagacttggaaccaacccaaatgcccatcaatgatagactggataatgagttgttttttaaagcaagtctcttgttcatagcacaaagttggttctgctttgtgatctattgtaaaagttgaaagtctttgtcttttaataggtatattaagccagtttatatctaattatgtgatagatatatttgttcctggtcctctcctgttactttatcatatagtttctctttttcttattttgtttgtttgcttgtttgtaatgtgttctatgcatgtctatatgtatgttttgctatttaagagtttgcattttctcccttgtcatttttacagttataatgtattatatttttagtgctcaatatatttaaaccagagcttctcatccaatataccacactcagggcttttggatagaccctctggccatgaacaatcttgtcttctcctctcagtctcgacaaatatattatttgctttttgacctatcatttgaaaaatattgggaaatgtcactttaaggaatatgcactagctctttactatgagcagtgaatcatctttcttaatatttaatacagaaaaaaacatgcatgtattaaaattaattgagttgatactttatatattatcctttgactcctagcaatcagataatttacttcctactttctgtcctcttctaactatttttagttgtattacttctgtattgtcagggtttattccattttcattctggtcttcagcatattattcccattaggttagacatagttcttctttaaaaactatactctgtgcttaccttcaatttcattgtcatagttattctaattatgttttggttgatcaaagtcatttcctagtagtttcctcaatattcccagtgttcctgaaggtaaataccatttgtaaactatcattgagtatagtttggctggatataaaatgttgggtcatattttgctttttgttgggaggatgtttctataaacttattaatacagtcctggtgagtcagagaagcctttcttgaagaggcattgtctatgtttaatctctaatggatgatcgtcacagaaacatagacagaggaaatggttccaggcagaatcaatggaattgaaaaaaatcatggtacttctgtggaacaggtagttggatgactgtaatgcacaggggaaaaggtagacacaagttgacactggagaagtaggaggggatagagcaagaagaacttgacagaccgaggagtctggattgcttccaggacaataatctaaactgcagagtggtatgaagcaagaaagggatatccggttgtaactgttcatattaagaggggtgcacaggggtatatgagctttctcttccaaggagcctttgagtcctcatctctgctgttacagtacagacccagaatttcttatgtaggagagtaaatacatttatgaaataataatggaattcattttatgctagggccatatttctaactaccttccaatgtagcaggagatagcaagacttaaggatatcttagtctgactcttttaaaaaagaaaaaataaagaattacagttcttgggtatatagtcttgtacctctgtaatctgtgaactgtctttcttccaaggatcccatggaaacctttacaaatctagctgatattcactatagttctaaaacatttccttccttagctgttccatggggagttttctgtgatctcgcagtttcaagctactttttggggaccttccatacttcattcaggtgggagctgccatagttaactagtttcggagcacaactctttatcaaacactatatatgtaaaaaactgccatgttaaataccacttgttgctctttcatcttcagtcagctatatgcaaaataggtctttacaggcaaatttacattctatcacagaaacagtgactatcagataaccaactcccttctcaattcttttttttggcttgttttcttgcttacttgcttggttgctttctctctttcctagctgaatagcattacaggccacttctaaaataaactgggttgtggaatttccactgaaggctggagatgaaaaacatactcatttacactgtgtgcgaacttggtggactaacattggttaaactttgaaattaagagatttttttttcctgatttttggccatctctttaatgcaatttcaggtagccacatggttcttaaaaccccaaatgcagctatcttcagtaagtacaaaatgaaaatatgttgcatcctaacagataagaatttcttctttctcatgatgagagctgttacctaaaggagcaaagctttaatggggtctcagcttgattttgccatgtttatatacaaaagagatgaggcaagctttgttttgaagatgttaattgattctgtccaccatgctgtctaacagccaattccctgaaaatgtagtgatggaaaaaaaatctgttccaattactgtataagtaaaatgcttcccttccacctccactaaagaaaaaaatggcactcactgctcaggatctgagatcgacagctgattctgcacatgcaaagccctgctgccatttgtcatttcaggaactgctttatttttgtcaaaatggaaggaaaaaaaaggagagagacattatacagacatcagaattcaaatcatttgcaacctgatttgggtaatgaaggctcaaggcggagttgagatttagggactaaggtggttgtataagtatgtaacttcacaagaatctgttttagacccagagcagattaatagccagattacaatggcatttcctgggcttaggaatctcattatcctcttctttcatatttctttaaagtggaagacccttccactacggtggtgtcatttgaactcaagtgtcaggttcacatccttgtgccctgaagtttcaaagtgtccagttgctgtaggagctttttctattctgatattactgatactgagactggataggaagcataccctgtttagctgcacatctaaataatcggtaatgagaacatccttgacaaaactatcttgcggaggagaggtcaggtcttacctgcatgcctgcgaccttcagcaaacaaaggcagagatctaaggagaaaacaggatgtgggatgtttccagtggaccttggcagtggacttgctttgtgtttgcaatggaagaaggaactagaggggggataacctcatggttgtcttttcttctaaatttctaagacaaccagtgaagcttgaggccttttctccagaactatacaatctttgcctccagcaagctctgtttttactaataaccagattgtcaggtggaaaactttttctaagtggaccttacttctctaagtaaaaaaacaaatcccctgaggcatgaagacctccattttacacttttgttatatacttcacaggtacctgaaatggttctggacaaaggatatgatgatcgacaataaagaaatcaaagatcatattcataattataaccaacaaaaaataattctggggataatattgtcaaaatggattccactgcaaacaggcagtaggatttactttgacaatattctccccagaattattctggatatcactgtagggaccaaaggagagtttttcccttggccttccaaagattctctgaaaaatcaacttgcaaaatgcaaattgatcagagaaaaagtgtacacatttatttaatgtgtatacacaggagccttcaaaatgaagacccaaagatacaggagaaattgttcatttttatgcttaggttcaaccaagtgtggacatctgtgtagaaatatgattggacaaaaagggtatgatctaatggtaatggactgaggcagaaaacccagcgaggcctggccgtgtagactcttcttggcctctctgagcccacattcctttttttctgggtagggggcaaaactttttctgaaatgggggtcttatgacctataatcaaacaaggtagtcaggcagtttctgcgtggtcagtttttacacagaaaggcagagggaaattggagtaatatttttaggtcttatgactagctttgaggaagagggatcctagtttctatggctagcattggggaagaatgggactgagaaacaggagggcaggggaaggtcagaaaaacttttgcttctgaggccttcattttggggtattgtttactgagccccaacaccacctcgagggtttccaggtatattttttaaagaccttctaacaaatgttccttttatttatacatccatttaattattggtgctagttccaatgcaagacttaaaaaattccacttctaattccccacctgcatggagggcacaaatctccaactcatgatcagaatttcctgcaatccgtatgtcatttaatgaattccactctattcttctggaaatcgaacactctagaaacatagttttccttttagctgcaaacctattaatgctggcagccataaaataaatgcagtcacaactattccccacaaatgaatcagtcagctcagattaaaatatactctttgcatatcactgaagggctcttcctggtcagcttgtaagtgttctgttttcattgcgtggtattcattttccttttagcattgcacttgatttgtgaagtagtgttgactgctagattcccatcattaacattaagttttattgccttaaatctctgtcttatgttcactataaatgttttaagtcaacataatgctagcaagaggtgctgggttaacagactacagttggcatatgattctcatttggggcagggaattgtgcagggttattaggagctttctacctttttatttatttatttagggacagggtctcactctgttgctcaggctggagtgcagtggcacaatcatagctcactgcagcttctgacccctgggctcaagggatcctctcaactccgcctccagagtagttaggaccacaggcacatgccaccatacccacctaattttttttctttttttgagacggagttttgcttttgttgcccaggctggagtgcaatggcgtgatctcggctcactgcaacctccacctcctgggttcaagcaattctcctgcctcagcctcccgagtagctgggattacaggcatgtgccaccacgcccagctaattttgtatttttagtagagacggggtttcttcatgttggtcaggctggtctcaacctcgcaacctcaggtgatctgcctgccttggcctcccaaagtgctgcgattacaagtgtgagctgccacctggccccatatccacctaatttaaaaaaatttttttgcagagatgtgatcttgatatattgcccagcctggtctcaagctcctggcctcaagtgattctcctgtgtaggtttcccaaagcatgtggctaacattttttaatcctatacaatgttagcactggcctcatctagtcctaagaagtttgctcctaatcatgtattcattagaattgaggaggagaatatttcccatggtgaatttatatgttccgccaattcaaccaacatcaaatatttattagctgcataccgtgtgccagatacagagccagacactcaattttgcagacacagtatacctgctgtcctagagtttagactctaatgagggagagagataataaacaaggaaataagtgtatgtaacaatgtacagctagaaacgctgggaaagaaacgaacgtgagagacacttattggaatttaaatgcaagccactccactatatctactaggtgtgtgtgttacaaaatacaaaaaaagaaaagcctcctgggagggtagcaggagttaaattactcaaaattaagccacagtttaagacagcaaaacataacagaacccagagatgccccaaggcaatacaaagttaattatctaagtagtagtaacaagaataactgctggccaggcacagtggctcacgcctgtaatcccagcagtttgggaggctgaggcaggtggatcaccctgtcaaaactctcaggagttcgagaccagcctggcaaacatggtgaaaccccgtctctactaaaaatacaaaaattagccgggcatggtggcagaagcctgtaatcctagctactcgggaggctgaggcaggagaatcatttgaaccggggtggcagaggttgcagtgagctgagatggagccactgcactccagcctgggcgacagagtgagactctgtctcaaaaaaaaaaaaaaaaaaaaaaagactgctttaggatttaaggaagagtagtgtggcgggttagagatggtggttagaagaggctttctagaggatcccaaaatgatgaggagattgtggatggaaagtggtctcttaagcagaagaaaaagcatggaagaaatactagggtcagggaagataaaaaatattacgctgttatgaacaatcaattatatagggaaagtaaataatgttagaaaggtagtttaaaattttccttttttgcttatcatgttagaaagaatttaaaatagtggccaggcatggtggctcatgcctgtaatcccagcactttggggggccaaggtgggaggatcacttgagttcaggagttcaagcccagcctggccaacatggtgaaaccccgtctctactaaaaatacaaaaattagctgggcgtggtggtgcacctgtagtcccagctacttgggaggttgaggcaggagaatcgcttcaacccgggaggcagaggttgcagtgagccgagtttgtgccactgtactccagcctgggcgacagaatgagactccttcgccaaaaaaaaaaaaaaaaaaagaaagaaaaaagtaatggcagtagtagcaggagtagtagtagtaacagataaaacctatcattggcagcaacccaggcaagcatttatttctatatcttgctgatggggttgatggggttagcaattgctatagtctccctagtaggggatttaggagacagatgaaaaactgttagactatttacgtatttaaccaaaaggttccattttggggtattcatcctatggaaatagtcatgaaagtaggtaaagatttagttccagagatgtttattatagtttcttgtgaacattcttatttgaaaagaagataagtgcccaataatatcagattgattacagtacactcaagcggttagcacagatattcatcatagctgtacttgataacagttgttactattatcatgttcttgtgtgagaggtaaagggagataagattaaactttttgatgttataaacaccatcacatacttcaatctaatattttagaagaatatttaatactattttaggtttactgttgaattacatcaacagatgtttgtaaaacacagagcaaaaagtagagtaagttatacaagatcaatttagtcacatctctatgtgagtatgtttgcatcaaataaatactggaatgatatatgtgtgtgtatatatatgtatatacagtatattcaaatgtgaacagtgagtagtgagattacaggtaattttgattctttttgtttgtttgtttaacattatgttctaaaatgtgtatggtaaaaaaaaaaagtagtttttttttatttctaagactagaaaattatttagcaaacaagtggaccaaagatattacagatagcatttcctaaacatgatgtgccttttgtcatggaaaaaatggatgattttgttttcttcttcagcttaatatgcgatataataagctcagtcatcgaagagtgaagtgcagcatactgaaaaagtatgatttggtttcacacagatcttggtttaaatcccagcttcatctctcattaatgatcacatcctgaacaagttaatatgtatgtctcggtcttctctttagaaagctgacaatggggacatgtatgttaagtgactagcacagcgcttaccagaggaccattctcccgctgtagcaggacgagccgcagacgaaacctctcagacaccaaattgtaaaaggaagggctttattcagctgggagtatgggccagctactctctcaaaatccgagctctctgagtgcacaatttctgtcccttttaatggctcacaacactaaagatttcacgtgaaagggtggtgattgatttgagcaagcaggcggtacgtgacaggggctgcatgcaccggtggtcagagagaaacagaacagggcagggagtttcaaaatgttcttctatacaatgtctggaatctatgagtaacatcggtttctaagttatgagttgatttttagctactgggtttaggccaggcaggcccaggcctggtttcgggcctggcgccgggctgcctgtctttgattttacttccttgttgttttttcttaaaacaggtactgagtataaaacaatataaaacaatatgagagggtctctctcttccctcaccacatatgtgagaaaagagaaaatatggctaagtcatgtacttaactgagtattaaaacacatgtcttaccagaaatagcaatttttcaagtgtgtgaaacacattaaaaataaactttgaaactccaaaaatctttaaaatatgtaaattcatttagactttactagaaaaataaagttatctctctgaaattttgttgttaaatatttgtagaaaaggatgtaaagtggaatgaggtctagagagagaattttgatggatgtgtgtatttgagtcagttttcatcccactgaatctttagtcaaatcaaataaaaatgaaggtaatttgtcagcttgcagaatcatgccaagcaaagtcgaaaactgccagcctatgttcattctcatggtttgaacaaaccgaactccaagtaattcattgtttggttttgaattacttatattcactctgttgatcccattttgctttgaaattgtactttcatgtttattttctgtagtccagaatggaggtaggaggaggaaatatctggaaatacctaaaaacatcttgaacataccttaaaagtaacatgtttaggaggtccctgagttagttttattagcacctctgagtgttacagaaatgattgcaaatctccaaactcacagacatttgcccagagtccccacctataatcatgtgctgggagagctttagtataattattaggccagtgtaggacaagcagcagcgtgcacatagtcacatttaaagtgaggatttaaatgacaacaaaaagcaaagcaaaatgacactctatataacttgggattgtttttatttaaatcaaaatttaaaaaattttaattatacatatgtcctggggtatgagtggaggggtggctatggggatgggtacacaggcatgaatgaacacaggagactatgaaagatgcttcagatgccccccggacaaagatggagaaggaaatgttttctgtaccatctctatatgggcagttcagctttctctctgtgcttgttttctctgctctctctgtttggatttgaagaaaaagaggttttttgttttttttttttcctttttcttttgtctctatcttatttattttttaagtagactgtcaaaattttagctgtgattgaagaaaagaaataagacaaataaaattagtgggaaaccaaggagggggaaatgggattgccacttcctcttgtacagagtcagcagttttaatacctgtaaacaaaaagttctttgctggaactctttttagaatggaaaatgggatgaataggtacagcattatcaaaccatttgttgtgctccctttttcttgaattgatggaaaatatagaaataacacaaaccaaagttgacactcttgaaatgacttgtccttagaatttattgtttatctcacggaaacatgaagaaatgtcttcattaatgtttttgatctcagagccccatttccttttatctcccagcagaagtgttgcagtgtcctcacatttggattgagaatttagatagataagaattcaaccctctagtcccatttactgcaattgtatttaaataccagcttaattagctgtactcatcctccttcccaatcctctttgaagtaggaaagtcccattgcttccgtttagctaatgctatgctcataccctagtttttaagctttgtagaaagtacagatatgactgccccatgtgatctctaagaagtctagatatttgatccacagaagcattttgttccatggaggacgtggagtttgttgctttggatttgagcttcatttaaagcatttgcttatttttcatcttgcaaaattaatctaaatcaacttaatgaagggtagaacattgagatatatacctgttaatagtagaataatatgacatggcacagtatccaggtatggaaaaggtgaatagggatagtgttatgagatttttagagtacgttaattttataaagcatgcttatgggaaaagccaaacattgatgacatttcgcagaaaatgttatgttcaggtttggcaaataccaataaggtcagagaaaaagcaatatgaatcagtattaagaaaattataagatagtgtatgtctaggtcatgatctttagtatcatcaataaaaccactaaggatgcctcactatagctgtgagatgggttcggaccatgatatccagtttaatactatttgggagcagaagtaactagatatatttatcctatgatattttacacttattggacacctgttgaatctctgttggcttgagatttaatttgctaagagaaaagcaactgaagttactaaggtaatagacataacatatgatctaaaaattgagagtacgttaatcaaggggagtgagcagaaattattctcgtcaatcatccatgtgtccctctatatccttcacctttattgctgttagatttggaggaaattctgagcaatgttccgtgatcaggggtgaaaagtgtcatttctgggctgaggcagtttatagtcatttgcaccttttctataccactctctttccctgccttctcttctcaatgttctgaaaatcttgtgttctaaagggacttgaataagatggagatagagtgccaacccacattagcatttatagcatatatggagcaagaaatgaacacgtgtgtatgtctttatgtaagttacagatacttatctatgatacctatcctgactattgcaacatgttaagctttccactgataattaaatttcatatataaatagataattaattttgatatttaaaaaatgtaagttacaaaagcactatgctactctgagaggaaattgagaaatactaaagttttctttcatggagccccatagttggaccttcacaaaggcttcaaaagctagtttcctaaccagtaaaagtcagcatgagacacagtgggctgagataacaggcccctcagcctaggggtggtttgctgaagtaggaggccagagcctctggatgagtcatcttcagttgttacgacggcttactctgtggaccatgcaaataatatcattttcgatgtgttccatgatgcgaaaaagttagagaagtaccataggtctttgtatcaggcaccaatataaccacccctacactccagatcttctttccccatactcatttctccactctcctccaagtcctgcctcaaacgagttattattttcacataaaactgagaaggaactgttgaaatgactgacatcttcagcaaataaaatagttgtcaaattaataaataaatgtcacttgaggcacttctgagcttctcaatatgtcttcttttggaggactatttgttggcataggagaagatttcctagcaaccctcaaaatctttccaattaggaacctaaattctattcccaaaggttatgatataaagaggaaacttgaaaatttgtaactgaactctattgaagtatggggtatttcaattgagtaagcccaatatttacctgcatcacaaaaaaactagattttaataatttcttatcaagtgtttatgccatgtaccatatttaacatatatttactcattagtttttcaaaattcttatgaaatgatattgtttttatacccattttacagatgagaaaactgagagagaccttaaggagctttctcatgatgcatggctagttaatggcagaactcatgttaaagcaagcagtccaaccctgcctgggctcttaaacagtggagtctgctgtctccttttaataggatgaaggtgaagttctcagcttgatatttttgtttcattcagtgcaaagtgtcatcttctaccccagtgccaaaaattacttcaaagaaaacagctttttgactaccgacagttatgtacaagaggtgtgatttggggttttaagagcttactttgacacagctcagatcccttttttggtagtgaaaattatgctgttatctcctaaaaaacatcatctgctctgtccccacctctttaatttgacaggtgattccatatccatgtaagagcattttggtgtctgaaaaacaataaaaatcgtcccagtaaacccatgttctattcaaaaaattttggcatattgattgtctggggtaaggttcaaaattgcataaacttccttgccccacaaatcactttgttgcatcgacaataataatcacaattattgatagtaaaataatttggccattctatgaatagtaaggactgcacatgttaaaaagaggcaaaagaatggatagatgatcagaatccattctcagtaaccagagctaaggaaacagctcaagtaaaaacgctcagcttacttaatgctctatagtaattaatagtaattgataacaacttgtagcaattaagatctaatgcacttaatttgcaaatgtactccttaactttgaatacacttttttctctaaggcgaaagtctagaattggagactcttggattcttcttcccattcttttccttcttccttggaaaaaatcagaaacaatctcgaaatgtggcctgttggagctggaaaagagcttagagattgttctagtacagttgtgtcaaactacaggtgaaaactttgaatcttggagaagaccactggtttattccacctctctagccatcggcatgaatgtctattggtatacttggtttagctgcccaatttatggccaagactgggacatgatatggtacaaaatatggtgtttttgtataaagagctatctcttgttccttcgttgtaaggggactgagggcacaagagttctaagactgataatcccatcaacttaatatattaaaagaggttttatatctaaagcatccaacacagtgtctggcctagaggaggcactatatctatagaacaaataaacgaatgttcgaacatagcctctctaaattctatttgaatgacttaacacaaagatcagaaatttgcatagctgtttgtgttagccctttaaaacaaaactctcctaggggaacatatgtgaattctattcagagtttaaaaacagattcatgggagagccccaaaccaatcaaaaacatggcaaggtttaaaaaacaaaaaagacaaaaaacaaaccagaaaaaaaaaattatgaaaagaccctgcctgccaagagtgacttgtttgcaattgaaaacctggagatatgagtacataatagaaacgtggcaatgatcatctgggcaaaaacacaatttgtatgacaatgaatcaggaaatgtcctggaacaccagaagatgaaaaacctgggattttataaggcacattcaagttgctgcgcatgcgtcacaccatgaattttcctgtggtctgacatcctgttaaaagcattggtctctttctaaacattggtagtagaagtgtaccacaacaggcaaccttacatttaaagaaagaatgtaatagatacctgtggaaactgtcaaaagtgtcttctagagctatttttgaggtctcttttattccttcattcctgatctgaaattcattaaggctaagagtgccccttaaattacgttctgctgtatcctggaggaacacctgaagaagttaataataaaccctagagattaggcaagtggaaagaattatgaaataaaacaaagcaaagaaattgtgtaaacaaattaattaattgtctgaaagtgaaagcatgtttgtaattttgcccttgtcaaagaaaaattggagttcattatgctcgctgactgatttaaaagcttcttcccgcgtagcatcaccgggagaatgagtgtgttgtgagtgcaaagcatggatcggttgcagcatcaattaaaatagaaattcattattgaaacctccagagtaaaaggtttgtgctttctgctttgaggatgggaggaagcttttcttttcttatttttaagttttgtttattttttttctctcctctctccaattggtataggaacatttattttggatttccagtagcaggcattctacctttttgtaataaattatattaatacctgttatacattgagcacatgctatataccaggcattctatatactttatcatctttaaccctcagagcaatcatgtggtgaaaggtatccatcagtatcacttgaggaaactgaagctcacggaggtaaaattgaacagctactaagtgatgatgccaaggatttaacacaccctaggtttgtctgactaggaacttctggtctctccaggacacaacagagccttctaaggcaggtttactgtgttgagttgggtttgcccctataacaaggctatcaaagatatatgtgtgtatccaggataggcattctgtattcagttacgtgttggagtgctatcgagagcccagtgggattataggtggaataagataccttcaacacagccatctgctgcatatggtgacccttgtgctctccaaatgagcagaagctcaaccagctttgctgaaatgtgtttgatgagaggatggtgtgttttacttttgtgacatctttccccagaggtggttgcctgaagagttgaactttagagaacaaaaagaaagaaatgtaggatccatttatggtctctcctagaatcatgccatatgttggactctatatggaaagggaggaggaataaaatgaagaaagaggagtacacagagcatggaaaaccataagtacgtgtgatccatgattacatcattgcaccttgcaaaaacttgttgattttagctctggggaggatgagtgaaaatcatggagtcagagcagaatcatgaaaagagattggttttggagccaagggaactcagatttacatctggtcacaacattttttttttaatattccctttttttattaattattttttttttaatttaagttccaggatacatgtgcaggatgtgaaggtttatttcgtaggtaaatgcattccatggtggtttgcagtacctatcaacccatcacctaagtattaagccctgcatgcattaactatttatcctgatgctctctctccttctactccccagcaggccccagtgagttttgttcccctctctgtgtccatgtgttctcattgttcagctcccacttataagtgagaatatgcagtgtttggttttctattcctgcattagtttgctgaggataatggcttccagctccctccatgtccctgaaaaggacatgatcttattgcttttaatggctgcatagtattccatggtatctatataccacattgtctttgtccagtctatcattgatgggcatttaggttgattctgtgtctttgctgttgtgaatagtgctccaatgaacatatgtgtgcatgtatccttataacagaatgatttatgttcctttgggtatacatcttgtaataggattgctgggtctaatggtatttctggttctagatctttgaggaattgccacactgttttccataatgtttgaactaatttacattcccaccaacagtgtaaaagcattcctacttctccacagcctcactagcatctgttgtttcttgactttttaataatcaccattctgactgtcatgagatggagtctcattgtggttttgattttcatttctctaatgatcagtgatgttgttgagctttttttcatgtttgtcggctgcataaatgttttcttttgagaagtgtctgttcgtgtcctttgcccacttttttttttattatactttaagctttagggtacatgtgcccaacgtgcaggttagttacatatgtatacatgtgccatgttggtgtgctgcacccattaacttgtcatttaacattaggtatatctcctaatgctatccctccccctccctgcaccccacaacaggccccggtgtgtgatgttccccttcctgtgcccatgtgttctcattgttcaattcccacctatgagtgacaacatgcagtgtttggtttttttgtccttgcaatagtttgctgagaatgatggtttccagcttcatccatgtccctacaaaggacatgaactcatcattttctatggctgcatagtattccatggtgtatatgtgccacattttcttaatccagtctatcattgttggacatttgggttggttccaagtctttgctattgtgaatagtgccgcaataaacatatgtgtgcatgtgtctttatagcaccatgatttataatcctttgggtatatacccactaatgggattgctgggtcaaatggtatttctagttcaagatccctgaggaatcgccacactgacttccacaatggttgaactagtttacagtcccaccaacagtgtcaaagtgttcctatttctccacatcctctccagcacctgttgtttcctaactttttaatgattaccattctaactggtatgagatggtgtctcattgtggttttgatttgcatttctctgatggccggtgatgatgagcattttttcatgtgtctttcagctgcataaatgtcttcttttgagaagtgtctgttcatatcctttgcccactttttgatggggttgtttgtttttttcttgtaaatttgtttgagttcattgtagattctggatattagccctttgtcagatgagtagattacagaaattttctcccattttgtaggttgcttgttcactctgatggtagtttcttttgctgtgcagaagctctttagtttaattagatcccatttgttagttttggcttttgttgccattgctttttgtgttttagacatgaagtccttgcccatgcctatgtcctgaatggtattgcctaggttttcttctagggtttttatggtttcaggtctaacatttaagtctttaatccatcttgaatatcttgaattaatttttgtataaggtgtaaggaagggatccagtttcagctttctacatatggctagccagttttcccagcaccatttattaaatagggaatcgtttccccacttcttaatggggtggtttgtttttttcttgtgaatttgtttacgttccttgtagattctggatattagacctctgtcagatggatagtttgcaacatttttctcccattctctaggttgcctgttcactgtgatgatagtttagtttgccaatcgcagccacttttaacactgttactctgggtaggttatttggtctgagtgtcagtccctccttctgtaaaatggggggaattcctgaaggacagtgttaggatgaaatcacattacttataatgtcgaattcctctgtcaatgcttatatgcttctcattcattatttctaagtcaagcatttttaaagcatttaacatgcaattattcatttttgtttataaagtgaccctgtgaacttatccctattttacagttgatgaatctgagacactgagagattaaataacctacctaagatcatccagctataaagtgatcgagacaggttttgtttgttggttggttggttttgagatggagtcttgctctgtcacccagcctggagtgcagtggcacgatcttggctcactgcaacctccacctcccagtaatggtgcaattacaggcatgcaccaccacacctggctaattttttttttgtatttttagcagagactgggtttcaccacgttggccaggttggtcttgaactcctgacctcaaatcatccacccacctgggcctcccaaagtgctgggactacaggtgccccgctcaagacagattttaaacctagcattcttgctccagaattcatgctgttaatcactgctattctgcctctctgttgactctcagaacctctcttggtcaaagcaagaaggtatcgaacagacttcctgtgctgttttataagctgcctcaaatccttccaggacagggcaatgtctatataaatagatgttataaaaagtataatctaggccctatttatttttctctcagattcatgtctaattcataccagttgagccttgctatttgagtttcacttaaaagcattctgacatagctcacctcccctctttctcttatattgctacccataaggactagagaaaagatggataacataatcctgagtctatgagttgctagaaattcctcattataattgtgtgtcttctggcaaaaataaataaataactttctcttttaaagccacttataggagacaatgcacattctgtgttttttctctgtggctgtgcatggacacagactcttctgcccttctcttgcctgttccttgattcctcatgtttctgtctggtgcctacctgagatccaggtattcctctttacctcgtcgtcttgctattttttctagggacttttcttctcccaaagttatgttgaaacaggcaaaacacctagaaatgggtcatgtgggtgagtagaggggagtgagaaggagagggaaaaaattcccaaagctcatattaggcaattacagttctaatgaatagaagcagtctattcaggcttctggcaatattttatgctcacctagtgtagtctgtattcccttaaatgggtaaaagatgccttaaaaagattgctttgaaggatgaagagacttgaaacaactctctgaacaaaagaacttgtttattcattcatttattcagcttgcatttattatgtgctgggtattatgcatataaatattttcttaagttttgtttttaattaacacataatagtatatatttatggggcacagtgagatgtttgatacatgtagacattatgtaaaaatcaaaccagtgtgtttagcgtattcatcacctcatatatttacctttttcttctggtgagagcattcaaaatcttctcttctagctattttgaaatacaacaatacaatatttttatccctagtcaccctgctgtgcagtagaacaccggagcttattccctccatttaactgtaactttgtacctgttgaccaatcatggtccctattctaaaagtgtcacagcctaggtaggttgacaaacaggtaaatcaggattacaatacaaaagtaaaatagcctggatcaaggaaagcacaggttgttatggaaacacaagagaggacatgtaaataagattgagggaggttcaagaaggcttttcaggagagatgacttttgaactgagttttaaagaccactgggtagacaataggagaaaaaaacatttctggctaagaggttagtgtggatgagcaagtggctctgtatagctggaggagtgtctgaattttccaacatgaaaaggaccacaaacttggtggaatcaaacaaagattttttttttcttttgtcacagttctggaggttggaagtccaaaatcaaggtgtcagcaaggctggttccttctggaggttctgaaaatgaatcccttccatgcctctctcccagcttctggtgctggtggatgcatcactctgatctctggctgtctttacattgccttctctgtgtttctccttttctgcctgtatcttctcttcttctaaagacacttgccaggccaggagcggtggctcaaacctgtaatcccagcactttgggaggccaaggcaggcagaccacctgagtttgagaccagcctggccactgtggtgaaaccctgtctctactaaaaatacaaaaattagccgggtgtggtggcgcatgcctgtaatcccaacgattcaggaggccatggcaaaagaatcgcttgaaacccaggaggcggaggttgcagtgagccaagattgtgccattgcactccagcctgggcaacaagagcgaaactcatctcaaaaaaaaagatacttgccattggattcagagcccacctagataatccaggatgatctcatctagacagcctttactaattccatcttgcaaagactcttttttcaaataatgacacattcatacattccatatcttttggggagacactatttaacccactacaaggtataaagatgagctataggcctgatgaggtaggaaagaggcagggcaaggtctcccagacactcatgtacctgacaaggtgagtctcaagagacacaagaaaaccttggaactgtaattgtgaaattgacatctatctctggaaaatgactattactcctaatgcctctagccaaagactatcagaaacccacctgtagctgatggagttgcatttgttactcattgtttcgatgaggacacacatcatgaggaaccatcatgtctcagctagagggtgttggagaaaacctattgtaggaatttgactttggttgggtaatatgaggaagcgtccaagaaagcctagttcactttagattagatgctgtcagaaagcagaggcaattctaaaaatgtgtatcttgattaaatcttctctgtatggaacaagagtgaggataaagttgtaaatgataaagaagtagcaatcactagccaagagaggggactgtttgctattttgtgggtgaagcagtgactttgtttttctgtgcattgattaaattaagatgtagctttgttttgactcagtttatcatggtctcagagtgacttcttctgagattggtattctgtgacattgctcatgtgcaatagaagaataacaagatctagccatgagtgccaggttacgttccagatgtcacaggctgctcttttgttttgtttttctttttcaataccaagtgataagaatgagcatgcctaaaattccagcagttgtaataaaatacatcaaccaaaaggttcagactgtcctgtaagacccataataagagtctcaatgtgttcttaaaagaacattctttcttagcctacgtgaacatccttctctagacttaaattacttctgacccacatgttgggccgtatctattttaaagacaagaggagctaactgcaaagttccttgtctggtaagctgtttcatctgatagttgtaatagcattttctcccgtctcactgtagggcctaaccccacaagcatccttgtgaagaaagaccccacagtcctctttttaagctttctccctccctttcctggggtgccttatctatttaaatattagaggtgagtcaaatgtaattctctttaatgaaaaacaaacaagtgatagaaccctaaacgctcttttggcaaagatcccttcagaacaaacaatcttcttttaaaagaagtcagagctaggaaagggccacaggagagcagggatagccaactaaactatgcagcaggcttctctgaaaaaaagtgagtgacttttttggtgtggcaagaaaaaaaaaaagtaaagtttgatataactagtagtccttggaatgacaagtgacaagagaggtctcttccctccctatagtcccaaggagaaaagggctctgtaaaattaaaggcacaggtattcagttgaaaggacatatttttctcctctaacttataattagcctgcgatactggcttctgtaggctcttatgaaggcaaattgctcaggacagtgactctggcgatgtcagtcatacaggcaagcactgggatatctatcacaaacacatgccagttgtcatcttccaaggcatcacctgattgccaactcaggtcaggaagaaatcattcctctttcttcttctgtgatgttacttatctgttgcaacagaggagagggttagcacctttcatgacatattccagcatcctgttaaattgatcagaagaccaattgcacacagtgtcttctaccattgagattggaaacacagccaagggtggagatggtcagtgaggcttcccagtgtcttgcaagttccaggtcagttgtttatgcttagagtcccctgacagagagatggatgtgttagcaggttctagggcctgtggtttcccttgtggaaatgccagtggaccatgtgtgctccttgggtatcagggtgattgggcttgggttggttgtggccacagcatgaactggagagtcggctgtatttggcatgacaaggttggcacaggccagctgagaccttgaaaaatttggagctgatgcagaggtgaataaacacattgaaaacagaagctgcaacctcaaatttctacagggaccagacaggtaatatgcctgagtgaagcaggccaggtggcaaattgtacagtgcaggccccaatcaaagtgcacagtggccactcagctgccactggattataattgtgtagagatgtgagtttagagttgtcagcttttcaagagaagccaacagtctggtgtgtatgttaaatcccctgattctggcatctaattaatgcccttagcagtccaaaccaaacaatgtgtgagctgccatttttgcaaccttgagctaatggtgttaacgtccagtttctttgtttcataacatctatggaatggctttgtgaatgcaaatgttgaaacattgtgagtctcatccccaacagtgaaaataaatacaaaatttaggcaaaaaataaaaataaaaataaaaatacttcttaaatgtcacagcgcccccatggggctggctggggcaacaaattaagggacacagctgagctttcgattctgtcagtaactaagtagtaatggtgcctcagggggtctgagtcattgaacaagcgctacaggatagcacaatactaggtacacaaagtaggcgagcacaggctccctacctttgaaaagtttataagttcattaacagtattatgtttccatgcactggagcattagaggaaaaatgccacgataacatctaaacaagagtgcagtgggccctgagaagtatgatgattctgtttccttctttaaagcatctcttcttaataatgtgcagtagtagagagaatagaaaagcagcatgatggccatgtgacttgctggatggatgccatttctgttggatgagattggacatcaataggtaaaaccaataagaggttgtgtgcattttcagattctggaattctggaatctatgacatttttggaaaaatagctctcctaagacactggttctaaatatagcagtgggtttcaatagttctatgaattgaaatcaatagtactaaggagcgaagagcctagatcactctcccaagaatcattgcttagatgagtggttctcaaagtgtagtctctggccaccagcatcacctggcaacttgttacaaacgcatattgttgattctcattccacaactattgaatcagaaattctgggactgagtcctagcaatctgtgttttaaacaagccctccaagtgatttaatgcatgccaaatactaagaatcactgttatccttggaagaggggaaagctcagataacccacaattgaggtctagagatgttcatagtctcttctacaagtaagtcttaccagtgagctatagtagagataaccaagatagcatgtagctggaggagctgttgcttatttgactggattttttggtcattttttctttctcacttatgtgtttgttctccacttgttttcaagccccattgatttctgtattagctttctattgctgctatgataaattaccacacattttcatggcttaaagcaacacaaatttatgagagttctgaaggttagaagtccaatacaggtatctctggataaaatcaaggtgtcagaattagagcaaatcccttcttggggcctctcgggaacaatctacttccttgctttttccagcttctaaaggccacctgctttctttggctcatgggcccttttcttataaatgcagatgttgtttttaaaaatgaacaatgttaggctgccttcctcgaggggctgtctctcttgttctcactcttctgcctccccttccacctttaagtatcctgtgattacattgggtgcacctggatgataggcaagctccctattttaagatcaactgattagcaaatttattcccctgtgctatagaaggtaccatattcacatgcttcaagaattagaatatattgtatctttcatgggggaggtacattattctgcctaccataagagattgtattcggagggcttgtttttttttttgttgttgttgttttttcaccaggaaatggagcctggtgaaaaatgtaatatatagcctcttcctccacactactaaactacctttctgtgtcctacagagactgtgtaatattcactggtgaagacataagctttgtagtcacaaacctgagttgacgttcctactctggcacttactagattgatatggtttggctgtgtccccacccaaatctcatcttgaattcccatgtgttgtgggagggacccggtgggaggtaattgaatcatgggggtaggtatttcccagggtgttctcctgatagtgagtaagtctcatgaggtctgatggttattataagggggagcttctctgcacaagctctctttgcctgctgccatttcacgtaaggtgtgacttgctcctccttgccttctgccatgattgtgaggcctccccagccacatggaactgtaagtccaattaaacctctttcttttgtaaattgcccagtcttggatatgtctttatcagcaccatgaaaatggactaatatatagatgtaataactttttgcaagttatgcaattttgggccatagattcctttattctgaagtggagaaaatactttccttatacaattgttatgtttacataaaataaggtgccagatacatagtagaaataaaataaatgatgttactacttcctaaaatcctaaaagtttcatttcagattgctgagtaaacccagttaaagaaaccagcctctgtgttttggtgttgtcattaatgctaagttacatttccttagggtatctgcattaagcaaatgtaagatgtttgagtttcaaagatgaacaagtgacttgtaagtgtaaagtggtatggctgtttttaataaataggtaataccacccttttggcgggtagtagagaaaagaagatgagtttttagaaaaagactcagagttactcagaattaagaaaatgaatccttactgtcaatatgagtctcccaactgctagcgcaagtggtggatagattttcttttccactagatttacttcctgatatacacatttatcactcaagcatggactgttcatcaagtcattttccatctataaccccagctgaagcctgacaggttgtgtgtttattatgtactcttaaaaaactggagctcatttgcccctgctgcggggagagcagactcagacagatagagggataaggtcattcagtggaatgcccattcactgcagtcaagcctaaataatagagaggtgtaaaacaaccaggaaaagctctgattattgccagaaatcaaatattgatcagatagtcccctaacttaccaacttccctcttaatgatctgattcccatgtattcattcatcagttagttgagcccctcctatagaccaagccctgtgcatggctataaaaaacagtatgtccatgcccacttccccctctacactcaatctggagccatgagaaattaaataacctttaatttctgaagatcgggtgctcttataaaacatcagtacttataattgtatcctgcagtggaaaattgtgcaataatctttttctgaaggcatggccatgaattgtactatattactccatctatcttcttttaacactaaacaaaatgaagagaatacattgtgcatggcccctagaaatttaccttcaaatagaaacaaagctgctaactccacacacacatgatatgctgaaaactgaataaatattgaagaatctaaattcaattaattagcaagccaaatcttgcctcaaattatgttgacattatttattcctttgttgattaaatgagttgcctcttaagccaaaagagaagatcttaagctcttgtttcttcattccaggtctcttctctccaaggaatttgggaaggagcaagcacagcagaggccagttttactgcatgctggtgctcagagggaatagggttcatagagtagaagacagtgaggagagaaccagtaaggaggttggggagctggatagcatttacagcatgggttcattgattcattgggaggcttataaatttcctatgcatagaagcacctgtttttaaacagagacatgtattcaacacatgccttcgagaactaattggaaagagtctttgatggcctatcgttttgaatttgcatgaccagaactccactatccatgcaaacacagtggacttgctgcaattgtcctttgacttaggcaactttaacaatgcaggggaggaggggtgagaagaggctaggagaggaagtgtcagtgggagaagccaagaataattgaagtagtgtgttatttcttttttttttaactattaattttttttattattatactttaagttctgggatacatgtgcagaaggtgcaggtttgttacataggtatacatatgccatggtggtttgctgcactcatcaacccatcatctacattaggtatttctcctaatactatccctcccctagccctccacccacctgacaggtctcagtgtgtgatgttcccctccttgtgtccacgtattctcgttgttcaactcccacttatgagtgagaacatgcagtgtttggttttctgttcctgtgttagtttgctgagaatgatggtttccagcttcaccagtgtccctgcaaaggacatgaagtcattcttttttatggctgcataatattccatggtgtatatgtgccacattttctttatccagtctatcattgatagacatttgggtttgttccaagtctttgctattgtgaacagtgctacaataaacatacatgtgcatgtgtctttatagtagaatgatttataatcctttgggtatataccctgcaatcccattactaggtagtatggcatttctaaccaccctttccttccatgagcttaggcctgggagttgcagtgagtgggagccttaaatctaccaagccgcaaatttctgtgttcctgaggcctctcaaggcatcaacatcttgaatagaaaataagtctatccttaaagatacagtacatttaaagattaaaaaaaaaaaaaacaaaaaaaatcatgttccctaaacacaaataacttcatctgctgcccaagcaaagaaacaaagagatgtctactaaaggcaaaaatgccaatgtcgtgcttcctgagcacagacattgcactgcacagaatggaccattttggagactttcaaagacagttttgactcagtaatctcctatgctgactttattacctaactgtgtcctgtggaggattaggtgatagtggcaggttaggtccatgggagattggattccactgtgatcagcaaacagaataaccagcatgtgtgaagtgacttttgtcagaggagtgatgaggagtgctctctgaattcagtgttttccctctttaatttttgctaatcatgggtcatttatctgtgagctactgcattgtttccactgcctgctttccaaccagggataggttttatctcaaaaaacagaagacaaaacctcttaacctaaaactaagactccctctgggagattccaaagagagacggctttgatgtaatgggaagggagctgatttagggtctaataaagtcttctaccagctgtgtgatctttggcagtttctagttccctaggtactatttgcctatctatagaaatggggttaacagcacctactgctgaagttggtatggacataatgagataccatacatgtaaggaaatgaaaagtattccacaaatactccttccctgagcttgttccttcctttcaccaaaacacacatattccatctttcaactctcctgctctacacgtgtatgcttgagtttagggccctggaataagcaatcctgggtcaacatctgctctgcaaacatcaaaaagtgtgagcaggggcagcctagccttggtattgatgtgtttcccatccacagccacattcaccattagacccagtattagtcactgggtccccggggccagcatttactgttgccttcaaaaatgcagactcattactaacaaaagtggtatgtccattattatgacctatttagtggcccagcaaatccccaaattctattgagccacatctgtctaccgaggggctctgcggttgattgtctgagacggatctgcttgcaaagaggctgatttgggaaagttcaacagccccacttagttgctctgtgacatcctgacttcctacaggttacttctcatattgttgggtgtttgtttgtttgttagtttgtttgtttgacagaggtctcactctgtcaccaggctggagtgcagtggcatgatctcggctcactgcaacctcctcctcccaggttcaagggattctcctgcctcagcctcccgaatagctgggactacatgcacaccccaccacaccaagctaatttttttattttttagtagagacgaggtttcaccatattggccaggatggtcttgatctcttgacctcatgatccacccgcctcagccttccaaagtgctgggattacaggcatgagccaccatgcctggcctcaatgttgtgttttaaagttcagctggaagatacccttattcctaagaaatccactaaagaaaactgttcttccaggagttccatttcattctctgggaagggtccatcccttgttcctgttccctttcctctgaattctataggacatatcacagcaccttcttgctgcctccttgtttgtgtctttcattaaactgtaagctccacacatgcagggactgtatttattttttcagagatgtgtcttcaacactgaatgcaacagtgacacttgacaaatatttttcaaacacattgaaatgagtttgatcaccacctgggcattcacagtagtccagaggtcccctgcactgtgagtgtgactaaagctcaggaaagtcagaaaggccagccaaggaaggaagatgctggcaagactcggaaagtgcaggagtgtatgagattgaatcacctggacaggggcacccaaacaaaggcgtctgctggctacgtgactttggttaagttgctgaacttctttgtccacagtttcctcaacactaaaacaaggagtaatcattatatctactttatagggctgttctggggattaaattagttaatatttataaagcatttaaaattatacatggtatgaaatgagcacaaataagtgggatgagggagacataaacaaaagttcctaaagtggaggttaattcagagccaaagacattgcctgggcattagaagtagtcagacatgaatttgagtcccagctaaggcatttatcaactgggtcggccttgaagaagccgcttgcattctgagtcttgctttccatagctatgaaatgttctcaatcacagttatctcccaggattgttaagagaagtttcctttaaatgttcagaatagtgaatggcatttcttatgtgcctaataaatattaactcatctactgccatcccttcctttctttccctctcattctttctcttttcctggcccataactttctgctcagaactggaaacatctttgaaggagggagaaggagcatgagagtcaggggcttgtttacaaaacaaaacatggaaatagtaaaaacaacaaatctaatagtctctgaaatgattttgtctcccactaggaccagaaaaagcagcagaattttatgttaatggattcggtggaaaatacggctttaatgaaacattgactatgattactctgttgtcatttctctgaatttctggtcctctttccatctctcttttaagaagatctgaatggttatttctcaacacaccaggattatgttttcttcgtcaagagtttgaggaacctagggtgcagcttgagctgctgagctgtctgtctttattctgacaggcgtggactccagtgtttagctcaagccccagggactggcttttgaacagcagctgttctcagtgaaactgaaatgcgcagaggggaggggaatagtacaccctgggaagtacagggagcaggtaagttgttttgctaatacatccctggggaagtttctagtgtttctgggcatggctgagcgcacagctcataaaaaatgcaccagatcattgttggcatttgatgtcagaagaagctacagtaccaagagacatggactgtctggtttcctgtgacatccaggtgacacaccaggtttccactgcttttcgtcattagcccagatgttcccagttacttggacagagagccttgtagatccctgtatatggagtcttccttcccgtggttcattagaaatggcaaagccaaactggcagtattcttcaatttgttgataagagtgcttcagtgcatgtatttacaaatacacattgttgttttcaatttgtttattcagtgaatcaaaatagcaaaacacattaactataagacaagagaaggataaggaagtaacatctattgggtacctgctatgttccaggcaatgacagagctgcttgacagaaaatgtttaatgtcttcctcattgtagctacatgtggtgtttcaggtatgattactgcatgttacagtgggaagtagcccagcattcttgaaagagtatagggtcctcactatctgtgtgaatttgagtagttacttaaaccctctgagctttattttatttctgtaaaggaatttaacaaagtggctaatagggtgtgtagggatgaagggacttttaagtttgctgaaataaactggaaatagattagcaggagagaaggcgtacaaatttattaacatgcagatgtgcacaggatccacacaaaatgggaagactcaaagaaaggccagatagttgaaggttaaatacccttttcataggggagagggaaatgggggacattgccaattttagagaaagagtaaataatttttagaggagatgagtggcctggaagaacagatgatagcctgggacaaagttcctctgcactatggggcaggtgatgacaagctataggaaagtgagggacagaactgcgcttcaaacaaaggttgttttattatacagataaagtctctaaggtaatggcccttagaagaataatgggaagaacaggtgaaaactctgtctgggtgtgttgtgggtgccctggaggtagagacttcttcttatctctcctgcatcagagttaatcttctctggttagtgtagatttcagggagcggtcaaagaccattgcattccttctggataaactttcttctggtgagagaacttcagagagagcccctccctacacttaggaaaggaatgtggggggtggggaaagctgtgcaggagaaagtcagagaaagaccttggttctgaggcctttcaaccttctttgttcaaagcaatcagtatgccaaagtaccatattttggggtatcattttctgagcctcaacaattgtcatgaagattgagtatgattgtaatataaagggctaacatttttacttgacctacatgagctgatcagtactgagagctcctcttacaagaaatggaccagagagggagggaaggggaaggggaggaaagggaagggaagggacaaaaagaaagaaaataaagaattgaggttcaggaaggttgaataatttaattcgcccaaaggcttacagctgctaggacgttcagccaaaaattacacccaggtctgatttcaaagacactaaaaccactgtttacttatagctacttagtgcaccccatctcatcccacccaatgccacctaactcccacctctattgtgagataactacatgcacgcactcatttggtaagtgggatcctggtgcctatttgactgacatttgagagttagcacatacaggtggcacaggtggtatctgcacagaaggaggaaggtggtgctgacacctctggatcttacacttgggtttagaacatagctggtcactaaagccacagggtagtggcagaacatttggatacatctttaaagactcaattagtatcccctcactgagtccccatcttattcattggttagccccctagactgaactgtcaaaaatgttctaagtctccttgtgttctctttatctttgtttttacaatcacaacacaataacaggagatactttttaatgaatgggcaggaactctccactgagatgtaaacatgttatactgggaattctgctgcagggttaatttatgatgatggagtcatctatatcatagctgaaagcaaggctttggggaagtgaaacccaggaaaggtcagttgtaatgcgcattgtctatattttaatgtaaaataccaattttgttgggaaaagggtggtcgggaaagaggtttgatccaaaaggttggaagttggggaaataattcaaaaagaaaactccaaataaacaacagagttggctggtcagttagccaaaggacaccggaggattcctgaaggtctgcatgtggtgagcacaaacttggtagggaaaaggcaggaatctgggtggggagaaggtactagaattcacaaggaagactcgtaaaatggaaactacggttgctgaaacacgttgtctactctattaattttctgccaaacatttcatgtgcttttagttcttcattgagcatgacatacttcaaatactcaaacctatttccttcttgtaggaatagctaggcatttcctcccacggtccaaggtgagactgaagataagtagaatctccacacttatttgtttactttggtccagactatagagtcaggttaaaagccatctggggaaatagccagtagccaatgcttattagcgtactacttgggtaggtgggaggatgcaagagctgtcaaacagcagccatcctgatgagaaagtgaagaaagccagaagcagcgtctcttctgtggcagtcacacagggtcccttgatactcagcccccaacatgagattgcctcttaggagaattctagaggttaggctaggcttgagacattatagagaacaggttacagcaccccatttttactttattggtaactgagaaagtaagatatattcctagcctcccagtcttagtagtaagaggtacttttaaactgttaatttttatgagcaacacagtggtatggccggcccttcctcctccttcagggagttcatttgatgtagtttggttgattcccatgcatgtggaatagctatgacatcatcaaattaagtgtacactatgtgctaacaattatcggggtgtcaagagtgaaacattcaggtcctattggcagttctaataggtgaatctcatctcactgttttatgtgttcagtgaagtaaatcttcagtaagtctggagtagctggggaagccttcgccaagaggtgaggtctgagctgggccttgagcattgctgagatctgaatgggtggaaaacagaagagaggtcattccagtcaaaagcaagatgtactcaaaaaatagcaaggaaaaacagatcacctggatgagatagcatttggggaagggtaagactatagtatggttggatttattgaacaggcacagtgtcaggaatccaactggctactttatatacactacttggtgttttatcctgcaaagtaaccctaataaccagtagcatttgctgagagtgtatgtgggtagcaggcaatgtatgagatgccgggaatacagagaaggatgattcgatgtttgccctcaagacctcagaatgtaagtctaggatatagtaacaaaataagtttattctagtataataggaatatatacactttaccaaggaagcatagagagcagaaccatttgctttgcctgctagatttcaaaatgacttctcagagatggtgagttctgagctgggtggtgaaggatgtgtaggagtttgtcagataaggagatgaaacaggcattccaggaaaagggaatagcaagttcagagacttggtatagtcctaaattatgtttgtcttcatttcagctagtgctatttcattgttgctggagataacacacacttggattccgttacgtattttcaccttgccaacttgctttgtttgcagaccataatttctgagtttatctctacagcaggttttcagccaaattgctctactaaaataaccctaaaaatctatcacctctgttttctgctgctgtcactggctgtttgtgtccttacttttcagtcaacctcaatggagactggaaagagaaatacaaattgccccagaaagagaacacaggcccctctcttcagcaacagggtgtgagtggatggggaccattatcacattatctacacagacaccgttttaatccacattgccaaggaggagaggaaaatgcatggccttcacagaacatcattaggagggtgggccattgtgcagcatctattgttaatgtcaatacctacaaacatgtccagactcttccattctttagcatactcattctctgagtggtattttatgtgtattattctctgagaggtaagcacggacaagtataattccatttttatgtaagggaaagctgagtaaagaagatgcttaaagaataggtggatagaaaaatgaaatgacttcagctcataagcattttgagtacctattatgttttagtcattatggtagaaacatggcaaatggatataaacaaaaaacatataattccatgcctctgttcagattgttgtctgcccctgagattcctctttttcccactccccttgactaactcaactagccctgctttttgtttgcctgtttgttctatttattttttggaggacagggtctcactctgtcacccaggctagagtgtagtgatgcaatcacaacccactgcagcctcaccctcctgggttcaagtgatcctcctgcctcagcctcccaagtagctgggactacaggcatgcaccatcacacctggataaaaattattttttgtgtaaagatgaggtctcactatgttgcccaggttggtctcaaacttctgggctcaagcagtcctcctggcttggcctcctaaagttctgggattataggcaccagccactgcacccagtcaactagccatgtcttttggtccaacccaatgttgcacctttgcataacaaaggcaattaaagaccacttcttccctcctgccccctgcaaaaacctaatagttctcaaacacattggttcatggaactcattatatatgaaaacccatcaacatccacacaattagcaaacttaaccctctgcagggttgacattgagttggaccttaagatatattcaaggctagttggctgggcttggcttgactcccccttagctctctctataaaagcaatgattactgtattatattggttttcaaagaattctgtcccacattctgttctacttattaccttctttgcttgactgtgatagattgaggccatctttctgtctgtccctgtattaatacattcaggctgctgtagcacaataccttagcgtgagcaaaggaagttaaagaccacctcctccccctgccccctgcaaaaacctagtagttctcagactcattggttcatagaactcattatatatgaaaacccatcaacatccatgtaattagcaaacttaacacacttgaaaatgctacctttcaagtcagtattcatattaggcagactttggagatgttgtggattctgcttcataccaccacaataacgtgattattgccataaagtgagtcacacaaattttttcgtttcccagtgcatataaaatttacgttgacattctactgtagtctattaaatgtgcaatagcattatatgtaaaagtaatgtacaaaccttaattataaatatttattgctaaaataatgctaaaaaattatcagagccttcagagagtcataaccttttggctgatggagggtcttgtcttgatgttgatagctactgacagggtggcagttgctggaggttggggtggctgtggaaatttcataaaataagacaataataaagtttggtgcatcaactgactcttcctttcatgaaagttttctctgtagcatgtaatgctgtttgatagcattttctaaatttatttcaaaattggagtccatcctctcaaacccagctgctcccttatcaactaagtttatgaaatattctacatcctttgttgtcatttcaacagtgttcacgacatgtttaccaaaagtagattccattttaagaaaccacttttcctcatccataagcagaaactcctcatccattcaaggtttctcatgagattgcagcaattccatcatatcttcaggctctacttctagttaccttgttctttccatcacatctgcaattccttcccccactgaagccttgaacccctgaaactcatccgtgagggttggaatcaacttttttcaaagtcttagtaatgttgatattttgacctcccatgaatcattgatgttcttcatggcatctagaatggtgaatcctttctagaagaatatttcaatgtacttcgtccagatccattagaagaatcagtgtctatggcacctatagccttatgaaaatatttcttgcatgataagacatgaaagtcaaaattattccttgatccatgaactgcagaatggatgctatgttatcagatatgaaagcaatcataatcttcctgtatatctctttcagagctcttgggtgattaggtacattgtcaatgatcagtaaaattttgataggatgttcttttctctctctctttttttttttttttctgagcagtagctctcaacagtaggcttaaataaaccatgatgtaaacagatgtgttgtcatccagactttattgttcctttgatagaacacaggcagagtaaatttatcacaattcttaagggagccctaggattttgggaatggcaaatgagcattgacttcaacttaatcaccaactgcagtagcctaaaacaagagagtcagcccaagactacaccttcgtccagcagaagactgttttgtctgcattgaaaatctagtgcagccatctttatcaatgatcttagctagaacttctgaatagcttgctgcagcttctccattagcatgtgctacttcaccttgcacttttatgtatggaggtgacttctttccttaaacctcatgaacaaacttctgctaagcttcctacttttttttcctacagcttcctcactcttcttagccttcatagacttgaagagagctagggccttgttctgggttaggctttggcttaaggaaagattgaggctggttggatattctgtccagacaactaaaactttctcatgtcagcaatcaggctgttttgctttcttatcatttgagtcttcactagagtaggactttcacttttctttaagaactttttctttgcatccactacttggctcagtgcttggcttagcttttagtctatcctggcttttgatatgtcttcctcaccaagcttactcacttctagctttttgtttaaagtgagagacatgagactcttcctttccctgaatacttacaggccattgtagggtcattattgacctacattcaatattgttgtgtctcagagaatagggagacccaaggaaaggggaagagattagcgagtggctggtcagtggagcagtcagaaaacacacatttatcaatccagtttgggcaaggtgtgtggcaccccaaaacagttacaatagtaacctcaaagatcactgatcacaggtcaccataacagatataataataatgaaaacatttgaaatattgtgagaattaccaagatgtgacacagagatgtgaagtgagcccatgctgttgaaaaaaaatagtgtggatagatttagatttgcctaacttaaggttgctacaaactttcaatttgtaaaaagcataatatctacaaagtgcaataaagaaaagtgcaataaaatgatgtttgcttgtagttttaaagttttgtatgaaaacagtagttggataaattgtttgcctaagcctcttttgtagtcagagggctattgtatgtacttggaaaaagtgtacatgctagggacttccagggcagcttgcatccctgaggacgggactaaaaataacagagtcccctgctttgtgggacctaaagcttgtacaatttgtgtgtgtgtgtgtgtaacgtcttgagtaaaaagaattcaaaatataaaaatgatttcatttaaaatgaaaaaagataatgaaaaattacagattttaagaagttggtaaatatcaccgaaatggataaattaatttactatttgcaactaactgcttgacattcttctataacacttttttctataaaattaataatgttcgctatgaatgccttttcatgtgaaaattctgtaatattcctttctacagataggatagaaaggtaattcagtctttcctctggcctggttcgtcaaactttctaaaaaattatggatagtttttagagtttatattggtaaatttaagtgaatttttaaaaaatgttataacttctggcaaacctctatcaaagtacaaattctggtcctgggtgaccagagaggacccctaggtaagacagcactgggggtgggaggagcatttctggaagccattttgacacctggacagtagcaataacttaattctacaaggacaagattgtaagcttttttttttttttttttttttttgagatggagtctctctctgttgcccaggctggagtgcaatggcacaatctcggctcactgcaacctccgcctcttgggttgaagccattcccctccctcagcctcccaaatagctagtactacaggcatgcacctccacgcctgggattacaagcatgtgccaccaggcctggctaatttttttgtatttttagtagagacagggtttcaccatgttggccaggctggtcttgaacccctgacctcaagtgatctgcctgccttgccctcccaaagtgctgggattacaggcataagccatcacacctggccgattgtgagctacttaaagataccccaccaaagaacttaaagtgttccatctcagcaccctggccctgtgttgtcaagctgctcccccttccatcatactgtgcactgtatggtgcctctttatgaaccagacgctgcttgtgcaacagaggctgatcccactgcagagactgtatttgtcttctctttattttactggaagtctttgccaccatccggctggtaattgctccacaccacttctgaatcgattgcttttagagttgttgagcttttattactactactcattggggagagaagagagaaagaagcaggttggcctgggctctgcaagagacggatgttgtcaaattgtctttctccagctgttgaatacaactcataatgctattcaataaaaccagaaagaaaatgagagtacaagggaaagaagagatgtcagaaagagagaacaagagaacatacgagtctgccttctcttggaatagacagcaaagccatattgtgatgttgactatatcatgcagtaatggtgaacaaatgtagcaagaagtaaaagacagagctatttaaatatatctgtgggcaattgcacaaatctgccacttttgtaggtatactgatgtttcctcattcctggagctgagaaaaagggtctatgttttgctttattttatttctttcatttagtttggtaggctatgtaatttgattcaagtatgatagaatttctccttagttatacacattactgttattttgctagtaagtggctttgtatccacaatcaggacactcttatgaactgtttacatctgctattgactgatctcgttgcgtttcctcatgctttcatcaaaaggtagcagttggcagggccattcactggagaatgaggaacacgcataattagatttagtgaagaacaccctcattccaattggaatctgtctttaagaaaagaaaagaaaaaaagctccaggttaaggagcttcgaaagactgaatactgatgtaacttttgttcatgctaattactcacaacccagataatacttcgtttaatgattttatcccatttgttatcccctataacattcatctgcataaattagtttcttgtcaacctttcagaaagggtttaatgacagttcatggtgtttacttattttctaaaagtagtctaagtgagtcattataaattgaacattcaagttaaatttgtctgaaacatatataagtatcatataaatttcagattttacacagggttctcctctactaagcaggtggaatataccccccatttcagaatgccagtttaaattacttgcctggggtaaaataccaaatcagagttggacataaaacccaggtatccttattctcattctactattctaataaccagatccaatgctataatgctgcaaattataggccctatttttcgagtaggatgcatgtgaatgtcatttgtctcttaaatgcatgaatagtgtcttcccttgtggtcgctctactgcttccagcctgtcatgtcaagcagcattgcctttattattgaaatgaagacgatacttagatcattgatctcaatggcatttggcaccataagaactaccagtctgttgtatcatataaaatgatactgcctggtatgcaaatcagccagtgtgtcaacaaaaatgctggcatcagatagaatgtccaaattgctatcactctgccagttttacacctacatccctattagttcctgtctaattaccaatgataaaagtactttgaagtcccactgatttccatgtaaatatcatacaaatttggatttgctttaacattataattccatcagcttagaagttaaaatttagaaaagctgtagttcattagtttaagtcacttcaaaacttaccttgcttagttttcagatagactcccatcctatacttctaggactgtacaaataaaaaaatgaattaaaagacatttcttgatgggtttaatgttttctactaattattttgacagacagtcataatctgttctgagttcttcttttctccttccatttcaattcttcataaaacatggaaaaaactttggagactgaataagatctatggtaatccacaatagatgaggccctgaacacaacatagggaaaacatataacccacccccaataagctcaacttactgtaaactcttgaggagtaattagggacttcagcagtctctctgaaaaagccaacgcattgtaaaacccttttagtttttacatgaatattaattctttgaaagtagatgaaagactttctttaatgctaaattcttatccatagagaataatattagagcgaggatctagtgtattattcccatttcatgaataggaaacggagaagtagagaattttagggaccataaaagtgacccaagtgccatgtgtcaaagctaatatacttaactcaagcctattccagtgggttctcacccttcacttgtgccctaaggcctggcagcttatttcaggagggacacccgttgttggtgtaaagagcaagatcttttatgggtatcagttttaaggggcttatgggaataatcaatatgctatggaagtaatgaagatatttaacgtcctgaaaattctagtctaagctttgagaatgtgaccataaaattgacagggattaactttaatatttgactagttaacggtaggattttttccgttacagtgcactgtgtcaaaatttggtctcgttaaataaattcctattctatcagggatgagcttcccacaaataatgttaaaaaaaaaaaaaaaaggagaaagcatgataaaccttttttcctgtttctcttcttctaaccacagggtgcactatggcagttgcagggcttggtaattgaattcagttctgcaacctgaatacatttctactgtaagtggatctccctcctctaccagagaaagaaaatggcctcaaatgattctgactggaacacagcagccacctctcttgtaaatagctgggtcttattgacttatcttggtagggagccaaaattgctgcccagatgagtccaagcagtagccagaagagaaccagctacttatggggtctctgtctttgtgaaataagtattaagagggtccatcttaaagaaggaagagaagtatggtcaggtgagtcaggcaatgatgcttagtgaagtacaacctcagagttacggtttttaataatacgcaaaattacatgtgtaagtgtattgatatgttttataatacagcatgcccagaatctcaaaaagattaaaaaaaaaaaaagatgttcctaggttctaagtatttttctttgcatagtggtttgagggcgagtcaagtttataggtgtgctgacctttaagagagttaggaataaaagagggcattgagagaaagtggtttgggtcgcagacaccatccctcaaatagctgacaatgaaggtctataataataattggcattatctcaatttgccaggtatctttagtagaatgtgctttatctaatacccaaggtagggtttcaacaatgttgagaatctatttatgaaaaggccaagatgataatgttagctaagtgctaaatataataaaaagtagtcatgaccaccattctagacaagcttcattgtcccgcacactttatctggacctgtggtttctggatggttaagcggcttgtactcacaaagacaaattgtgcattcttggaatacattcttggaggtctgagagttttctgtgagtggtgctgaaagtgtatatttcatctcaatgacaatctcaaaaaattataatgcaagcatattctgaatgatcttgttgaccacctaataaccaggtatttttatagaattttaatgcttgtgttgagttgtgttcatggggaacaaacctgtcataccttatttggtaaggactattgagaaaagagcagagccaggttgagaacataaggaatgcatttatgtcaaggaaaaaataaaatgatgccagagtctgattttaaaaacaaagctatctcacgatttcaaatggagaaaacagggagggagaataaaatcacagcaagcttaattaggtgtgagcatcatgacctcaggagaacctgggccagagaagtcaggagtattaatgtttaccatggaactggtaatttcatttaaaccaagcagcatcagctgtcacattaaattaatattattgaaattttatagcatttatatttatttgtatttaatttataaatgggtgttggttgtgtaagtgctataagtataaatggattgtagctagttttatgtttgtgtatatatatgtgtgtgtatatatacatatatgtgtgtgtatatatacatatacacatgtgtgtgtgtatacatatacgcacacatgtgtatatacatatacacacacatgtgtgtgtatatatatatacatatgtgtgcgtatatgtatacacacacacatatgtatatatatgtaatgctaacaaaaaataatttgaatgattgccaggggtccccaagaatgagctttttcttttaaaattggcctgtactttctttgagaagccttgccacgggtagaggagctattcagtgcctattgagtcaaaatttggccttaatataaatggggaggttttcccttgccatgtttggtgcctgctaggtatagtcacttgctctaatttcagtagggtggtggaaattaccaataggcagaaaaagacagctttgctgacacctatttggttgaattttacaaaatggaaggatgaataatacctcaaaggcaatctggtagattctttgagggaaagagatgtgtctatttacagggaataaagctaagcacattgactgttcttaggttaatggaaaagaataaggctagtgtaggagccagcaaattatgtttcctccataattagagtcttataaaaatatcagcgtgaattacttgctaaatacaaattacaattgttaatgtttgttaagaaaaataattcaatttagagcaagaatgaaagaaatacaggcacccaagaacaggcacagaatacaatcactttaaccaaagcttagcatggattattttcccccacttcagcttcaagtttattctaatctttttctggggggcaggagacagtcggaggggaatgcatctgtatgtcccagctgtgtggcttctgagcctgacacccctgtgctctaacaagacccagggaagaaatccttagcaggctcttacccttatcagaacaaagctatttagttgccaccttaactccagtaattaactcagtggagcaaatttccttatttcatgtaagatgtgagccaaaactctccttgctgcacttcttctatctctgggataaagccaaacagagaagaaactcaaggaccatagaatctttccttgcttttagttttcctttgaggccctacctcccaactccctcctcacctctctccttgaccactgagtagtaccactactcagttaatactgaattttcttcttttccaagccctgcagtttactctagaatttctactgacaaagccaaatcttgctgtgatttttgcccccatggagaagcatgtattataggaacaactaaccctttataacttaggaggccctggggcttcattgcattacagagtcatacaaccataaatgcccagacatacatcaccagggttaaatcattttcagtatgaaatgatgtaatccaatttgaacactgcctcaaacccagtgcccttcatgtggtaagtattcaatacatacctaatattttaactttatttatttttacctcctccgatacaaaaaaatgtaaataaccctcaatgatctgtaaaaaatcacttagttggaacactttgttcatcctctagcaatgtctgataagttagttatcattacatcatgaatcatgatactcctcatcaggcagtaaaaatacagtaatttcgtttaattgaagggaaatacatgtttaccttggtaaaacttatatattatctttaaataaataaagggttatcttgttcaaatagcttaaacccataatcaaatgttgcttatagaggtcctgctttaaggatctcataatgatttgcatatcattagcttgtcagaataccatcctaaaccttgctgatatctgctctctttgcagttcattctttgttgcatccaagtattacagtaagttgttctctggcaatttgtttatactaatgatttgacagttattttttgacccttgaatgacataattatgttaaatacagtttaggctagcttgtgttcaaattgacatgaatttttaaattagtaatgttggtatctagtatatgacagaaatgaaaaataacgtattttgtatttatgcaagaaattatctgtaccgatcaaaactgacctccggacacaagaccagactggacttgcatatgttaatgggaaacaaaatggggaaggggctcctaattacttaagtttattaagaatcccaggatacctcttagaatggtagaggtgatgttagcccttatgtcctggacatgatccagtttaggtaattgctaattacaatctgtctacttaattcccacggcccttgcttctgaatgttattttcttcacttagcaatatttaactattatttgctcttggtgtgtgactgttggaacatctgctgattcctccttctacgttcggcatgatttgcttttcatttggttatttgataattattattttcatattatttttgttctaaatatgtctatagatagaaaacagaagccctgtaaaagttttagatattttttaactgcgtgggctggactatgctttgtcaatcgagcatacagactttctggatgtaagtttgggaacagtgggcataccactggcccatgaaacactcactataagatagtgtcaactcagaggtgaatcacagatagaccagggttttcagtgtcttcaaaactagggctgaaatcacagcacttaggggcttataagtagatccctctaaggatctatcctattctggagccattccaaaacaagagtacctctgttttgggtgctagagcatgctttatttcaatcacaattcaatggaactgaagaacagaattagaaagtgatgagtcaaaaattcttattcaccgcaaatacagggctagataaactccaggtattccacacagtttccatccctctgaaggaagcgagattactcttgtgtccgctcagctatgagcaccttgatttgggatatattgcttggagttcagatggagaagacatccaggttttatctataaactaccctccatatctctaaaagttacttagaggaaatcactgagttgaaacttcattcattccctagcattgtcagatgaactgaagcatctttttcaatagtcaatatatcctgagccttcttagtgaacacagtgcttagaactttcaatgaattcacctctctaagattatggactacatattccaaatgtgtagattttgacctaaattttacccattctacagaaaaccaacaaactccacctcagagagatgttctcactatatctacccaccagggtaccagtctaaaaggccccaatattttctcctgtgttttctgaataattgtgtttgagctagagccgggagactcctcctgtggcttttattaatggaccaaagtttggttcctgtgaggactgcaatgtgtgattcaaatgcccagtccatgattcagctagtgaggggagtaacccattttatcagttgtgctgtcttccactgctgttctctatattccatcagaggaaacaaatggcttctattgtgcataagaatgccatttagtcccaagcaccatttgaaatggaaatgaggagtaacagtaacagaagaacattggctaataattgtgctctgaatagccatttggccatgtgggcagggtaaaggtaattgtgtcctagagtaatacatcttctgagcattccctgagactataattgctatgttgatgggatgcatttttaaacatgtgattgcggctcttagacttaaaaaaaaatggctattttcagaatgatctgactttaagatgtcaggcaagattttgaagtcagaataacaacacacaaacacagatctaagatgtattattgtgtagctacttgtctaactgcatttttttttcttaagtctcaccctgtcttggtgatacacagattaatactaacctcctaccaaacaatccctgttgccactctactgaaaatacattcttgccttccacaagcagaaggctgagtgtctttgtggcttaggagagaacaaaaacacatctatgtattcattgccttgttcacttgcacaaacggagaaaactctttgaaaacatcttcctttctcctgagtgaaagaatgagcaggcgctgcctcccctgatttactgcacccatcctaatcagggtagatgattctgatcttgcattaaacaattactatgcaggctctgggcttaagttttgacttaagtttagaaattgagtagttcccacaatgccctccatttctaaatgtatgagaagaggatcaacaaagaaaaaaattaatgggcttttgaatgagcaacgtgtgtgtgtgtgtgtgtgtgtgtgtgtgagagagagagagagagagacagagagacagagagaggcatgatcttggctccctgcaacctccgtctcccgggttcaagtgattctcatgcctcagcctcctgagtagctgggattacaggtgcccgccaccacacctggctaatttttgtattttttgtagagaccgggttttgccatgttggccaggatggtcttgaactcttgagctcaagtgatccgcccacctcagcatcccaaagtgttgggcttacaggcgtgagccactgtgcctggccaacagaacatattttaatgtctgaaaaaaaagaagaatctactttaaacatcaccagaagggatacacccttcggtgtccccaggccttgctggcttgctgtgggtataaagcattaattcttgtcatttgctggttatagtcctccaccaaaactcttcagttcttggcctctaattcaagctttcttccaagtttctctccactctcactgtgtcatttctaggaggcctcagagttttccacgctagaacacagtcggtactctcatgtgtgttttcattttagcctctttgttgatgtctgctgcctgtcaatccacctgggtttgtaaagtccctgaagcaattcctgccatgagaatgttccttcatccagaatgctgccttctatgctccccaaactcaaagaccttcagggaccagtaaactcaactgcccaaagccaagcacagctgtccacagaattggggcagagattcttctccataggactctggcctggtgcataggtttggctgaggaaaagacatgcttttctccttccccttttcacttctatcccttttcaccaggactcttgaagaatattctcacaggcctcgtttcccctcaggtcagaaaatatgtgcggaacagaccctgagatgctgactgtgcaaggctgttcagacccagtcaggtcaggccctgaatccttgtgatatggaatgagatatgataaattggaaattgtctttaataaattgccattcgtgataattctagtgataattaatctgctgaggctgctataaaatatcatagactgagaggcttaaccaatgtatttccacatagttttggaggctggaagtccaggatcaagaacaaggtgctagccaattggctttctgtgagggatcacttcctggcttgcagtcagctgccttcttgctgtattctcatatcacctttcctaggcagatgcatgcagagagggcaagtgagctgagcaagctcactggagtcttttcttgtaagaacactaatcctattggatcagggccttcacttttgtgacctcatttatcctcaattccttagaggccccatctccaaattcagccatattaggggttagggcttcaacagatgatttttggggcaagtattcagtctatgacaatcctcatttaaactcatcagggaccattgataaaatgctattcattcttccctatgctggtgtggaaatttgccacccaatggatgcctgcaatatatgccagagactttaggtacgctgtggcatggcttagtgactatgagaagactgacatattagcttggactagcttttgttaagcaaatggactattttacaatccaagaaaatgaacaaaattccgttttacttactcaagataaaaatgcattgatactgcaagacatatcctcactgaaagatagggtcacttaaaatatcccatttaaatgcaaaggacactagaaagtatagcaagacaaggtaaagaaaataacaaccttgctaacatatgactaaaataggaactggcagctgggggtgatgagagaaatgaaggcagtcagctacacactgactgccggggagcatcctgcacctcagataagggagcttccgcaatgaatgcctgggcctttggctttgtttcaagtcttttgatctagcggagtccataggatcatttttcccgtgggccagacctctggagaagcaattggcattgttagtttgcactgttagttctgaagctagtttggtaacaaaaagttattgtagtaagtgcacttgtgtgtgtatgtgaggggtgtggatagatgatcatgttcaagtctgtagtagaaaatttctaattattgagtctagagaactaagaatacttataggaggtaattaatccttacccgacatgtggaaaatgtcttataacccttctgtttaatttaacaaaaatatagtctactgttcagatggttaccactcggagcaactcaaactatttccctacagattttcctgtagagaatgaatgagaaatttttttgtttgtttaaggcctgaaattttactaccaaagtcaaattttgagtattgattgttgagtcctgaggatggttatattatcatgacaaatcttgcttattgtttttaattagacaaaattttcaaataactgtgagttattacatatctcttttattatagtgttctatagattgtattttgtttcattacccacactacacacacaaaccacatatacacatgcacaacacacacacattctttctatacttcatgtgaatgctttgagacaatcctatttaacattgacaatgaacaggacagctggtctctcaataaaatctaagataccacagtagtatctgcaaataatatataaattagaaatatttggaatgtttagtttatttgctaaagctcttcagaactataaattacaatattaatgaacttatttttaattcccatcactttcatttttatagaatccagaaataatgcatgtaacttgccattcctccccattagtacacttgagtccaaaggagaggttcacagcatcgtgctcttttgtgatgtggtttagaagaaaaccagctcaggacaagtggactctgaaaatagcagactttcctttactcatcttttgagttttcagagaagagtagagattcagttcattggatattttctttgtactaggctccatgctagaaattggagaaaataataaatgagaacctatctttaattaccattctagaaagaagacatgtacattaaggataatatgtaatggatgtcataatataaatatgtacaaagacaaggtgtagcatagaaggcagatgaattgttatgttgattggagtgtggtttctgttaagggatgacattaatgaggtatcgcctttgcaacttcaagaatgaatagaagttaatcagacaagaaaagaaccatttcacaaggaacaatatgtacacataattcaagacagccagaatgtgaagtaagaggagactcaagttttgtcagcatattatataagtaagggtgagttttggctttgagagttgctttgttgtgtttttccagatagatgtttttcagatatcttctcccctgtgagaaatttctgcaggtttgattgatcctttcagatgctttttaaatatatattagtttcatcactttaccacattgagagtccatgtatctttgactcaaatgcctaggaacagaagatgtgaggaaagggagagagagagattctgtcatttaacaattattattcaagtacctaaaccaaatcgaaatgcctaaaggaatgcagtgggtgatgtaaaagaaggtgtagggcaggtgtaacaacacagaatggtagagaggtgggaggtggggggacgggagagtacgcagctcttctaaggtgggcagctgccttatagcttcagccagttgtcacacagcactggttttgtcagttttcagttctttgaaaaaattggaaatgtgaaattttatatggaactgtcaatttgtggaagttagaaaccactcgcaggccagcactgggaaggccatatccagcctgacttgctctgttttatacaccatgcactctcagtggttgcctcaagggctttagaaagaaggtcaaccctttgccttgtggcttttgtgcattgctttcttaagaggaacataaggaaactctactgttctcagctgctgttgtggttacttggccatttgtaagacttatatataataatgaagttgtcttggagggctgccatgtccgtgatgtagttgcttatctaattttgtaatcttttatcaattccctctacagcttgaaggccaggctgagggtatggtacagaatactaagtggtttcaaatcaagtccaatctctgttgcaatttttattgtgataacaagatatattattaataacaataaaagacaataataatgtattattatattgtaagcttaccatgaagtgtatgggcaacccaaaaagatattcagccatcattaaaatcttttctaatcacagccacacatttcatattatattaaggaaaaacataaaagcaatcttgatgttaagtagaattagtaaagacctaaaggagtataaccgaataaacacaaagtagaataagtaggccagaatatgattgtattctatcaacaatgttatatttgcttagaaatctcttatatttcttcctccaaatatgcgtgcatgcacccacacacacacacacacacatacatatatacatatatgtatatctgcaattgtctaaaggtagatggtatagcataaaggttaagagtgtaaatttggggttcatactactagagtttcacaactgcctatgtagccttccaaaaatatttagcatcctgagctgcagttttctcatctataaacaaggattaataatagtatttatctttgtactattagatatgattgaataagatatttcatgtaaatcatctagcgtactgccagatatattttatagtcattattaatgcaaatcattattgtatcattattattactggagttttaactctctggctgttggcaggaggcctcagttcttctacccatgggcctctccacagagctgcttgagtatcctcagacgtggtggctggctttacccagggtgagtggactggggggtttggggaacaaactaggtagaagaacacctctaccatgtctattctttagaagcgagtcacgatgtttggcccacaataaagaagaatggaaatatttgctaaagattttgcagatgtattttaaagccacaacaaggcaaagggttattattcttaatttgcagaagtaattgagactcaatgagattagataacatacccaagaaaacacagtaaattgcataacttatttactggagctcctccccaaacccctaaactatgtgacattcttgctttaaaaaaaaatggattatacagcacgtgtcaccactgcattctcttttttatgttgttcatgtgtgtctgtgaaatgtgccttctaataaaaatttgaggatcttatacttttccagaatcattttgttgaagtcatgttttggagtacatttgtatgcaatccgtctgataagggaagtatatttctcactggaattagtataggcggaaaacaccatcaatcatagtcatcacaaagcaattaagtacctaattgttcatggctctgagtttgctactgaaacagaaaacttcttaggcttgctaagaaaacttcttaggcttctaagccctcctggggcttggaatccaagaattcagtagaagacggaagcgtggtaaggagaacaagaactgaagacataaacaaatttatttgaaatatggttgcagtggagcagggagagtgaattcaggggaaagaaaaataaaatgaaataagatgctgaggttcaagaaaggataaaaggtaaagtggctgaatttaaatgacctgggtttcagtttttaacaaaacataaaaataactgaagaaaggctctatattttatttaacaataacaacaacaaaaatcaaagtgcttgtttatcattgggactcaacttttgcagagtttttgccttaatttttttctctctaaagcagaatttcccatcactttagattcctttccgtgtcaatgatggcttttaatcccaatttccatcattacccctcagtgaaatgattgcttccatgtttgagtatatatacatatgtctgagacttaggtcaattattttcatgcagaaatcggggagggtgctcctgtttttcatatgcatttgtaaatattttcaatcaatcatgcatttataatccaattgggaagatatgattcagacacaatagcccgtctgctgcaagagtctgttataaaattgatcagttggccaagttatgctatttttttaagttactttgctttctttcagggaagaagaaagacaaaaaagtccagaaaccagcagcagcaggtgctgccaaaatggtattcttcttatctgtgctgatttcaaggggtgtgcaaaagaatgtgtagttgcttttctctctggctgttgggatggcgtctgtctctctggcattatccacttatttgatctagctaagtataggagcagaaataaattaaaaatgctttttcccagaagccccaaggatgttattcacacattctcccttctactgatctctgccagtggtgtgtaaatatatatttagggggaagtggctgaagtcaaaagctctgttggatattctttccctttcagttacttaccttcttatgcacaaatagaaagagagaaatcagaatagcagagaaattaacagacatgacagcacaacaccttctttcccatgtgctgatttgaagaggctcatgtatttatgtcacaaatgtcaaaattcaagtttctaagcaaaagaaaaaaggaaaaactgctaaatgttaagtgatttgcttatttgaagagttgtattacaaagcaatggaatgggagagctctcccagcccaggaaagacaaatgggaagacgggtctattttcattttggcattggacagaaggcagccttctggcctgctgtcacttcctatctgttcagtcttcgttttgcttccccgctgaccatggatcggattctgactcatatcagagactccctcttctgatcctatttatttatctgaggattttttcttttctttttccatagactcctagaatccagaggaaactcagtggcatctctcatattatcctaagctttctcagaaatgtgacatcaatattttaaaattttcagtagttatcaatatttcttaaatctagcagtaaggatggtctttgaaatatcttttctaaattccttctgttataataaaagtcagtgctcttttatatggtttggctgtatccccacccaaatcttgccttgaattgtaatgactcccacgtcaagatggggccaggtggaggtaataggatcatgggggcagtttcccccatactgttctcatggtagtgaataagtctcatgagatctgatggttttataaatgggggttcccctgcacgagctatcttgcctgctgccatgactttgctcctcattcaccttccatcatgatagtgaggcctcccaagccttgtggaactgtgagtccattaaacctgtttttctttatcaattacccggtctcagatatgtctttattagcaccatgagaacagacaaatacactgtttatcatattcttgacagcaataaaacaattgcttactgtcagctcttaacaatctttagtataattaagatagtctatttggattctttttcagagccttctatttttcagtcttttgaatgtactcttattgctaaatttggaatatttttagttttgctgcatcattttttgaatttacctttctcccctcttttgcctattcattattcaaaaccagatcaaacactctttctgtgaagtcagtaacttactccttcagaaatgtaggtacattgaaattggtaaacattatcacactttgtacatacttttacagtgactatgtatatgtgtgtgtttgcaaaactttctgcctcattggacaataaactcctcaagtgcagagatcttgtgttatttatctatgtgtcttcagatactaaatgtggcacatagtagagctccatacatgtgtattgagtaataaattaatgaataaatatgatgctggtggcaggtaaattcttggtgtttactttgaggtccggatcaatacaggatcaggatagtgcttctcttacatctgtttgcacagcagaactgtactgcactgaccagatgtctcaaagtaatgtccatcttgcctggaagtgtctttccttacttggggtcttttaccttcagaaatccaggtgcattcacaatctgcactgttattataccaactctaggtgaaggatgcatgatccaaaggtccagagtttgaaagcttgcagtctgcaaaactgccctcacttctgatttgaattgcaagttcaggggtttctccaaatcactttcagatttgataatttgctcataggacttacaggactaactgaaagctgttggactcatcattgtgatttattgtaaggacaggatacagattaaactcatccaaggaaagggacacatggggcaaagtgagagagctccagatgtgtagcttccagttgccctctcccatggggtcaaataactcctccaggcaacagtgtgcgacaataggcacgatgttgctgacaacagagctctcctaagctttggtgtctgcggtttttggaggttgggtgggtgcttcagcacatacacatgattgcccatatatatatagctaatctcggtctccagcccctcaggagatagacctgagaccatgcgccccaagtcccacaacctaagccgcatcgttggtgtgactcacaacccccaccataagtcacattgtcagatattctggcatggcagcacccacactaaacaaagatgtggctcctactaggcatgctcctcctagggctaaaagatttcttcctagaagccaagagcaacagccagaccattccctgggcaagattaaattccttactgaaccacattttagttcttccacacaggtctcaccaaacctataatttccaagtgagagaacaggaagcctcatcttgctttcacagcttgagacaaggcaaaaggaaacgctgttttgaactttgtagtcagggtgggtgtgtttacaagggatacaatcccctcaagtcaatttaaatcaagaatctatatgtacagtggcatacccagggtatgtggctgtaagtaaatcgtgttttaactctctccctctactttcttcctctcaatgacaaaattattttcagtaataattatttaataatatagtaattctcaccatattttaaaattgctcttcagttttaaaacaatttacaagttagaagcatacatttcaattttacagctattattcaaattcagtagaaatatttcacatatgacctgaaatttgaacttaccaagcaaaagtattatataacacagacttctttttttctactttactgagtgagtggacacagatgaaaaattctaagttagaaattctaagtggtcctaaggaatgaccaaattgaataactcaagttttctttcttttgtcattacaatcagtgtgctatcactttttattttaaatgttggtttaagcaaatgtgtacgtatgtgtgagatatatatatatttcatatatatatatatatataatatatatataatttcagcattaaggagacattgtgcccacataaagtgataatgagactggaacattacaaacttactccttcaacgaatgcatgtagccaatctatgtgtgatgggactgataatataaccaggagctctccaaattatcattcatgtagaatacaatggtttttaaataatcggtaatagaagttattaatttgaggcttacatatgaatctgaaatgcaacaatgtctgtagaaattgtttagaattttgacaagatttgtttgtggatggagtttctttttaaaagattgatatataatattttacatatcagtggggtccatgtgatattttgttgcatgcataacgtgtaatgatgggtatttgggatatccatcaccttgagtatttatcacttctatgtgtaggtaacatttcaagttctctcttctagctactttgaaatatactttgttgctaactatagtcaccctactctgctatcaaacattagaacttaaaccttcttctaactgtatgtttgtaaccatttgccacatctctttatcccctcatcccacccacacacccattccagcctctggtatctatcattctactctctaccttcttcatgagataaacatttttagctctcatatgtgagtgagaacgtgtgaaatgtgtcatctgggtcttgcctatttcatttaacgtaatgacttctagtttcatccatgttgctgcaaacacatgattttatccttttttatggccaaatagtattcatatatatatcacatattttccttatccttgcatctattgatggacatttaggttggttctataactttgctgctgttgtgactagtgctgcagtaaacatgggagtccaaatgtccctttgatatattgatttcttttcctttggataaaaattcaatagtgggattgctggtggatggagtattttatcactgacattgtttagaattgtgaagggaaagcagaattaaattttctgtctctttaaactcagtcatcttttctctatagcacaaaagattatgttttttttttttttttcataactcagcatctttgtgagctatgaaacttgccctgatagccttttcttgcctagggtaggatatattctgaggaagggctgggactgcccatgcattcctgcagagcattcacgggtgctatttacagtcctaattaaatggaggattattagaaacgggaaggcagctataaatagcatggtccattttatctgtttctttggtgtgtaggaagagcattgctaagattctcccttgaagttcagttaactcagaatgtgttctgcttttgttattctgctttggcttaaaaaaaagtctcctgatgctgttcaaagtggggaaaagaaaacaaaaacaaacaggagtcactctcagtcattttagcatatggacagaaggaacacagaatgaaatagagttggggaggggtgtgcacggtataagaaaaaaaaatgtgggcctaatcctttccgataacttttttttctgaaaacaactattaataaatcttatttccaagtctgtagaatattggttctcttcatccaactgtaatgtgatcagtctgttcagggagcagaggagtgggtatgggagccttccctctccgtggtcctgttagggcaccttttccagggagtggggactctgctggcttctctttcagcacactggacggtgcagaaatcagctcaactctagaggcagtgctgggattggaatggaacttgacctggatcaaatcaccgagcctttgcaaattcctgattttccaagttaggacatatctttagacccagagcccttaatcttggctcttgggataagcttccttactgcttctctcaacactcatctccacctccagcctctgctctacaagctgccactcatctaccttacatctctgatccatccccagtattcaacagccttcagcatttcttggttacctgttttaaatttcccaagttcttaacctgtgtttataacaactcatgaacttccaaccaacacatcaactccagctccctccagtactccttctttcaaaagggttctagtcaaaggggtttgcaggcattgcttaagctcatggggtgttttcgtcaatgccccattggatttgttcatgtctttgtttctttgatatatcatccttcttctcctacttatcttaattgatctcaaagctcaagtcaaattatatttctcccagttggtaattattttccccttactttaaattctgaaaacgctaatgactgagcttttcatttagtactaactggatggttagttttctttgtgtatgtgatcgtttacgtggtcgttttgtttctcaccaacacattgtaaactcttttagaattgttatctaatagaaatataagtaacataaacctgtattatatttttggagcatctgaaagatttctctcaaatggtctcatctgatccccaaagcacccctctcaggaagtaatttttttatttttatttttggggaacagggttttactctgttactcaggctacaatgtggtggcacaatcacagctcaatcagccttggcctcccaggctcgtgattcacctgcctcagccttcccagtagctaggactataggcacctgccaccacgatgcccagctgtttttgtttgtttgtttgtttgttttttaagtagagacaaagtcttgctatgttgcacagactggtctcaaattcctgagttcaagcagtcctcccttgtcttggcctcccaaagtgctgggattacaggcatgagcaaccatgcccagctgaggaggtataatattatccatagtttcacatgtaaggtaataggagctcacaagggttaaataatttgcatcaaatcactcagctggtaacttttagatccagatttaaaaattctcaacttctgactatatcctatgttttttgtttggttttgtttatagcttgcagttgcttttataattattatttttttgagacggagtcttgctctgtcactaggctggaatgcagtggtgtgatctcagctcactgcaatctctgcctcctgggttgaagtgattctcctacctcagcctcccgagtagctgggactacaggcatgtgccaccacgcccagcaattttttttttttctagtagagatggggtttcaccatgttggccaggatggtcttgatctcttgatctcgtgatctgcccgcctcagcctcccaaagtgctgggattacatgcatgagtccccactggatttgatctttacaaattaatattagcacttgttaactaaaggaatgaagaaataagtgaaagaatgaaggaataaatacataacaacattatgtataacacagatgagtgtaatgattcagcaaaacttcattataatctcttcagggcacctcctggaaacctgagaaataaaactgttttattactggtacttgcctttctcgaaaactgatagtaaacgtcctgacaagttagtcttaggtatctttccttcagttcaatagcaaatgctgtttaaaagcaaatacacagcatttatagaatgtttttgcctcttcattatattttactacataaaaatctaaaacacacaaaaaagtaaaacacaaaaacagtctaaagtgtgacactgatttcagtacaatacatctagagggaataatttttctctaaattcccaggtggctaaaaagagggctctgtggatagatgtggaaagcgtgagacagatgcttctctgagcctcgggtttctcatcttaaaatagagataattacagtacctacctcacaaggttgtggggatttgttgggaggatctaagtaaagcccttaagacactgcctgggtataaagcagctatgtagcttctagtgtcttaacattgctaagaaaagaaacacacttgccccctttttgcagaagtaagctcctttagtgattttcatctcattttcttctatactttttttttatatttgttgtgagcacgatcttctcttttttaataaattcatatttttcaattatttttattattaaggtaagaagtgtgcttttgttggtggaggaagaaggaagcccctacatgcatagcaacgtccatgggaatgaatcactgttcccttcttttctatgaacttaagattatactcaagccactccagaaaatgaccatgcagtcactgtaagcaattcctctaaaattattaaaaactgtttatgtttggagaaaggcagcccctcttgcagtgataatgactgctatatgagaggattaagctgattacatctttggaatactgagattgtgcaaaatagagggaacgatgaactctccacataagctaaggaattcagcaaaaggatgaatcaacaggagagagagaatatgaagcctctatttggaaactgaacacgtagcctcccagataaaagtgagaaagattttgagtaatatctgaagtcatgtagctgagaagttccatctacacttgagaataaaaacaaacaaacatactctaggcgatgtctatgccagttccatgaagtcatcatagacttgcaatcaattgcttgggaaaatagattttaaagttgaatttctggctattactaggataattttttctcctggacattttatgtatttatgtatctactttggtcagggtgacaaatggtatgtggtatgcagagcttaactactactcctagcccccaggccccataatcttttagtggattcagccaagcagaaatgtatgttgaataaaaccatgtccagggggtgagcagaaagaaatgcatttgaggaaaggatattatgtcaatcccaaactcgatgaaatgttctaagagtatcccagagattggttctatgaatctagtgaaacacagaataccctactcttcacagatgggtgtttatttgcatgagtccataggcatgtgagcttttgttccttagctggaggattagagggaagaaatgacataggtgattagggatgggggagagctgggatgaatatggagaaaggttagagaatgcaggcggaagttgatggcagcaatttgacttagaaccttatgggacttgggacacacgcactgtaaccttgagacctagataacagtgttttatacagattcggagaatagattatttctcccacaacccagctactgctatgggtacagctttagtgctctgcgggctcagctgaccacctgaaggtgactggctggcttggagtgacaatagaagagcctatagcacttgtaagagcagggtcctcactgagattgtgcacagcagagggagccatgaactccctgcatgagctaaggaattcagcaaaagcatgaatcagcaggagagagagaatatgaagcctctattcgattaatgaacatgtggcctcccaaacaaaagtgggaaagattttgagtcatagctgaagtcatcatgtagctgggatattctataaacatttgagaataaaaacaagcacagcaaccaatgtcctttctgttctaattaggactaacttttgagtgctagagactagagggcaggcatagccctctatggagatgggccgttcaagttttaataaatgtgttgcatttgtcatcttagtatggcatgacaaatgatctattttatattaggagctgcccaaagatgttgggttaattttagtcaaagtgattttatgcccacaacatctggatgagtttggtcaaaggaaagaagtttagtagactcataaccagaaagatctttgtcttcacctggcctgccagacttctgagggagtaatcatgcccaatatagtaactggaaggacatgccacttgtttggaaggatagaggcatagcctgagaagataaaggtgaaatctctgaaaactttgataaagaggctgggcacggtggctcatacctgtaaacccagcactttgggaggccagggcaggcagatcactaggtcaagagattgagaccatcctggccaacatggtgaaaccccatctctactaaaaatacaaaaattagctgggtgtggtggtgtgtgcctgtagtcccagctactcaggacgctgaggcaggagaatcgcctgaacccgggaggcggaggttgcagtgagcggagattgtgccactgcactccagcctggcgacagagcgagactccatcttaaaaaaaaaacaaaaaaaaaaaaaaccaactttgataaataaaatataactctaactctagatagggaccgaatgggggtataatgtttgtttaagtttttgggagacacttgataacacaacctggatatggtggagagcattcacattccttttcagtagtagcctcttaacgatgaggtatggatgaacagcaaattgctgctgacttattaattaccatgcccacaccactgatttccctatgtcttacctgtgcacacacattggctttacagcatacgaacgccaagtttgtggcgtagcatatggtgctccctcaaataagcacaactgtctgcctctctgcttatctaatcatagcaacagaaaaattgacttttcagttttcttttccccaggccctgggagatgcatatgccaaatacttggcattctttgtaacagagtcaatcataattaggattccaaattaaagtacactgccagccagggcatgtggtattttatattatttgtttgaacaaatgtattataacttgaaaatggcaaagtaaaagaattaagtaaagctcacactttttatatgtaatcatcttgcggagttttattttatcagaatgttagatgaaatcagaaagcaaagaatgtaaaatagaaaaatgtatctgaaactttattcttttaagtaacaggtttggttttttgtttttgttttctttattttcattttgtttggtttttgaaatgctcattgtagaatgttgaatatggtcagatgttgggtgtgaagtttattagaaattaaccctgaaaaagtatggtatagtcattcagttgccttttccagtggagtctgatttggcctggcgggtgtagtgaaacattaactacacccgcctcagccacccaaagtgctgggatcacaggcgtgagccaccgcgccaggccctaaagcacatcttgattgtaggttgagggtgcagtgccaacaaattctactttcatggctcttgaaattctgtgaacatttaagagccactttgacacagccatttcttgttttttgagagagggtattattgaaattctttttaatccaagatttttgtgacaatttcattcattcctactttctttacaccagtagtagctattcatattcattcttctattttctttgcatgattaactggcatatactagttcttcacattattagcctaataatagtagttacaggctataataggctattaattcattatcatctcctgactcaagtgaatctgctggtaactgagagctcctactcttgtcaatggctttgatcccactgatgaccattttagtgctattcccttctcaccatggttgagccttttctacatattcctctcagaatggttgtgccagactttcacggggagccatttttaaagctatcctcactacagaatatggcagcatttcgttggcagtaaaatcagttaaactgcatatagaatgctttagtttcttctgaataaaatgtgttacacaaactgaagtcactgctctttttaaaaaccaaagcagaataaaccgttttgtaagataattttgccactataaatatagtttcctttggcttcttcttggaaagattttatttcagcttgcactgtgagatctttgtcgttttcaccacacatttccgtcaaggaagcccttggatgactgccatgatttgcctctgctggacgcttccttcaagggctgtcaacacctctcttaattgtctggcttaaacatcaggcgagcaatgtgttaaagttagatggcaaatatacttaagacaaatatgtaaatttttactctttcaaatatgcattcaactggtgtgtatagatttcagaacaaaagccagagagagagcaagaaagagggaggagagagaaatctatatgtataaatagaaaagccaaggtagaaatgctgtgtgtgtaaatacccaatttctggattaagacgtatcacaaatacatatgatcaatacttatgtacatgcaagtgtactgcctttccaaacaccagcaaatcttggtgagcagaaatcagtagactgtccatagtgggatctagaatttgaatggaaacggtcttcaattttaaatattcatctgttttcatttgtagatatgacactcactttaagaggtgatctgagttcaaattccctaaattatatttgcatttgacttattacacatattgttagttgtcccttgaattccagtttctctttgagtaagttcttagaagatatatgtagctaggtgacttatagtcacctcttagtcattctcaaatatgattataggctatttcagattcatttcaggaaaatgtcatgtgtcaaggtgtcaattctgagcaatttttacattttgccaattctattatagaagtggctctcacccataagtagcttgaaggagtcagtatgtaatgtgccagtctcattttcactttatgtgggcacaatgtctctctaatgctgaactgttatataacctgtggtctatctgactaccatagcttcgtagatcaaaatattgttatggtcatataaatgactataatgtgggtgttttagaattgcacttttgtttatgcataactggtcccaactcaaatctgcttcatcattttttagtcaaaggatagtttttcatgtcagtagtacctcaaactccgcttgtgaacttaacacccagctatatcctgttagtttttaatcaggagggaaaaaaaggctgctatttgaactaaactgacagcttttgttgatgagctgttaggcagattaaattctgtcttgctcttcaattgttcttgaggctctgtgggacttacagtaatagaattttatttgtgtcagtaaagttgacagccctgattcagaagaccacagggagctgagatgttgattaaggagcatcatattgaccatggcttaagtgggtaacaaatgaactgagagagaagactctggatctacttttgcctgtccatgaactcgtccaaagcaaatatgctttgagttttcatgtctgttttttaatttttgtggatacacagtaggtgtaaatatttgtggggtacatgagatgttttggtataggcaagcaatgcatactaatcacatcatggaagatagatagggtatccatcccctcaagcatttattctttgtgctaacaaacaatccaattatacccttttagttatttaaaaattctattgaggctggacacagtgacttatgcttgtaatctcagcactttgggagggcaaggcaggaggatcccttgagcccaggaattcgagactagcctgggcaacatggcgaaacccaatctctacaaaaaatataaaaattagccaggcatgctgacatgtgcctgcagtcctagctattcgggaggctgacgtaggaggattgcttgagcctgggaggttgaggctacagtgagctgtgatcatgcccctgcaccccagcctgggtgacagagcaaaactctgtctcgaaacaagcaaacaaaaaattgttaaatcattattgactagagccacccattgtgctatcagatactagcccttattcatttactctatttttttttgtactgagattttaatttctgtacttagtaatagctttcaaaattgtcatgttatcccaggaaattgttatttttatccaaggcttattccatttttttttccagttgtttggggcccacaatattgtttcttttagaaataaagttagaaatattcagaataatgaacacttaagagagaataaggagtagaatacctaaaaaaaaaaaaaaaaaaaggaatcaaataaggaagagatagatagtaaaagagaagtggatgtaagcaatttagaatatattttatcaaaaattgctttttaagtggcattttctcttgctgcagaagacattattgaacaaaaaaaaagcccaatgcaattcaatttaaatttatcactctattattttaatatatttactcagggttaacaactcattaaacaccaaattgctcactcttaatgagtctctgacgctaaaattgagctgacttaaattttactgtaaaatatcagcaccattgcataaaactgtaataaaaattaactaaaagctattgaatgactgtggagtggaaaacagatttgtgacacaaaacagaaaatgtagcacacgatatgtggctggcagaaacatgagtaatagcttttattcaccaaaacatgataagcccatttttcttttgctgtattggagtctgtgaaacatgaagtcatgttttctttttttcccccattactttgtacaacgagggccagtggtggaatgatacagtttggctgtgtccccactgaaatctcatcttgaattgtaactcccacaattcccacatgtcgtgggaggaacccagtgggaggtaattgaattatgtgggcaggtctttcccatgctgttctcataatattgaataagtctcagaaagtctgatggttttaaaaatgtgagtttccctgcacaagctctctctctttgcctgctgccatccatgtaaaatgtgctgctccaccttgccttccaccatgattgtgaggcctccccagcgatgtggaactgtaagtccattaaacctttctttcttttgttaaaaaaaaaaaaaaaaaaaaaagattatgatagtgctagtcaatactgagttgactgtcaaaaataagcacactttacattagccagttacttctgggacactgttgaagagtatgtcacatgtacccacaaattagtcaaacatctttaggcatcacatgatatctaaattagtctttttctccttctccatcccctggttgtccatgaaatattggcctcaaatcagcttgcctatggccaccatggaaaccatccatcatgaacagcacctatgcccctggtacaggagtgcatttctccccaagcctacagtcttctgtgtgtcacagcaatgctgagtttcccacagaggtggcgttgatggactctttctcaactctttgctatggagtatcacctgggctaagaagttctgcttttgcatcaaatttcaatttttttctttttattggatttgaattgttctggcacttttgccactatgctgtctctcaagccctaccatcccctccatctttctaaggtctctcagaaccttagctccaacaaaacccccttctttttctctcattataacacaaatttcctgtgaatatcaatgaagcaaacagatacagtgggagctcgtgaaagacaaaggacaccgagctagtattttcattaacaacatgggctcttgtactgtcaaccaacaagagctttgttataaatttattcacaatggcaatggctttgggcaacatttagatggaaagtatttatgaaaaatatactatttatgtttctggataggaaacatactattcatgtaacaaaatatgacatttaaaggaactcactttttcttttttgttgacagtcaccgtgtcatcaaggaaatcaacatttagaaattatgattgtcactagctcactctgagccatggctctacattttatccttgtcaataagcaatccagtgttaggattttaaaaattgtttaaaatatccgtacaaagagttattttctatcttggtccacaaatttgtcaatattttccacagcatcacaattgtcagaaaacacagtgaagcttaagttaaaacaaatctgcaaagaaaaagtcaaaaagaaaactcttccacagattttcagagagatgatttattagtccaaatttgagcattgaaactagcctatattctaagtttaagaaaactgtaattttcatgtttctttcagttcaatacaatttatatattgaatacaaaagagattttcacttattgatatggctttctaggtgtttaaattctaactcaatattttaaggattcagtaatagtagggtttccatttctacatggtaggcattctctagtttacttttcctcttctttctgtagaaattaactatttttgcttcacagtcatttcatgatagacccgatttcttacactgaaattcattttaatgtttggattgagcaatggtttgctttggtcttaacttttatttattgaggtataacttacatacaatgaaaatctcaaatcttacatctactgttcaatgagttttgacaaatgcataccattgtggactccatccacatccctataacaaagcagggaactttttcaccttttcagtaccctgtaaaagttacctcatgcccaattctccccttcctctaagcaaccactgatctgatttctatcaccatagtttactttttcatgttctagaattttataaaaatgaaatgatatattgtatccttttcttgtctggcttctttcactcagcatactgtttctgagactcagcggattgctttttaataatataattacaactgagtctcaaagatttgaaaaagtcagaatttcttataaaattggacattgtggtttgctacctgctgaatgatgaagacgaataatgtacttcagtgccctgagatagtttttgtctactgtaataaaatatttccagtcttctctgtttttgcattcttcaattattaccttgaagttttaatgttttttaaaataatgaattggcctaattgtagcctcagcacaactactaagttacacattcaataaaaagactttttctttgtaatgttatatgttaatggtcagcctcctagatactgatgaagcccatcaatttctactgatagttaagatcaattaaccaattagttacccattttcatttttcctgtatattctttgtagatcacttactaaaatgattttctaagaccttcactttcttaagtaaagaaaaacaatttgactgagacttggccatttagctaaaatctaaaagacctatttaatttaaagtataagtcaagcagagatcttatcttctgtccataaataataagaatgattgtttttcgctaagtggaaaaagtgagatgaggcaagaagttgaagaatgcctagccaggtagcatatgaagcctacaagtttccagctgtgggtctgatgaaaaataatgagacatctgatggaacttaggatcttatttgaaaaataagccatcaagtactttaactttctggtatttcaaaagtaaaaacatatactaatcacttgtttttatttcacttatttgacactacacatctgtcttagtacaaactcatgtttatgcaatgagatttattagactgatagttcatatcttagccccttttcatagagaatcattgaaaaaaaaactgttcactgtgagaaaactctctcccctcactactgatcgcttatagtaccaattcagtatatgagaagacactatttttacaattattcacatccttaagaaaataaaactctataatttaaacaatgggagtataaaggtattttagaacgtatttgtatatgttaaaacaacagcatattaaaaatttaccttgagaaggccgggtgtggtggctcacacctgtaatcccagcactttgggaggccgaggcgtgcggatcaccaggtcaggagatcgagaccatcctggctaacacggtgaagccctgtctctactaaaaatacaaaaaaattagccgggcgtggtggcgggcgcctgtagtcccaggtactcgggaggctgaggcgggagaatggcgtgaacccgggaggcagagcttgcagtgagccaagatggcgccactgcactccagcctgcactacggagcgagactccgtctcaaaaaaaaaaaaaaaaaaaaaattaccttgagaaaaacaagcaaacacatgaacctaaaaaggcaacagcagatatagtgttgattgatccactgccactccagaattatttatggtagcaaaaataataattttcaatttgatggattcttatttaagcagactcattatactttttggaaaataaaatattaacattcaatataatatgactacctcagtcactttagctccacaggtgattgggatagcgctgctggcctgaataataaaatggtaataacctcagttagaacaaataattgttttactagttcagatacacttaacattataatagatgccctcataaggtgctatgtataaatcctttttttgaaaaaaagcttgaatcatcatgtaaatgttttagggcaactcattgcttagagaaatcctttgaagttttcttttataatgcaaaaactcctactgccttatctgttttgtaaattaggttgtattcgtaccagttttgttgaaaagtgaaacatccttctaagcatgaaagttttagaaataatgtctaagtatatctaaagtagctattataggacataaatgcattgatattttagtggatctcagtctagaggtgagaagagggctaatcataataattgggactgagtgtgttagaattacacatctttcccctgctctgataaaaaatatcctgccatagagagtcactgatactaatcagagcatgtcatatctttcagatatttggggacagagaaaaaaaggtgatgaattacagtactagagatactatagcctttaaaataaatattatatacttttggttctacatacttttaaatgaagatggtccatgaagtaagttatgatcaaaactaatgcaagggcttacagcctaagaagaaagtccagaatttagagaatggtgacctgtcttttcttggcaactaatattatgaacatcaatttctcatcactttgtggcttcaagaaattctcccatcatagagatgaatcacctttcttccaggtcttcaaaaaaaaatatatatatataaaggtctgtgggagataagcttagaaacagtggctgaaaaggagaaaaattcagatttcagtcctcgggggtttgcataacaaatgatgaagtatagttttatagctcatctaagtaccttggtgcttcttttgggtacaagtccctgtttattagacaggcatggtgacttctagatacattcttccaagacatcaagataattttacttcttagttttttcacatgttaggcaattccaagattaatcgtgtataaacttgtttgacacttgaatcaatttttggttttacataaacggcattatttcatgcatacctcagctgaaaattggcagttatgtattagtgcttgattttctagaccagtattaaaattaccttccaaaaatgtttcagttgcagaaagtattggtggccaacaggtcttccatgagtcgggacacattagccagtgtcaccctttctctagccagtcagttctatgagaatggtattggaagaacagacaacctacctgcagcacttgccctgtcctgttcatattgtggacaatcatcaaaagataaaagggcatatgaaagatttatggtaaatgtcttccattttctctgccttgagtacactggagttagctttcattttcatagttgcttactatgaatgtcttagatgtagcatgagaaaatcttatattttctttttgtctagaactctgctgttcaatatagtagtcactagctattacataattaaaatatggctagtatgaataagcagataattttaattcttatttcagtataatttccatttaaatttaaaaactcaagcagtgtaaaatagttttcatcaaacacaatttttgttctaataaaactatatttcacctaaagcactgaaaatttagcattgagtttcagtgtgctgttaagtataaaaatatactagattgtaaaaacttcatatcacgatataaattatctccaacaatttttatatacattagatgttgaaataatattttgattatattgggctacacaaaatacattattacaattaatttaacatttctttgtacagtttttaaatgtgaatccttggaaattcgtaattgcatatgtggttcacattatgtttctcttggacagtgctgagctagtacattctgaaatatgtagcaattatttctctatggcttcataaagaaaatgtcaatccaaggctgaggatttatttatgaaaatctaaagacagccggttttcctgatggttcatgccgtgggggaacgggtctctttcccaatatataagaggacaaatcttgggatgggttttttttttttttggtcttttatgacattctttaatgatttctcctgtgcttgccattctgccttgtacgtaatacaccctttctagcaatgggtttaaaggtttttccttcctctcctttttgagctgtaaaatatgcattatggggagaggtgagctgatagttgagaaaggtcattaagggttcagcctggcttagtcggaaagatgtgaattcaaattgttattctcccagatatatactaacatgaccttggggaaattgcttaacttttctaaattttagtttgcttcatctgaaaaaggtacctaatagggaagttttagatattaaaatcaatgaaatttaaaagaatcaagaaatatgataatgcctagtatataacaggccctcaaatgtgttctgaaccaagagatccctgtaagagttaaagaaacaggaaagaaacacgaaaagcggctcaacagtcaaagacaggttaattttgcagaataaacctgagaggggcttctggccaatttttggacaggagcactctctcttacagactaagagtatttattggttttagggcgagagagctttatcacaggcttggaatgtttctgtgtgggggagaaatttatggtggggttggaatgtctctgtttggaagggaagttatcctggggctgacctgtctctggtcggggaggggtttatcttatggttggaatgtttctggactgggatgttatttgtggtttatggtcatgctgacgttagccattaagctgatgccctttggatttaggcagtttttgatcaaggggaactttagaatggtggtgcttgtccaagatagccatgctcccgctgtgtcaatccccaagttttaaatgtgtatctttacttagtgacttatggagtcgtaactattaggacacatacagcagtaagtctaaggcatataccagcttatcagatggatcccctacctggcaaagggaagatcctctttctctactaccttagtccttctttttatactctgtgcagcttttcagttcttccacttgcattaaaattagattacctcttagattagatcaaaagattgtccctggttgtgagaagaaagaatactttaatctagcactaatcccttaatacaccattatatttgggtacattttttttcctagcagaaaaattatttttcagccttctcagaagtactaaaagtcctttgccaacatcagcccagtgcaagttaacctgttatgagatttgttttgtgctttggaaatgcttgtcagacaagctttcaacattgagatgtgtgatttaaattagtttgcataagaaaatgtaatgccagggacaaatttctctctttatcccttcttatactacaaaacagacaaagagggttaggtggttgctttttagtatgcgagtaatcacttgggattcacagaaatattagatgcagtgttattagtgaaaccttagttccctttatagatatgtcttatgtcccatttgtaatattattattgttgttaccatacgcaaactttatttcttagtttggatgcttggtctcaaccagacccattacctccttatcttcctatctcttagggtcacttcatgcttagaggcaacttgttgaaagtggaggtcagcgtgatcctttttcttagaagacatagccctttcatggaacttacgtagctgattcatagcctgagtcagtctcttggatctgtgaaaaaaaggaaaaatgaaccagacatggtgtttgcagtcagtcttctttgaatataaaatatataggcagaggaaaaaattaaaccaggcagattaacctcaaggcataaagacaaatgctaaaatgtactctaacgtgaagggttaagcattccaagatgcccgttggaaggttctttatccaacacttctctacccattccaaccccagtgtaaacattaaataattcttttaaaatttgaatactcaaacaagaaagtaaagcatggaagataatttttaaatcattatgtagtgattagaggaagaggaataaagggtaatgtgagattttagaaataggtgctttgaatagataaagagatattgcaaggatagatgaactcactatcgtctttgcagtatagtatcgttggtgcagaggatttgggatagaaatccagtctgggggccgagatgtgatcattatgtgcaatatcatcttcaaaaagtcaggtcatggttatcagtttgctacaaagaacatcttagtctcatttcctgtccaaggcaggaattttcccctgaacattcctgacagaagataacctgttttgtgctctaatcacccagtcttctaccagaggttgaagtgacattttggctccattttctcgtattttatgcaagaagctgggaattccagcatcttactctgctcatcagggatcctgagggagctggtaatatgcagaaaggatgtcaaagggccatgttactaatagctgtggaagctccgctatccacaaagcagagattatgaaacagtctatactttggctagaagcctaagcagaatctcttctacttccctcaaaatctatttcttagcaccagcaagactgggtctgtccagtgggttgtgggtttggggagaagcagaggaaagattgacatcatgtggaatctggaagagacagaacacatctcttggtgcttttgaaggtacagtgactccatctagtagtaaaaggtgttcaaatgaatggcttcaaatttgaccagattatcaaatgctgcttccctgataaacagctcagacatgggttagaagaggtggccctgggatgggaagcagtgcagactctcatgtatgaatagctccaattctcaaaaaattcttttagttaactgctgtctgtcttcttctacattgcactcaagcttaactctgcacttttaaaatcaacatataaattataactttctctcctatgataacttttcaaatgttttttgacatctattcagtaccgagctcccttttgaaaactgggccatcatttcccaacctccaatttctgactgtatttccataatttatttaaagactcctaacaatggagccacaatcataactacaggtcccctttatatctcaggatgacattcatttggttctaatccttgaactcatttgaagattctaattgctcttgtattctctcctcttctatctggaacttatctccctgataagcatctgtgttgtgattcttctagagtggagattatttctcttgtaaggaaaaaaattaaaactaccttgttctactttctctgttgcatcacaccttctctcttaagtaatagtcctaaaccttctctgttcttctccagacagatcataaatgttacaccccaacctaaaacaaaacaaaacaaaaccttccttcatgaattattattggccttgtatgcaagactgagttgatcccagtctcaatttacctgataccatctatttcaacaataacaataataacaacaataatgaatatttatttagagctttctctgttccaagcactgttctgaccactttatgtatatttacttggttgactctaacaataattactgaggtgggccaggcacagtggctcatgcctgtaatcccagcactttgggaggctgaggcgggcagatcacctgaggtcaggagttcaagaccggcctggccaacatggcgaaaccctgtctctaccaaaaatacaaaaattagccgggtgtggtggtacacgcctgtaatcccagctgtccagaaggctgaggcaggggaatctcttgaacccaggaggcggaggttgcagtgagctgagattgcatcactgcactccagcctaggcaacagagtgagaatctgtctcaaaaaattaaataaataagtaaataaaaataaataattactgaggtggctattactaatttctctattttggtgatttggaaactgaacttagaagttaaagggcttgagcaaatacattggactaaaaggtggaggagctgaggtttgaagtttcaatgcaggcatctggctccagggttcatggtcttttaccatgatgccatgctgctatgtctacttataggagtatgcacgcttttatgttctttcctgtttttgtgagccttattctagcttttatatatttttaaactctgagctccttagagagtttccaatggccagtcaaatttatttaggtcctctgaatagtctctgaatggaagaaagtgtttttcatccctaaagcccacatgtatacttcagatgcacaaggttcaaggtcagggcctgaaggagaaagtatcacagcacaagtaacaatgttaaacttcaaaggaagataaaacctcaaaataagatattaaggtcaaatactagaatctgcagggacactgtcctggttaagaggcaatagaaaggaagtagcataaggtgattcagcaggggagagatgtgagaccaacagcgttagatcagtggggctgtaagagagactctccaaattcatttatggaggagaatgccagaagagtggggagagagtgagctagagattcccaagtcccctggcaacgcgaaataccaggggtactagcacccaggtctttgcttctaatgccattctctaatgaaagggacaaggcatccttggaaaaatggctaattctagcacagagcagggaatagacaagatgagcccggagaatctggtagtgacagaaaggaagaaaatgcagaaagaaaaaggaaggaagacaagggaagggaagggatggtatgaaaggaaggaagaaagggaaggaaggaaggaagtccaatgaatgggattggggtctatttctatctgtgttcttaacaatcttcttcatcagggattagattcttgtttttttctttgttgccttttttttttttttttttttttgagatggagtctcactctgtcaccacgctggagtgcagtggcgcaatcttggctcactgcaacctccgactccgtggttcaagcgattctcctgcctcagcctcctgaaagctgagatcacaggtacacgccaccacgcccaactaatttttgtatttttagtagagacggggtttcaccatgttggccagaatggtctccatctcctggcctcgtgatctgcctacctaggcttcccaaagtgctgggattacaggcaggagccaccgtgcccagcctgttgccttgtttctgatgggagtccaagaatctccaagctatctatatgagaaagacaaaactactctttctatcctgtactgtaatcctacctgacaaatatatccttcatgctccttgtcattttgagcaaatagcctgagcttacctcactttcatttgaacttcctccctctttattgccaaggtactacgttcctttatctctgtgcctgaacaagccccccttgctataatcttcatgctgacccctcattctctagagtatatgctgttttctgcagcagactacacggccagtgcccttgcttggagcagatctagacatcatatcgccacggtcttcattctgaagtaaccttagaagtcactttcagttcataacattaaagcacaggttacaactcatatgactacatgggccatataaaataaatgagtcaatgtgccgaagatcaggaaagtgatagctcaggcaagactgacactaattcttggcctctctgtctaagagacagaagagagtgctagagactatggcacccaggagaacccagaccgaagagggcagccactgctcagctgctgccagtcatcacagcacaggagcaatggaccaatattatgaatttatcttcttttgaaagacaatccagaagtcgagacttttataaaaagtctgaattcattacctgtattaaattttctttgatttaaaacactgatcaggctaaatacaacatacctgtaagatattacatacctactgcaagaaccctgcctctgcatataaaggagaaagataagcacagttgattctcttcacaagccctgtgtcatgcaaacaggattaatagcccagttctaggctaacaatttcatagcaaccatgtggttattatgtgttgtatatatgaaattatgccataatgagctgtctcctaacaagattgtgcaggctataaagctgttttatagctccaagagagttgctcctgagttcattgacagtgcttattgtttctttccatctcagttacttttgaattaaaaagtgctcaccctactctttcttctcggctacaagttttgccatagtgcacagtgtttcttcatcttactttctttaaagaacctttcccatctcttcagttatttctacctgttccaacctccctcctgatagcaccccagtagtgggatggaatgtgctggaggggtttggccagttcttgggggagtttcacagtcacctgtctacagtttcagtgagatgggaatttatcaagctgaaattagcaaaagacaaaactgacattgtttaaacacatacttaacaaaagatctaaccagttcctcctagaactagaagatatttgaaaattagagaggagcttttttttttttcctatcgctttctttaaaacacacttttccatagataatcttatctttttggcatcaacaattatttataattctggaatgatttccaaatctaacttgtaaccatatttccaactacctgccaagtgtctgtgctggaattacctaatggcatttgatcgtggctcaaatgtgctcactcaactttattccgtgggctgctcacctcccctgtgtggagcctgggagcctctgaaggcaaatcttgactcatctctcacctctcaactgatcaaccagtagccacacctgacttaaatgccatctggaatccagttctctttcagctcttccatttcttacaggaacttttacagtaacttctgaactgttactcttgcctctgaactgcctcctttccaatttattattcacaagttccctggagttattttctttaaaacaaaatgacagctttgtttcgttaaaagactgtcaggttactccattccattggccagagggaaagggacaaagcaagtacgtgcccacacaatctctttactgtggtatttggtagctaatacatctttcaagcctcatctacttcatcgcctcctgcaccccaagctggaattacatgtgtcttattgccctgtccctgcatatcttctggccttatagacctctgtgcctttatctatgtcgttccttctacctcaacaggtttctgtcctaccatggattgtctaatgccttctgcacatgttctttatcctaggaagcaaaatatttattccttttcctgcattctttaatacctagtttatgcatgtctcattgcacttattctaatcggagcttgttcttgtcattttttttcatatttttttccttttgtgggggagtttaggacccaagtctttgtcctcttttggtttaactagtaccttgcacagaaaaggtagtcaataaatgtttgaaaaaaaaaatcccagtttgataattagttgaaaatttcttcagttaatgaaaacttggtacaaccaaaggaaaatgaattatcagagtttactatgctccatgagattcttttcatacaagtatgctgcagaggaatggaagagtgggaatataaataaatatgaaaaattcttagaacaatcttcttattatttgagacagagtccagctctgtcacccaggctggaatgcagtggcatgctgttggctcactgcaaactccacctcccaggttcaagcgattctcctgcctcagcctcccgagtggctggaattacaggtccccaccaccacgcccagataaatttttttttgtatttttagtagagacggggtttcactgtgttggccaggctggtcttaaactcctgacttcatgatctgcccgcctcggcctcccaaggtgctgggattacaagtgtgagccaccgcgccctgccagaacaatcctattttctaattggggtttttctttgttttttgtttctttgtttgtttgtttgagatggagtttcactctgtcaccgaggctggagtgcagtggtgtgatctcagctcactacaaactctgcctcctgggttcaagcaattctcatgccttagcctcccgagtagctggggctacaggcgcctgccaccatgcccagctaatttttgtatttttagtagggacgaggtttcaccatgttggccaggctggtcttgaactcctgacctcaggtgatccacccgccttggcctccaaaagcggtaggattacaggcatgagccactgctcccggactttttttttttttaatccttctactttactcatactctccaaagttaattcacacacaacctccccaataaaatggaagtgaggtttaaaatcagaccataatttaaccagctgaccaaatgccattttgtataagaagataaaaagctaccattgttgttatatctcagagcagaagctctttcttcattttattctttaaaaacatcattcagggttgggtgtggcggctcatgcctataatcccagcactttgggaggctgaggcgggcggatcacttgaggtcaggagtttgagaccagcctggccaacatggtgaaaatctgtctccactaaaaatataaaaattagctgggcatggtggtgggtacatgtaatcccagctactcaagaggctgaggcaggagaatcgcttgaacccaggaggtggaggctgcagtgagccgagatcaagccactacactctagcctgggcgacagagtgagactccatctcaaaaaaattttaaaaataataagtaaaaaataaaaacaccattcaatttatagttagcatgaagctacaccatcaatctttcctcgtgttcatgatcatggctcagcatttttctgaagtgtcattaataagccatgttagcaggaatgacctacacatatgcatgtcaggagggcttcaggccactgctgtctgtgtgtcaccttgacgtcagccttgataattgtccagggcctccaacttcacagcagtacctgggcctatgtcaggttgagttctatgatcacacactattttcatcagaaattttaataaaattatttttttctcagatgacttcccgcatactactaagtgatctgggagaaggagtcttagggtgtggatgggattctgccttgggcatattttgctctactgggccctggagtctttgcagatgctgtcaagatactgcacttttttttcttttttgagacagagtcttgctctgtcacccaggctggaatgcagtggcatgatgtcagctcactgcaacctccgcctcccaggttcaagcaattctcctgcctcagcctcccgagtagctgggactacaggtgtgcgccaccacgcccagctaatttttttgtatttttagtagagacagggtttcaccatgttggcccggctgctcttgaactcctgacctcaggtgatctgcctacctcggcctcccaaagtgctgggattataggcatgaaccactgcgcctggccgatactgcagttttgatggccatcactggtacaacaccctgcgtatgccaagactgtcatgccttgtcagctataataaaaagcaggagacaaatggccttttgttacctgaaatgatggatcagtatgtatgtgcaaggatgcacgctgtcaagttcttgtgggttaatcatgccaggctgatggaggggctccacgagttccaaagtagaaggagcttgaactccaggctgtggctttgaagcagttgttttctctggaattagctaatgaggctctctttgtttgaggattggaaagcctccaaaaacccactcaggagggaaattaacaaatgtctgttttgttacctccggataaatcttcatgatgaaatgtgcagccggtccacctcttcaatcttctctcttcttcttcctcagtggaagctcaattaccatgaaggccaaaataaataaataaataaacaacaaaccaaccaaataaataaataaagcagataaaccgtggttctttgcttaaaaaaagttgcagcaaagaaaagctttagagtaatttctagttagaagtggctgtgagattcactgtcttctggtgatatttgaaatatactatattcatgcaaatgtttctgattatttaaacacattatctgtatctataattatcagtagctgctggcattatgtgagcatgcaaaagtgggaacagcagcagtaacctgactcatttcaaccaggatggaccatctcagagggtcacagttactaatctctgcatgaactagattttataaggtattatgattctttcatagcttgtaacttttcattgatcatcaactttactgatttttgttaatactggaaattttaataaatgggttgtgcacaggtacttattgagcatctattacgtgccatagaatattctgattattaaggatgtcaaggtatataatccagagtcacggttttcaaggaactcagtcaataattacaagctaatacatgggtaccactgttctaggcacagcgtggcagaaaagaatagcgtggacacacattcaggggatttaactaggagaaaacagtaaggaaggggatcttagcagaggtagtatattaacagatgtatatgacaacttacactgctgtaagtcatcctgtttggctggcaagttttgctttagaaactgggtaaatattgttcatgaaacttctgtgtaagtttcacgtgaatgttttcctatgtgtatgtgtgcatgcttatttgcatttgtgtgcacttgtgggtatgtgtatttgtcctgtgtcacaataaaaggtatctatttctggactttgcagtcaaaaacattggaaaactgtctatgtaggtaatggacacaatagaatttagaaagcaacttttacaaacattgcagatttgtaattttctaatatcattgatatataaagctgagtataccagacacttgtaaagaaatgatcttttccaatgaaaacacaggtgttaaacagaacctttcttctggcctacaaatcactcttctaacacttggaaaaaattaaagaaatattcagcaatgtgtagaatttcaatcccagagagacaggaagagactgtatagctgcagatgcaatatgcttgttattttggcaaaagcgtaacataagaagccaccaactctcacagaggaagcagagaaattcagtatttgcttgtaacttagatatttctttctttgttttccccctaagaagaacatatcttttctggtgggaaaagggaatttagataattaaagcagagggaataaacattttcaggaccaaagagaaaatagccgtttgagccacatatttaaatgttaatctacaatttttttttttttttttgagacaggatttcactgtgttgcccaggctggagtgcagtggtgcagtcttggctcactgtaacctcccttctcccctcttgggctcaagccaacctcccaccttagcctcctgagtagctggaactacaggcatgtgccaccatgcccggctaattttttgtcaagacggggtctcactatgttgcccaggctggtctagaactcctagactgaagtgatccaccagcctcagtctcccaaaagtgctgggattacagatgtgagccaccaccgtgcctggccatcaaatgtttttcatagtggactagggctttatgatcccataaaaattatttccctcatggaaccactccatttatgtattataaagctgtcaacatctggttttattgataaatatccctggggtttttgagctttttcttttcaacatagtgcctgtgttttatcttgacctttgctttaaaattactgctagatgtaatgaggattctggaaagagcatggttcaagattttgtacaattgatataatgattctgaagcaaataatgggaaaggggagagtttcagaatttggtggccttagggtaagcttatgatttgttttatctttcctcatatctacctaatgctgtgaaattttgggattagatttggattggggacaaatgaggagtggaaatagtggagggagaaagggttaggaaagttacagaacttggcaaggctcttggaggtggtggattgatttctctggtgttgtgaagtgtcatcttctttcttcagttaaactgaagtacaggcaagcttctcctgctgcccctcagtttcactgtgtcaccatttttagtagggataagcagagacttgttgttggtaaggacaggaaggaaggtgatgctgatgaatttttgctggtgctaggttagctgccagccggcctggcaatggctgtggtccagccagcctggggcgcttctagtattctctgtcatggggcaatatgttaacgaattaaaatgccaaatagaaatgagacagaattccaaagacatgtaaactgaaaaacacctgtccccatttgttgattttttttttcctgcatatacttaaaaaaccccaaacctttatgtaagagtctcaggagtgcagtgaaaaaaaagtgtttattgacgagccatttccaatttaggccttaaacttcaagacccatttctaagacccatatgcttcaaaacgttctatataattcagctcaaaaggatcttcctctcctctagatctataatgtttattgactacatccctcaaagagcagtaatgcatcatggtgaaataaaaattgaactgcaaatccgaagacttgaattctagttcctgatcgtttttcatagtgtatttaatcacacagtttaacccctaggtctccttcactgtgactcattatggtgagttcgcgtgagaaagtgtccaccataggacactaaattcaaaagagtgaccagtaatgattgttgtcccaaggatgtccaaatgggaaaaccattatcagtctacactctaaaccagaagggacttattccaccaaaagaggttaagggctccttaccacagtcacaaaaccagaatatatattctttcagagaaaacccggatacagggcatgagattagaaccctagaatggcatatcaaaaacttctggagtctgttgagtagaagtttggagaataaacaaattgatagattgatatttgaatccccggcagagtaagaggaataataagattttgaatcaagaagaggaattctgccacatgcaactaggaagaaaaaagcaaattaactgtgataacactcattagggattatcattatatctttaatgaggaggtaataaagactgattatttactaggcatcccttattgatccctatttatcactacgtagagtaaaatgtacaatttttcctttcacttgtggatttcattaatttatacagtcatcacatattgattgtacatatactgtataccagacactttattagctttaagaataccaaaacgaatatgccagatatagtatctaacttcatggagtttgtagagagattttttgaactgaatttctcagcaaactaacacaagaacagaaaaccaaacaccatgtggtctcactcataagtgggagttgaacaatgagaaaacatggacacagagaggggaacatcacacactggggcctgtctgggggtaggaggttgggggagggatagcattaggagaaattcctaatgtagattacgggttgatgggtgcagcaaaccaccatggtacttgtatacctaggtaacaaacctgcacgttctgtacatgtatcccagaacttaaagtataaaaatgagaaaaaaagatgcacaaatagtgtcacatatagtataataatgatatggatatggcctaattcatagagtcaacattctgatactaagaggaaggaaaaatcaaaacaaaataaagaaaaaacaaagcagacagtagcctttaaccgtttccttttaaagaaacattgttatctgggttcattacttgttagaaagtaatgtgaagcacttaataaacttcaggtggtggtattaggtaattaacatgtgaaattcctcatatggttatttaaatttcatggtagtatttaacagttttcatgtttatggccttttcctgcaactaagttgtaaaatccttaagggaaaggatgaggaaaggaagacaagagagaaactagcatttgttgactggctactacgtgccagccacagcactagctactaaacctgtgtcactttatttaaatatgaaggtcagaaagcatttctcatgttcctggtatctcctgcactgcctagtataatatttcatacttacaggtgcttcatcaatatttgtgttggttgacttagcaatttaaactgcttctaaatagagttacgtgagtttttccccaaagactcatgcccttttttaggaggcaaactagccctttccatgtcaccttccttaagaagcagggcaaagaggtgacagtttttatactgaaatcagttgtttaattgttcacccatttatcaaagcctctgtagagttaaagacaagtacagtgcccatgtaccctttatgctgcaagttctggacagatagctgtcaatgcctgaaaatagtgtaaattcactgggtgaagagagcaacttgccagggggatgtgatgtagccccttctagagtatggggttttctacttgggcatagtcagctgctagtttgttggattgctgctgctggggaaagaccaggccacttcatgatggaatgcgtcaacttttggaaagtcaaattcaggatgcagtttcaactagtagtaactatatttttctatcttttaaaaagtgaaggagcaacagaccagtctagacacatggacgggctttagggctcagttgctaaagagatagaagtaaaatattatagaaaatgcttatagtacatgttaagtgagaaaggtaaggtaaaaatggtttatgacctataactgtgtgaaaactaaccaaagagacacgtatcatttaaaaagatttaatgttgtgcctgtaatcccagcactttgggaggccaaggcgggcggatcacaaggtcaggagatcaagaccatcctggctaacacggtgaaaccccgtctccactaaaaatacaaaaaattagccgggcatggttggggggtgcctgtagtcccagctacctgggagactgaggcaggagaatggcatgaacctgggaggcggagcttgcagtgagctgagatcatgccactgcactccagcctgggcgacagagcgagactccgtgtcaaaaatgaaagatttaatgttggtcaaattatacacaacgattcaacagtactggaagttgaggaggacgagcaagccagatagcaccaatgatcatgaataaattccttatctttcagaaagcattattgttcagtggtttcaagttttggatgtgcactcacattgcctgtatggaatcctggctccacaagtagttgtgtgagattgggaaagttgcacttgtttaatctgtaaaatggaaaatatctgaggattaaattaaaatatagctggatcatgcatagcataatacttggaatatactaagtcatgaataaatagtactgttgtcatttctttgacattaattattaaggcaattaggaaattttccatctagttaacatatagcaaatcaaactaagctgtgaaaaatatataatatgctatggtaataagacactgaactgtgatgctattattggggtctgtctaaatccacagaagcatcagaaattcacataaatcaatgctaatgtcaatgcctagtaaattatagtctcagaaacatgaagattctagatgttttccccttctttgcacactttgtttatatttcaccctattactattatcacctatatttatggtttttcaatcatttgtgagtgcttggaggaaattcattggttcagcagttgaaccagggtattgaatagtacatgaggactctcagactctgaagagctggtcgggtgtctctggctaacacatttccagtggataaagagctgctccagggacatctccttcctctgcagtacagtgatctttttgctggtgactagaaagtccaggggaaaggacagccagccaaagggtggcaaactgatggaaagtgggggcaagctttctgtaaccatgtaaaagaaactgccaattcccatgaaaatccattgtctctttttcttattaacaaatccccaacaagccaccatggctcaagcctgtaatcacagcattttaggaggctgaagcaagagaattgcttggggccgggagtttgagaccatcctgggcaacacagtgaggcatgcatctctacataaaaattttacaattagtctagtgtggtggcacatgcctgtagtcccagctactcaggaggctgaggtggatcgcttgagccaggagttcaaggctgcagtgaactaggatcaagccactgcactgcagcctaactgacagagcaaaatcctgtctctaaaataataataattttaaaataaaaataaaatgctaaaatgaaccaaatctccaattttatttgaaataacactgccttagttttttaagaaagaaaataaaacatttctcaccttttctaacagtcaagctggtatgttgctttaagtttggtgagtgtcaggtatgcaaaagtgttgagtggcagatacagaaagactgcttaaaggcatctgactcagttgcaaaggacatcctttgtccttcttgctgcctgtactatgaatgtagtggttggatcttcagaagcctatttaatcataaggtaatcttaaagatggaagttatgattaagaatgccagaacacaaagataaaaaatatagaagtctcagatgaaatttctgaatcagccttaaactataatgcttaaactgtttaaatgtgaagggataaaatttggggcatttatgccactattttatgttatcgttgttacagtgagtacaatttttaattggtatgtgtgtaagatttgctcagatctcaatcaatggttctaagaggaaaaagcttaattccaagctgcctctctcctgtctatgatatcccaagcatcacaaagtacacttccagctcctcagaccctgtccttgttttgcattgtttagccaaaccacttcttaacttcaagtagcaaatagataactcacattagcattaggttctcttattacaagtaattgacaagaattgtaccagtgattaggtgttgcccaaagatcttttaaaattccatgtgacccaaatactaccaaatcctaaaagatttaactaactggctcactaaccaatgcacacacatacttacttatttcacccagtatgtgttgactaccttttgcccaccaggagctaggcaggttcacagtgcctagctcccaggcacaaagataaatcagaaaccattctgtctaagtcaacctttcattttagcttagcaggaaacacactaaaccacggctgaaatatgccaggaagttggtagctggtgatgcctctaccacaccgcagtgcggttaatccagcattcgacttagtcgaaatcacttttttcttccaatactggcatttttatggatggatggatggatagatgaatatcagtatcaaaaggtccatgctttattttctaataacaattcatgtccaattatctgactgccagcacagttatctgctatggttgttagaaactttagaaagaagtaaatcctccaaaattgtcactcttaaaatctgagagaaaacagaatgaatagataagagatgcttcaaggcagttcagctctgtgatggttccgttgagatagaacacacatatacaaagtgtttgaagtaagaatttccttcgaggagaagcacaaagggaatagaagacccagcatttgttactggccttagataagcttactgttcacttatttatcaatgtaaaaacgcccagttagtttttagctcaaggaagagaggacatggccaaagatggccttcatgaacttttttttttcctgtgtgaagtatggaaactcattttcagtattggattttgactggattgtcttctacccagaagctggctctgcagaagttatgatcagatctttggaagtaacatttgatctaccgccgaatatagatccccttccttccctcttctactccctccttgcttttccttcttattacactgatttcatgcaaaattaattatcagtcctgtcacatcttgcactgctaacagtggtcagtattgaattatggggaacgtgaacagaattttcagcagcctaattgcttctcctgtgcccagcaaaatgttacgttaaatactcacagcaagtagactagactgtattctatttccataacaaactggcgggatttcattaccagaatccctagcatctactcacatgactctttcctaactgccctatcagactggtcttggataaagtaaattcctttccaaagctgcagctgcctagttaggtattgaaatattgtatccacttgcaggtcaaaaaggaaaaaataacaacaacagcaagtggtccatgagagtgaagtggaggtattaaaactaggctgggtcttctcttggaagatgacagactgagtcccacagtgcctcactccattcaaagcaattaggagtgtaggattgcagtgacaacggatctccagggctatcatagtgctttacctaaagataacaagagattagcccttagtgacagatgactaatatattctgtggacactgactgagagtttgggagtttctactgtccctctcaaggagcttagagaatatgtacacgggaagacaaaaattaaagaaataaatgtaatgcactgtataatgcataatgataaatgcatcttcaaggtacctaagtaatttagaagatattgcagtgggagaagagtactgagatattcaccaaattcctaccagaaaaaataacacttgagttggctgatgaaggttgactaggagttcattagacatagtagagaaagtcattttagaaaaaatgataataaccagctttgattgagagctcaattttgcttgtcctttttggaagtgtactgtatgtatgtattagtccattttcacattgctataaaaaactgtccaagactgggtaatttataaaggaaagaggtttaattgacccacagttctacatggctgggaaggcctcaggaaacttacaatcatggtggaaggggaaacaaacacatccttcttcacatggcagcaggagagggaagtgcagagtgaaggggggaaaagccccgtatagaaccatcagctctcatgagaactcattcactatcaaaagaactgcttggggaaccgtccccatgatccagtcacatcccactggttccctcctacaatacgtggggattatgggaactatagttcaagatgagatttgggtggggacacagccaaatcatatcaatgtattaaaacagttaatctttatagtgatagtgattctttgaggtattattcccatcttaagaatgaggaaactgaggcactgagaggttaactcacagctagtaagtaagagagcaagaattcatacccagcagtatgaagaagtgaaggatgagttgggaatacagaacttgatcattgagagtcatactagtcacaccaaggaagttagagttaatcaattgacaacggggagctcttgaaaagaactgacaaggtcagatttgcattttagaaatattgttgtggaaacagaaggattgattagaaggaagccagaactggagcctggaaagttggctacatggctttcacagtaatccaggaaggggatgatggaagagaggctgcagcatgggagcaacagctggagtgaagaagagaggatatgtgtgggaaatctttaaggggtacatttggcacaactaggtgatagacagaagtgatgggtggggagtagaattggtgaatctactcttctaactgcctttccctatctccagtctcaccaagtatcttgaattaggaagcaaggaaaaggggtcaattaagaaaaagggagagcaaggttaatggagaacaggctcaagaaggaagaatttaaaaatggaataaggcaagagaggataaagaaactacctatggagtgctatgcttgttacctgggtagcaaaataatctgtacaccaaatccccatgacatgtgatttacctgtataccaaacctgcacatgtatccctgaacctgaaataaaagtttaaaaaaatagaatgagttaagagatttggtaatcttgagaaatgtctgtaaagtgtccatgtattccatgggttcaatggggatctgccattgaaattcatagacctgaatatcagagaagggtagaagattagagaatttgctgtttggatagtcgaactccttctttcatagatgaggaaagtaaagtctagagaaattggagagacttgtgttatatcacttagtttgttacagagctgaattcataccacccatttccatgtgccctcaaatagtagccgacctcttccttcctgggagagaatccttaaccaccaagtcctgatctcataggcctgatagtcaatccttggaagggatactgtggtgcattgcttagatccgtcccacttaaccctgggacccacatactcactcaccaacctgctgggagtgctggtcactgacctgtctcaactaggttgactccaggaattgctctctgctaaaggattttttctgtttcagggatataccaaaatgaaaaaataaaaattttatataaagagcgtttgttgcctgggttgtatgcctgtagaatacattcagaggtagaattactgtttcaatagtattaataaatttttacccaatggcttttcaaaagtgtgcatccccaatggcttttcaaaagtgggcatcaatacacacttagaaatatgcagtaggatcaatttcaccaattatctcaccatctttttagaagctaattcattttgcattcttaaattccactaaatttcaagagagcagttaaagaataatacaaaactttgaagcactaaatgtatatatttaagatattatgtcttctgtagtcaatggcaaatatcaagaatagagaagatgcacaaaactgaccagtagcagaaacagagatccacattctaatctcacgtctttctactttggttaaaggcaataattcctatttcactcactgatgagtctttccctaacgagaatgtgactaaaaccagttgagtttgcgaaagggatgtagaaagagacaattaggtaaaggtgaaaaatgagactgacgaagtgacgttggtcaatctcctgtttactgagtgcaggttaggaaataacatcaactaggttttctggaatttgagaactgagtattataaaaacactgactccgttattattattattgtcatttttaattttggattcagagataggagctgaatagcagcaaaaaaaaaaaaaaacatgcttatgaagagctgcctagtgaaaatgacactcctttggcttaggaagagaaagaaaatgaaagccttacttctttcttctactgattgaagtttttactttctgctgtttacttgggtttttaatattgaagacttctttgtagtctctgatgagttttgaagattaattttgcagaagtaagataatattcctgtttaccagaaatatttctgaccataagactcattatttatttattatggatggtcattttatatatttttaatgcttatttaagactccggagtacatgtgcaggcttgttacatggatagattgtgtgccactgaaatttggtgtaagaatgatcccctcatcattcttagcatagtagtcaatagtcaggttttcaagcctcaacccttccctccccctctagtaatccccagtgtctattgttgacatatttatgttcatgagtactcatagtttagcttgcaattacaagtgagaatatgtggtatttggttttctgttcctacatcaattcacttagggtaattgcctccaggtgcatccatgttactgaaaagaacatgatttcattcatttttcttttctgtggctgtgtagtattccatggtgtacatgtaccatattgtttttatccaatccaccattgataggcacctaggttgattctatgtctttgctattgtgaatagtgctgcagtgaacatacaagtgcatgtatcttttttggtaaaataatttgtattcctttgggtataaacctagtaatggaattgctgagttgaatggtaataccattttaagttcttttggaaatctccaaactgctttcaacagtgtctgaactaatgtacattctcaccaacagtgtagctttccctttcctctgcaacctttccaacatctgtttttttgtttgtttgtttttcactttttagtaatagccgttctgactggtgtgagatgatatctcattgcagttttggtttgcatttctctaactagtgatattgatcactttttcatgtaattgttggctgcatgtatgtcttcttttgagaagtgtccgttcatattctttgcctatttttaatggagttatttgatttttgtgttgaattgtttaagtttcttacggattctagatattaggtgtattttaaatgcatagtttacaaatattttctcccattctctaggttatctgcttactctattgatagtttcttttgctgtgcaaaaagtctttagtttaattaggtcccacttagcaatttttgtttttgtggtaattgcttttggagatttagttgtgcattctttgccaaggccaacgttctaaatggtatttcctaggtttccttctaggatttttatgatttttaggtctcacatttaagttttcaatctatcttaaataatatttgtatatggtgagaggtgtaggggtccagtttcaatcttctgcatatggctagctagttatcccagcaatatttgttgaatagtagcgagtcctttccccattgcttgtgaccatgagattttatgtgatgttgaaacccaaaactacccaaaggaattaactactgctggttaattgtacctatattaaacactttctttatagtattttccttatttgggggccatctcaaagtcctaacaatcagaatttgtgtcttctcatatgatttttactcagaattacacagaatacagtattcataaaaatgaaccaaccataaaatatttattcttctactgtgtcaggtagtcttgtaggttcctaagagataccaaatacaggttcataattcttgtcctcgaagatctcccaatctactgataaagcaagtaccatatgcatgaaaagataaatgtctttataaagtttcttaatcatgagtgcccatttgagtggtctgtgggtttttagaagttattcacagaaacgaggctccttagttctgacatggggaccatttgtttttattttcaaaaagctctatgaagtgatttggatgtaaacctctgaaaagaagttattgtcttaaatattcatgggaggctaggcctacttgcatctggagttggctccagaagtctttacaaagttagcttggcattggctgggtttcaaagaataaatagaaggggataaaccaagaagaaatgtggatatatatggggcacgattgaataatttccagaaagaaatcagatagtacaaggagtgtccagagaatgatgtatatggctgaaatggaagtgttatagaatggtagttagtaataaagctttaatatcacaagcatattgaaacaaattgcatgtaaaacactgatgtaataaaaagatttagattgttggagtattttgatgtcaagtacttgtcttcctggtgatgtgaaaccatgcatatgtgttttaagtagaaatgtgactccatgggaaaacatgtaagaacatgagcaaagatggatgagaatagggtgagtgtgaagggaaaacttattaggatgctagttctctgaggttataaagaccataaggtagtggcattggagtacaataaaaagatgacgacattttaaaggaagaacctccctggcagcatggctgaatagacctgggaagaaagagaatttatgcctgaatgaatggaaaactgatgattttgtatctcaaagtggataatttatttagaggcaactggctttggaggaaagagaaaatgaggggttttctaatgtttgagatgatagagaaacaggcaagcatagatactttggaggcagttggatatgtagcattggagtcaaaggccaagtaagaggtagagaaagagattttggagaacttctcatggaggaaatacttgaagtctggagaatggatgagacctgaagggaataagatatgtagatagagacaaaagttgaagggtaacactcagactttgggggagatctacatttaggaagtaggaggagaaaagtaaaggcacagtaagaaaaagaaagattcaactaaagaaaaggccaaaaaaagtgtaacccacagagaaaagagcatttctggggctaaggagtgatcaacactatcaaaatactacaggtaaactagtaaaacaagtaatgtcagcattagtttccttgtctgcataacaataatagttattatgaggtatttttgtgaataaactgaaatgatgactattaagcatttagcccaaggctaggtaaaagaaaaggctagccaaaagcatctgttattataaatataataattactaatcagcacccaactatgccgggcacttttgtagttacacatttgaataagatgcaaccctcaatttcaaagaggtaagtgtcaatacaaagataaagatgtgaagaatagatagataccattttgtggtattgtttctacaagaaagatgtaaatacaatggaaaaggtgccagtggagaaaagtgataactttatgagtcctttgccagacataagtgatagggttttctgtacatattacatgttattcttagacttgtgcaatttgctaagccagtttatagactcttgaatctgtgtaattgctatgttcttgactcaaacctgaagggacagactcttgggagggaatagccaggttcagccttttatctttcttctgtgcacagaactcttgcttactttctccaccatgggtaaatcagaatggctttgaacaatgagcattttctgcagcctgagcagcagttgctctttagacccaatttacaaattaggaaaaacaaataaattatttatagcatgacaaaaataggatttggcttaatccaacagctttctcagttacaatgcttgctgctcaagtaatggatcaattcacagttggctaaatccaggtgtttttgaacctttctatttaaagtatggttctctgaccagcagcatggagatcccttggatatttgtttcaaatgtagaatctcaagccccactccaaacttaactggataagaatctgcgttctgtcaacaactttagaggcactgtatgcagattgagaggcactgggctagaatactgaattagggctgaggaacatcatcacattctccacgctgtcccagtatactgttggatgatgtcagagcaacgtgaaaggattttgggttatggtttagctcatagtccatgcagaagaggccataattagcacagggtaccatggcacttctcatctgagacatgtgacatggatttgcacagatgagtacttctgacctattaatgttagtagtagaagtgatccttttgtcagtggaaaaagctgccagactcagaagcaagtaaaacctgaagaatcttttagaactgttagtcaagaacttcataggtggtttatataaaatttattgtcacttgctaactgcatggctttcggcatttcttaacctttctaaacttcaatcttttcattcatggaacgtagataattattgtacctgtatgacagggtcaatgaaaggttaaatgagtgaagatacataaagtagttagcacaggatctgggatttagtgagggcccagatactacttgtctgttattatttagtttatttagtttatttttatttatttatttatttgagacagagtctcactctgtcacccaggctggagtgtaatggcgcaatctcggctcactgcaacctccgcctcccaggttcaagggattctcctgcctcagcctcctgagtagctgggactacaggcatgtgacaccacgcccggctaactttttgtatttttagtagagatggggtttcaccgtgttagccaggatggtctcgatttcctgacctcgtgatccacctgcctcggcctcccaaagtgctgggattacaggcgtgagccaccgcacccggcctattacttagtttattattatttcattattattgagtatctattatttgatcttttatgtaataatagtgaaataatagacttctgaatatttgcagagaaatccaataattttaagtgatattggcaaatactatgatattagaaatctaggtggtacttaggaatctattttcttagtctctattctgtggccagggaaactctttattccttttgtccctgctatatttgagacaaagatcttgaatgcatccactcttccctaaggaaatgccatcaactcatcatccccataccatgcaaatgccttttacagctgcagagcaggtgtgggcagatgcatacagcagcatatgaacacatgtttaccctccttggccacactttgtcttactctatgttttctaggaacacattttggggtggaaatgcctttattccatttatatttagtcaattatctggtttagcttccattcttacaacctaattaaattcagcccatcaactcagtttaaggcatagcagctgtagacacttcgtttatctacttggagagaaaaaagataagttggtacaggggttccccatcttgtgaatgcaattcccattcaactacatgcaattgaatatgagcatgggatggtattctggacctaatgttaaattctgctactaagctatcatagttgaaataatatactcaactgcaactttacatattttccagggaaatgcaaatgattgcttttaaaggaatgacaactcatttgcctgcagatttcattcaggatatttaattctgaactactagcctatcacccattaactgccatttctaatatcttttgactccctcaaagagggaaactcataatttgtttcacttagaatttacatttttttaatattctagaaaccatgaaagaaatcactgagtccttagctcctgttttttttttttttttttttggttgttgttaaattgtagaatattagaatgtttcagttttactgattgtatttgttaatcattcttcttccactaccgttgtcttttcccatcctcttggaagggtgttagagaagactctatatctcacctacagatgatttcacctagaagcttagcctcccttcatgactactgttaaagataaagactgcctttggttgacaccataacccacaagaaatgattgcattcctcctggatggggagcaggtgacattgcagatgttacacttcccacatggctaagccactgatcgagattaaaaattcaaaagacaccaaagagccacgttattgtcccctcacagggagctctagaaatacatgacctaaattgtttcttctaagcatattatcagttccattttcaaggtatcaacatgatatctttccattggttcacaggaagaccaaagagtgacaagagaaaaatgtttccatttgtagtttttctacagactcatggtataggtcagcttttttattgtaaatatttaagatgtacatttaaggtgtctccatatatgtatatatatatatatgtatacatagtgaaattactagtagagtcaagaaaattaacatatccatcatctcagttacctttgttgtcataacggcacataaaaatctactctcttagcaaatttccatgatacaatacagtagtagtaactatagttatcatgctgtaccttaagtctctagatattcgttctacataattgtaactttgtaccctttaacctatatctccccatctcctcttccactgcatctggtaaccaactttctactctgtgttactatgtatttgactgtttattagtgtcgacttaggagtgagatcaaactctttcactctctctttctttcccgtttttttttttgtttgtttttgtttttttttaaacaagatctcacactgttgcccaggctggagtacagtcacatgattccagctcactgcagcctcaacttcccaggctccagggattctgtcacatcagtgtccttagtagctgagactacaggcatccaccaccacacctggctaattgtttgttgtagagatgaggtctcactatgtttcccaggttggtctccaactcctgagctcaagtgattctcccacctcagcctcccaaagtgctggaattatggtgcgagccactgctcctggcctctacagtatttttcttgctgtgtctggcttatttcacttagcataatttcttctgggtccaatcatgttgttgcaaatggcaagatctccttctttttaagactaaataatatgccatttaatatgtacatctaccacaatgtctttattcctttagcatgaggagaatattgaacattactttgagaactagaaaaaaatgaacatgtgggttattttagtggttaaaaaaaataggaaaataactataaagacatgaaccaactatcaggggatgtttgggttgtttccatatcttagctattgtaaaaaatacaagaaagaacagacatctctatggggtgcttatttcatttcctctgggtatacccagaagaacaattgctagataatatggtagttctagttctaattgtttgaggagcagccattctgatgttataatggctgcacctatttatattcccactaacagtgtacaggcattccctgaacttcactctatattttatttcccaaatgagatggaagtacatggaataaagtagtattcaagccagtttagtcttcacattctaaatcacccctctatgaaacctctccagattaccttttctccccatgtggatctgaatatgctcctttattcccagttgtcctgtatgtatccagttttacagacatagcatctgtaaaggacactgttgtcttacaccgaagtgtagcagttaagaactcagggtttgcacctttccagctctgtagacttgggccggcaactgagcctctttcacccatagtttctttatctagaaaacaggagtgatgcatgtctcataggaccggtgtaaggattaaatgaattgtaactagaaaattgttgggaaataccaaatataattatataatgactagcctctgtaggtataaacagtttaattacttataagtttacatgtctgcttatattaaagagggaaagacttagactgtagttcattttcatgtctctgtaacacagcactctgtttagtagttacataaatagtgattgaatgaatgtacaagtgagtgaataatcatctcaagtctatcctttgtcaaggaaaatttccagatagagttctttctcctttagggggtctttaagatggtcccagtgccagcccaagaagagccagagctagatcttcaaggcagtctgggacctggatcctcccctccagatgcctagaggtatctcctgggaccatgatgggtctcagtcataccccttcattcattggttcatgtcttcatagtcattttctttttttttttttaaaccactgaaataaccctcattgtttgtcattatttctaatactcaatgtagttttaaattttctccccatgctcaagaagagaaatggaaatatggcaaacatctccatgaacccacattttctcacatctttagatcaaaaactcttattcttcagataaacaggttgtaaaattttcagtgttgaagagaatgaaatatgacatttgattttattgattcattgcttatttttggcagaagttatcctttattcagtttcatctctttatgtcttaccacctctttgtgaactagccacttgccttgagggtttacaaattcaagatttctcagcacgattagccctaatagtatgctttccttccaaggtttccagattatccaatacagtattatttctatcccaatcatgtttaaggattattattttacatagaaataaataaagaaaggggaaccaatacaaagtgttagaaagacagctacgattaatatattggactggcccattatcagaccctctagattttacaggtagctttctgatcagaaatctcgggtgagaaatagtaagaatgatggccttagttaaatcctctatcaatatgacaggttaaaaaaaagacatatgagttagttaaaagcacctctcccttggtaactctaagtgttttagtttttcagatggcaatttgtgactttctatagctttttcttgagatgaatttgtggaccagttgaatagtgatagaaatacaggacttgctaaaaattacaaagtgtttatggcagttctggcaaatatcctctagatcaccagataatgccaagtcagcaatattatcaataatgagttgcctactaagaaccaggggaatgggggcatggactgaaactttaccatagacatctttgctattctggactgttggtttgcttcctagtgtacttctgcttatcctttcttccctttggcttcattgagatcctcagccactgagttctatcttggtgcattccagccacaccccaaaagaataacaagaatgaataagccatccatctctgaatgtagagcaggttggaaaatgataaccttattcattattattgcttgatacatttccgaatttgtgttatctgtcattaaatagctaccacagccttctttcattcttctcggtatcagtttaataatttgttcaatgaatatgagaaagaacaggatcacatccagattttaccacttactggctgtgtgacactgggtatggttattaaccccatggaacctcatctttaaagttcagatgatggtaactaactcatgaggttgctagggattaaatgaagtaccatgtttaaggcttctggcgtgggtgctgagatatagcagataagagatggtagtcaaaaagaatgtgtcttactttttttatagtatatagagtgacaattttcaatacaaatagtgtctgtatatatgcagtcttaacacggcattttaaaatttcattgtagactttaaaaaacctaacaaattggatttcagcctctttcttactatattagaaaataaaagaagattaaaataaaaaaaggtttccttttaatcaatctattaataaaaagataagtactgagattccgttgacataaaagtaattgaaagtttataggcaaattcttgaaatagaaaggcactttttttcctcataagaggacagtttagaggatttaaaaagcaatcaaaggtctcatgttttatatgatcaattcaaattgactgaattttcatcatcatcctcctccctccttctttctgatagtctacatttgtggaatagagagatttttgtctttcaaattctaaccctgaggatttttgctaggcacaagttaagacctgtattgttttctcctaacagttcctatgacatttttaaagtatttactttattctagtatgtccattctgttgatcttcgaaggacctgtgtctctaggtgacatctgtattcaaccaattttgaagactcttctgattggatttagcaggagatttgtagagtgtggggctttgactaggcccaggtcctttgccagccaggcatagtttgtccttgtgagggcagatattggaaaggtggaggagaattatgttctatggcactttcagaagctcgagaataccttggcagagccaagccttctgcttagggaatggctagcagtaacaaagcatggtacctgagatcaggtacatagtcaagagttaggttgaaagtcgaatattaacctgaaaaaggaagatttggcagcacagtgtatcttacagtcccaggaaaagagccagttgacatgttctgtgagacttcagaaaactgtacgacgtgaaagtagaagcatttctaatcatagttatattttgagtaatctcttcacagtagaatgagtcccccaacactggatgtactaaagccaaaggaagggccaccacttttcagagttattgaaggaattcacccatcagatatgttttgattttattcagtgattgttcaaactagatccgtttctctaccttattttcaatgggcagtggttctctagttcatcaaaaagtttttcctctggaatttttgagaagcaatagaaatccagagcatttaaaggtgatgattaattagtatattaatcttagataaatgtccccagataatttttaaatgatcaaatttgtatcaaagacattatttattttagcatcattttgatttcttctactttgttgctggggttggggtaaaagagggagaaatggagaccatatataattccgaaatgaaaaaaaataagcaacaatacactgaattttcttagagtaaacataatgctatgctgggttgttatagcatttacaatgctcatcttcccttacacttgaatgacttcctcctggatctgaaacaccttcctcaagagcatcatcacaggactgttaaaaatcctaacatgttacaattttactacctttcttcttccagtattccagcttggagactttgcgtagccctggttaattaatgttgaacttttcagggtatctgtgaatcatggtggggggtagggttggggactagaatttaattaaaggcacaagcttcatggggattgtgaaatcacagattccaaaagggagacagccattctagggagactgctaatagggagtaagcagggtgacaaagtgtgcaggaactgaaggaagatgacattcaaaggtctaaacaggggagaagaaaaacaaagagatcagcatgttacagctgagccttttcaaatgcacggtgataaagaacagatatgttttgtgtgtgtgtatgtgcgtgtgtgtgtgcgtgtgtgtgtgtgtgtgcgtgtgtgtgtgttatgcacagtggcttgaaggtagcagccctttcccctgatagaaatttgatgatggcagcaacaaaacctaaacagagaataattaaagagtaagggggtagttaatgaaatgaaaataactttaaaaggatgaaaagaaattgttgttaacacaccatgtggtttacctatgaacctagctgctgtggaaacataataacacagagtcagctcctgcaatgcaagtaagccacttcctgggtagaaatggggctcttcggaaaaagattaacttttctgtccacaggggtattatttagctcactggaatagcaatttgacaaatggtgcctttatggcccaagtgaatactgctggtttctgctaaaagggcaggtgctacaaacccaagaagaaaaacattcttgcatacttgcccccctcagcataaggacaactttgagcctgttcatttttgagagttccagcagtggaaagaaagctctaaggtttggtaacctgtgactcacagagagcagaatttcaagcctagttgagaaaacattccttcaagagggtgctgcttatctgctttggccacgttggattttggaatcttaactgttcttgtcactttggtcctggttcaagtcaaaagagtttcttctacttgggacttgaattaggtgaagactgacggacatttatttacgtaccaaaatacacaacatatgtgttgcagttagttcctccttacagaggaactggtaagcactttagccaggtagggctaaggcaattttcacagttctgactgtatgaggattcctgtttctttgttgtcctattttatgcatcatccactgattctcatctaaaccccaggccattttgcgtgaaaatagtccttctataaataaaaaatttagaccagaggcaaaggagcctccatctctctgcttacaattattgctcaatgttcaaagttctcaagacttatctcttcctattgcaatccctaatatacccgtatatagatacatttaggtctgagaatgcttgagcttaaagagagtaagttcttgtttggtacaagctctgcataatacgtctgagctgtctccctgctttagaatgcagtggtagaagttttttttacagcactctgattttagccaaggaactaacaaccgttgtgtaatgcactagctaaaatagtctcctttatcgtgtaaaagtcatccattgactcatttatttatttaccaagtgcctactatgtttcagaaagggttgtaaagggaacagctaagacaaggtccttgtcctcatgcatgtcatactctaatgagaggagacagatcatactttaattggtaaattatagtcaattgccaacagcagtaagtgctagagaggaaaggaccagaataagggtaggaggtacttttgagaggtgacaacgtgctagcagccctcgctcgctcttggcgcctcctcggcctcagcgtctgctctggctgcgctggaagagcccttcagtccgccgcggcgctgtgggggcccctctctggggctggccaaggcctgccctctgctggcggggaggtgtggagagacaggcagaggtgggagtcggggctgcactgggcgctcgctggcaggcaagggttcgggctccgtggccccgcactgggcgcagccggctgatgcctgctgggcttgaaaagggacgagctccctctgggctgccggagtgcccgtgctaggttccaaagtcgccagtgagtgccactgagaggtgaagccggctgggcttttgggtggagtggggacctggacaacttttctgtctagctaaaggtttgtaaacacccaatcagcactctgtgtctagctaaaggtttgtaaacgcaccaatcagcactctgtgtctagctaaaggtttgtaaacgtaccaatcagtgctctgcatctagctaatcaggtaggggacttggagaccttttctgtctagctaaaggattgtaaatgcaccaatcagcactctgtgtctagctaaaggtttgtaaatgcaccaatcagctctctgtcaaaacggaccaatcagctctctgtaaaatggaccaatcagcaggaggtcggtagggccagataaggaaataaaagcaggccacctgagccagcagcggcatcctggtgggtctccttccacactgtggaagctttgttctttcactctttacaataaatcttgctgctactcactcttagggtctgtgccgcctttatgagctgtaacactcaccgcgaaggtctgcagcttcactcctgaagccagccagaccacgaatccaccagaaggaagaaactctgaacatgtccgaacatcggaaggaacaaactccagatacaccatctttaagaactgtaacactcaccgcgagggtccacggcttcattcttgaagtcagcgagaccaagagcccaccaattctggacacacttcgagtagtgtggttggagaaggtccttgggagaagacaacatcacacctgaaataagagagattagaaggagccagtgataacagacctggaagaagggaattcaggacagagggagcagaaggctctaacgtggaaacaagaaggccagagtacccagagcagaatgagaaggggattcctaatcaggaaggaatcatatgtggttgttcactgagagcaatcattgacagtctcacccatgttctacaaaatttcacttcatgattaaaacaaattatatctctgtctttgcctaagacgtgtattaaataacagcaatacaaataataaacatattaagtccattctgtgttctagtcacaatattaagtattttatatatattatttaatcttcacattactgctaagaagcagtgataaaaccaagattttaaaatattaaccaatttctcaagactaaacacagctagtaagttgcacgacctggatcaattctccattggcttgtttccaaagccacaggtttactttaacatatacagcttttatagcactaacattgtgttctatgtgtccgtcattaagttgggtattttacacacattatcttaatatataaaacaattatatgcagcagatgttattaccatgatactgcaaataagaaaactgagaaatagaacattcaagggatttgctcacagccaaataatagtaattggcagtgttaggatttagactgatttctgtgtgatctgtagtccattctgttcaacactacatgtacctgccttcccgtggtatcattgccccagttctgaaacctaggtctaggtcgcaggagaactagcttgataaggatgggctttagagccaaaatttaagccatgctttgtcttatctgcataattttatgttcccagtcaggtaaaaccttacccatttatctttatttcctatcaaatgcagacttccctatgagctgttgcttggtaagttccaacccaatatgatgtcaccactgggtggacctctatggcacctgtctcactctgccttggttccagttatttttgtatatgcttcattgattatttctactcacttcccggaaatgttccctttccctgagaaatggagttgtatctccctcattgatgcatcctctgtaacatctagctgtttaatgtgtcactcagaataagtgctcaataaatatttatcaaagtagctgatgtttcaggaagtctaggaagcaaaccacctcttctgttctgctcttggattcaagaacttaagaggattttgttggaaatccacaaagaatattttaaacgagacacataataagactctcttttgagatgagagaaaccaacaacagcaaaagatgggtggtaacagaacggtgctgtttgctgccagctgatgttcttcttgcctcctggaaagatagagccagaagtcttccatcacttcttgggatgagccaactggcctgttttaacctatattacttgagttttggctaccaaaactctaagcattcacatgggcccccacgaagctctgccatctgacactttcagcaccttcaactctatccagtctcactcctgctgtactaacaaacattccataaacacaaaaccaaaaccacttaaaaaaaaaaatcttaggctgtccctacaacttttgctatcctcacgaaagagtgttactccagtgagacaaaagtccatcacaagaaatgatttttctacggaaacagctgtgattggagcaagatacaaggtaaaacatgttgtggtcaagttcaaggagaaaacagggtggctagccctagcaatcctactggtggacttacttctgcacacttcatgctactatctatcctgtgttgtctaaggctatataatgtcgagagacgggctagtccaggaatcatgacagcaaatgagggagagagagagagagagaggagacagagagatggctcttgcaacctttccaatagcttttgataggttacgtatggaaaaagcctcatattgacatcaggtttacttaggttcaagtgaaaataatgtctttaaaataaattatctcttttgatgaaggaagtcctttttgttttttgataccatgttgcttttgggaaaacatgcctgaaagtaggcaagtttctctaaagcaagaactgtaaaactcacagaaacataaagttgacttgatcatgcccattttataaataaaggaatggagactcaaagcggttaagggacatgtctgcagtattttacccgtgagctatatgccctctgggtttctcctcatccatctgcccccaacaactatgctctttcctctttcctttactgtttctgggcatatcaaagccaaacttaacagcaccaatttcacattaaacaaaagaagaggaacctactgaccaacctttccccatcgccaccacgtctagcctcgccagactctggtaatcattacactactctgtaattctaagatcgacctttttagattccatatatgagtgagatcttgaggtatttgtccgtctgtgtttggtttatttcatttaacataatgctctctaggtttacctttgctgcaaatgatgttctggtgttctgttgcacagtagggtaactagagttaacaataatatattgtgtcattcaaaatagctagaagagagaattttgaatattctcaccacaaagaaatgacaagtgttagaggtgatagatatgctaattgcccagatttgatcattatacaatatacacaggtatggaaacatcacattgtaccccataagtatgcacaatgattatgtgtcaattaaaaacaaaataaaacataaacaggagagaaacatgagctaaaaagaaaaccagtaagcaaatgcactagctgaatcagatcattttatgcctcttgatcggactttgatggtgggaacatcaggctacaactcttgcctgaatccacagacatggaaggcaagagaaattatttaagcctatgcaatcatccaggaatggaaagtgggaatggggttcaccaaacgtactagttttctagggctgttgtaacaaagtgtcacaaactgggtggcttcaaacaagacttatttttttcctattctaaatgctagaagtctataataaagccagggccacattcctgctgaagactgtagaatccttccttgcctcttcatagcttctggtatgtgccatccacctttggtgttccttggcttgcaactgcatcactctaatctctgcctgtgtcatcaaatggcgttttccctgtgtgtctgtatttgtctgttctcatgctgctttgaagaaatactggagactggataattcataaaggaaagaggtttcattgactcgcaattccacatggctgggaaggcctcaggaaactcaaaatcatggtggaaggggaagcaaacacatccttcttcacatggaagcaggagatagaagtgcagaccaaaggggggaaatggcccttatggaaccatgagatctcatgagaactcactatcatgagaacagcatgggggaaactgccaccaagacccagtgactccttactgggtccctcccatgacatgtagggattatgggaactactattcaagatgagatttgggtagggacaaccacatcactgtctgtcttcacatggtgtttctttcttcttataggaacaccaatcattttgagttaggatgcattctaatgacattatattcgtttgattacatctataaagatcctatttccaactaaggccacatttgcaagtactagggattaggacttcaacatatctttttggagacacaatttaacccataactccatgttataactgtactttttcagaatatcagtacgatggtgcccctaatcaacaaatatattgtcaccaatatgctgcagtctgggagaacattcagggatttaatttttctgacacacagactgtgagttcttttgttttttgtttttgtttttctttttttgttttcagcacatcacactctggctgtcattatcagttccccataaactgtgataatttttgtgtcacatagagtgtttaggttggcctctgatgaaatgaagcccaagtacttgctcttccaggcacctaacccagggcaaaaacacagagacctaaatgccttctctcagattatttttttattatatttccagtgagcagaaacattacagatgtgagacttgttctagaaatcagagtatttccccagggaagcattatcactgttcagatattactaagaagtgtaaaatgctggagggcaattgcatccacaccgtcctctgcccatcactgcaaagggagaaaggagaaggccatggggggatgcagcaagaccccaaggtctaggctcctctgccaaaggagcatggatgaccaatttggaaagaacacttgagaacctctgctctgtcctcttcacttcactagtgagaaagctaaagctcagaaaggataaatgacttgactaagctacttattggaaggtgggtgattaggatgtagcataggggtaagactgtgtaaccagctgacactgctttaaatgataaagcattgagttgttctgttttaatggtacacaagtcaaaattgttcaaggattgagagtggagccagaaagcctgggtgtaaatcctggctccttcacttacaagctgcgtgatttggggcaaatcaggtaaccccttcctacttctgtttcattgtctgtaaaatggatattataataatgtttacttcatagattgatgtaaaggtcaaattcataatatgctaaaagttcttggaacattgccttacacagatcaagtgttaaagaagaattgatattattattattgttattgttattattcttattatccttgagttcataatcagggtgtcctgaatatactacacccaggaatggaagccccaccacattgtaaagacacattcacttcccttaaacctcggcatatttgaggtggttgtagcaatagtggagggagagcagcaaggatggacacaaagcttacagtcacccagcagtgtaggaaaggggggaatcctgcacacactcccagacatggtggaggtcctcaatcactgcagagaagactgttgtgggaatgacagcaaacatgtagctcatcaagaaaatcagctgacttattagttcttctggatctggttggagtccctgaccccagagctaaattataaaggttattttgttgtaattttgatgctctaagaaactgatgtaagatatagaaaagttcttttttttttttttttttgagatggagtcttgctctagcacacaggctggaatgcagtggtgccatctcagctcactgcaacctccacctcctgggttcaagcgattctcctgcctcagcctcttgagtatctgggattacaggtgtgcgccaccatgcctggctaatatttttatttttagtagagatgggttttcaacatgttagccaggctggtcttgaactcctgacctcaagtgatccacctgcctcggcctcccaaagtgctgagattacaggcatgagccaccgtgcctggccttataaagttcctcctatattatacgtgcccatacctctatactagtttttctctcttaaagctacattgccatctcttgtattatccgtgcatttgtcacctgccacttgtcccccatgcccctcctttctagcctgtggtttataacatgctgtaagtctggaaaccaaataatcatgtttattagacttgtatgtaaatcgaacctaatgctcctttcctttgttgttgttttccttgataatgtggtcttttaaaagagtaaaatttgaactaggatttatgaaatctaggtttaagtttgagttctttttctacttatgtgatcttattcgagtctcctgacttctttggataaagcccaaaacaccattttacaggtgagaaaactgacagagtgacgtatgagtagaacagaggagaaaaggaattgaaaattcaggtctgtcaaactgtaatacccaggttctttctgtttgataacaccgttttcaaatgttgagaatgactaaagaaagatatagaaatttgtaatgattaggtatttatacattctcaataatgaattttggtataaaaacatatttttttatctaactatatttttcatgcagtcatttcagtcagtatcaccatctaggtttcctctagggaccacatatcaatgactcttaaaatcactgttgtgcaaggtgagtgggaaaggaacaggatggtagagtttggattggggaacagactttgagcactgaacagcaggcagcattgctgttggcagagtaacggagaaggcgctgaggcttacccatgccatcatggcaaaaaatagcacggaaacagctggtgagctgtcagaatgatcttaaggaggaaatgtgaaatgtttctgcttggtgcattaatcgagagttatttggacagaactgaattgccaggggaggaacaagcaaggtggtaactcacccttccctgccctttcatctctctgtaatacggttctatgtcatgggcctccttcacatacacactcccccagttgtccattactcccaccctctccgtcttacccacacctagagatatgtgtgcacacatccaaagagataacagaaaaaaaatccatttgaaatgcttacagatatttcaagacaaaatttaaagagatattggacagattagcaattatgacttttttaaacttttattttaggttcatgtgaagttttgatatataggtaaactcatgtcaccgggctttgctctacagatattttatcacctgtgtatgtaagccttgtacccaatagttatttttttctgctcctctccttcctcctaccctctaccctcaagtagacctcagtgtctgttgttcctttctttgtgttgatgagttctctagaaatctttgtgattagttgtagttgagtactaatgtggctttgttttttttttcatggagttgtttaaatatgtgtcctgattaatttttgttaactgttatactaagacttttcaccatcaatgaattcagtgaagggttgaagggaagaagtgcaggaaaggagaacacacaaatgagaatgtcagtcttgactgctgggtgaactttttttcgctgtagaagatgaaacaaattgagggccaacctcttgaatcaaattgcaaagtaactttctgctgggaacagtttgagtaacccgaagtagctaaggtcataaatatttttacaggtggctaaggaaagagcatttgcagccatggaatcaggtgttgttattttgggtgtgaccttgaatagaggctgctaacttttggcttctgtttccgataataaatctccctcctccccacccccaccatcagccccaaggaaagatgaatgactcaggtgcttcagagacttcccaagaagtggtttcagtatatgcagcaagtggacatttagaatggcacagttatccatataggaatattgttgaggcagttcatcttgttgtccctatagtgtaattctttggagtagaaagcaaagagcaataatttgtccaataaatgaaataaggaaatgaagagaaaatttacataagccagggaggccaacttaattttctaaagtagtgaattgactttttttccttggattttgaaataaatggcaataaatccagttgtggggtagagttctttgctttcagtgatagcttaggaacattctgcagattgttaggattgcttgtatgtggttttaaatgaatgaagctgtttctatacagctattttcagaaattctatgatctaaatgttttagattcaggcaaataaatacatatctatattgggagataaggtttttgctcaaacaagcaatgagtagttttcccattcctaatgtccacactatcttgaccactaccaagaaacactttttgcaccatgatgtgcaaaccatgtatttcttatcatcttgatgctgttgctcattttgcttaagttttaaagatttggcctttctctttttatgttgattaccaagagtgtctttgcaaagtcctttatgcagtactcaaagtatgtccatgccatttagctcctataaagaaaacaagtttttagccttcctaggaaattaagtttcctacaaaatatatgctcttcaaaagctctctcggcttcatttcaagcatggaaagcttgctggtgacttttgttctacttgatacggcatatccattcttgagtgaggctgagtacaaacagcattatcctgatgtaaaggaaacaaaaataattctaaccactaattaactaacagcaaagagactgatagtcttaaatggaaagaatacttccatggtctagtttctagagaacactaccaggggcttgaaggtaagtagcctctactggaggctaagggaagctaaacacttaagttttcttctatattatcagttgctgtttagaataaattataatctccacgtttttttttgagacagagtctcgctctgtctcccaggctggagtgcagtggtacaatctcggctcactgtaacctccgcctcctgggttcaagcgattctcctgcctcagcctcctgagtaactgggattacaggcgcacagcacctcgcctggctaattcttctgtatttttagtagagattgagtttcaccatgttggtcaggctaatctggaaatcctgacctcgtgatttgcccacctcagcctcccaaagtgctgggattacaggcatgagccaccgcgctcggcctcttctttactatagagtaaaagttgcatggtcgttttcttgcatttgggtcacagcttcagaaggttattaccaatcagaaaaaggttttgagtcttttatttcctaaaactgagtgtattcgttattgtctaatgacacagcataacaaaccactgaaattcagtggcttatcataccaaatatttacgcccatgtttacaggcctgcaggttgactgaaatttggcttgtctccgctgggctcagcatgttggctctcctttggactgcaggtcagctaggattggctccaggctgggattaggttcagatatgctccatgcatgtttttttctggggctcaaactgaagggacagtgtctatccagggcttagtctttcatggtacatttctgcagcacacaaaggctccctccaaatgcagcaattccttcctcagcggtagtagtccagacagaaacagttttggtggttgcttgagttctcccagttgttctcctgtcattttgcaggtcaatctgcttcattataggaacattctactggagaaaaaagtctatcattattcaaaatatccctccttatgcatacttcccactgcttagatgtctatactcagaaaagttactatgtggtttttctttatgggacaatactgcgtgatcgtggcgttcacatttctccctccaagtccttgcttttctagtttctgtaatcattcctcaggtgacataaaagtattttccgaagttttgccattttcatcacacaatattgtggacaaattaaagcctattgatgactttattaaagcagggtatttaccacaaattaggattctctgcattttgcctgactcctgcagagcacagagaccattcttgtctccaatagcaacactcttctattaatcaatcaagagctgacatgaatgtttttatagagattctgttccacttagcgatcctattgaacccctggccatgtggtatccccacagctcttcttctgaaatcccattttgaccaagccatccaaattatacacttagactgtaattgtttcttttccataaatgaatttacattcatcttaattcacattcgttgagattttttctctgtttccaagtctcttcacagcatttgtattctgtcattcaatacatttcctccaatacatcatatcacattcatatgcaatatgaatgaacttgtaacaatatctctctttttttttaattcaagccactgatacaaatattgaccaggtaggttgtaaaggacatggttctgtggccagccctgcaagatctccttatctgtttgtttagtacaccatgtatataatgtgtaagcctgcctcagttttcttcatggtggcctcagagatatcactgaagacctatctgatgctttgctgtgatttttattccctgttcacgccattctcctgatttcctgtatagtaactatattctcaagaagatgagattagtttgatgtgactattctttgtgaagctgtactagctaattgcatttcctcttagtttctaaaacccagaggtcccaaagtcaaatgctttgcagccaggcaagtaacaaatgtctgggtcagaagctgggtattattcgtcatttcatgaacagaaatatatatcctctgagtagaagactctgccagcagaacaaaattcttctgttagctaatttcactagccatcatatgatttagcttctgaagcagcttgctgctctgttattcgtgtgaactcatatcctttctcatttggaaagtcaagaccacatgggtacacctcttatcacaagcttcgtagagaccacaaagatgccactttagtcccaactcactaaatctcctctacaatgtctctaaaaattatccaatagtgttttttaaaatatatatcaaattatgctatctcaccacatcacagtatagctgctactattcctcctgtcttcctgtctcagaggaaaaatttgcttatcaccttccacagttgagtctacctaggtccttggcctcctgcccttttatcttttctgagatctcatgccatctgttacctcatctctattttatctgttataattcctctcctctgcttcttccccagctgctcagaacatactgaaatatatgtaagattttgggttttttttctggtcattttgctcaatgacttcctaataccaactgaagagagtttatatttcttaatacaacattgaaagcctaacatgatttggcctcaacctacctttttttatccagtaaaattcatttctctctaatgtatactatattccatccaaactaacccactgattagacttcatttttcttttaattactgctttttgctgtgctggtcccactgcttagaatgttatttcctcaaccttatttctgtttcctacatttgttgaaatcctagatgtccttcagaacccagcctctgagtcacctcttgcaggaagccttccttgctttccctagcagaacaacaatttctactgaaaccctgttgaattttgtctccattattgcctttaccaccttctatgttttgacagctattttgactatgtcttatctacccaattgtaaacttaatgaatacccacactgtatcctatttatctttatatctttagattgcaacacaattctttgcacatagtgtgtgccaaaaaatctctattgattgatggtgcaattctgatatttattaataatgatcaatctaagtatttatccaaatcaacccaatgccctatattttgggacaattacccttgagatttttataaaccaaattcaccccatgtaaaacagatgaaattaaccttaatttttatctgatgtgtaatggctaattggctaaatttctttcataaatattacatatgtactattttttatctctataagtattctagtttgtctagatgaagaaacagaggctaaaaatagttaaacaaaaaattacctgtttcagagcttgaaagccagatctgtccatggaaatctcctgagagaagaaggtttggggatgcatataatgagagcagagaactggataaagagatgtctggatctatttttggctgttgtttagatttactttgtgactgaaggaagtttatctgaggctttcccatttgtaaaactgagattcatatacaactgtgcaaaatatgtgtccctttacttacctccctctaagagattaatgagatgatactcaagaagcactttgattttctctgatgaaagaaatggataagtatgaaatgaagcatttactacttctatcgaaggtttttaagatggcagcctttaaaaattatcaaagtgaaagctaaaggaagaaacagccgtgtacattttaaatcaagtcaataattattgtagtgcacctaatgattctctgatatgtgttttgtgcattaaaatttaccaagcacttttacatatattatctcatttgatccacaaaactatcctgtgaagtatgtaggctaggtggtttcattaccatttttgaaataagaaaactaatactcaggccaaatgacttggtcactgctgctcgactcatgtgaaacagtccagggttaaactcaagtttcctggattccaaatcccaattcaggtatcttgcatttctgtccacttgttaacatcatagcatgcacattggaccatctcctctgtgttcacttacattctatccatgttcaggattgagtttaaatcccatttctgctcttaagacttcccttatcactttaactgaaaggcagactttcttattccatattttttttgtccttaaatatattgtttcctggaggtctttctagtgagttggatttcctgtattccattcttccttaaaataagcctttggaattcagcccagcttccacacttcttgatagctgccaccatccatttcattcctgggactgagcctcagcacaaggattatttaaaagttaaaaatagttgtattcataatcccagcattttgggaggccgaggtaggtagatcacctgaggtcaggagttcgagaccagcctggccaacatggtgaaaccccatctctactaaaaatacaaaaatcagccgggtgtggtggcagacacctgtaatcccagctactcgggaggctaaggcaggagaatcactagaattcaggaggcaggggttgcagtgagttgagatgcgccactgcactccagcttgggtgacagaatgagactctgtctcaaaaaaaaaaaaaaaagtttttttcgtgtcggtattaatgcctggtataatacctcgcacacagaaggtgttccatatatgcctgctaaagaagtggctagactaatcaacaattatggatgggagggaaggttcagaaagtttggtgacaatactgggaaaaaatgttggcacctgataatggtggacctgggataccaggctgaagagtttgaaacttgcccttttggcaacaacagatttattggcaccaaggaatagttttgctggattccacttttgaactcatcaaattccttgcttttcttttccttgtcttttcaatcctactgggacctcctcccaccagtgccactttactggaggcttgtgatatgtatgacaggcagtaaaacccaagtgaatcaaggaagcctgttaagagcactgatttctatgatgtctcagtttgttaactaaattgcaggttgtactgcttggccagagacagctgacaggcaactctgcctgaacaagtagcatctccaaaatgacatgtgcactttagtttcattagaggcagtggtatcatgattgcctgggccattgcaataaatatggtgatcatatgtatcccttgggatttggggttgacagcatagttgggctgcactaaagagtcttactctgacataaatgacggcaaagtagatctctgggcccctcagcaaggaggcagaagttcatgttgcaaagaaagttccacgggcctactgaaatattaccaatcaaaattacaatttcatttattgacaagtcatatttaacattcttctaatgttttttctcacatgccaatgtccaaaaagctaaaccatcagctgcatgatgctaaggctttcagcagtcagcagaagcagtggtagttgcgagctggttattcagaggcagctactgtgctccacataaccataaagtgaacattttgacattcccgaaaatgtaccaacctccaagtcacaaatcctctgtagatgcctgtggattggcttttcagatcctcttaaaagccaatctgtggtggcaggattgtctgaagagggtagacttgggcttctggtacgttacagaaggcatggtttctccatctacactatgctataagacaactgctcttctctgaaaagaaactactggaatcacacttcttgtaacttctctctattcccttatttagttggtgggattggatgaaggatcttcacatgtctagtgagactcctttcttctcttcttcctatccaaagggcttttcttcctgggctgagtgtatccaggcctatttcatctttgtaggaggcaaagggaaagagaagagaactagaaattggtgtaggcagactgatctgtggccaggtctaagtgttgccccaatccgttctcccatccaactccacaagcagtaaagtttgctggtcctttcatctatgtctatttctcaattggcttggatttcacaatgaagagggctatgatttattggcccacttaaacctcaacatggtagagtggcaattttgtttttctggctcttatattgcaatgaatattttttatttgacagtctgttataaacgaaaataatttttttcactatcagtttctactcaaaattaaatggtagctctagaatagtggcctgcattaaatttttctttatggttatagccatgcagatagatgcatgaactcagaggactaaaaatgtgtttccatgtaatttaaatgtacctttctatacggaacggtctgctgtcatgcaactttcaaataatgcattttattatcattatcttttccggcattgattaatcctactgtttattggctaagtgtacatttcctattggtatgtttctgagtcaaggtgaaagcagttaatacttaagagttgagaagcaagtttatttaaatctagtctttcttatgagtctgcctaacagtgatagattttgttgttgagccacagtttatgaaaagtgcattaaaacctcgagccgacccatctctctgaagcagcagttgggccattacattttggcaggcacttcagatgtgtgtatgattttatgatcaggtctgcttaattcatcccaactcttcaaagaggaagggaactaaaattccttgagcatcttctagtatgtgctagatgcctgcatatgttgttttatcctcatgacaatctctcatggtagatagtattttttcagcattgaaggtgagaaaattgaggttcagagagtttaaataatattgtcaaaaacatataggaagtgatgaagttaagctttaaggccaggcctgtctactcaaaagcctgtgattgttatattaagggttaaaaaaacaaaaaagtttgcaagagacagacaagttatttgaacggaatgaagtataagaaaacctgtgctttccttaatttttcttgaatcctgtggccttctcagtctatcctttattgaggttcagagaggttgctacttatatggtagcaaaagtatttcccttccctacttaccctactatacaaaacaaacaaacaaacaaacaaacaaaaaacagaaaacttgatgataaatgtcaatcaacactcagcctctgcatctgatgagcaacagaaattagcggggactgtggtgaattggaaaacctgtgcctttctctcccaatcagctctggctgattgtcctacagaaaatgttggctctgtgttactaaatcttaccattttttaaaagaacagtctagctgttcacgagagatctgatcttaaaatgttgaaaactaattcacatagaaaaatactatgtagtacccacccctcaaaaataaaacttatgtgagcactcgatccagcataaagtctctgaatttgtaagttctgtattacacaaggcagctaataagtaactactgggaaaaataattaacaaacaaaaatcaaatcaaaataattttcattactcttccaataattgtgccttccagatttagtactgtttgtgtattgtgcctctctgtggtagaggcatgacttctggtcctctatctgcccttcacagagtggagatgaggccagtatgcaatgactactcaagttttagatgttctgagcacttgtttctgtgctttctctggatagatctggtagtttggtgagcagagttggcgtggctcatcagcagtcaccctttggcaatggaaccagaaaagcatcatgctgtctgttaaagaatgtgtctatgcttgtagctagtttcctaagatgtttgcctctaggtatttgcctgcagaaagttttttgaagtcaatacaaagtagagtggcaagcgatgcatccatgtttgaggatttgggaagcatttttctgtattctttcaagtaaggcctggtcgataagtttagccacactcaatctaattccttgtctgtatccttattatctcccctcctcttctttaagttttcacttccttctgaccttaatcactccctcaatgaacccataagtatcactgaacatgggtgtcaccagttagcaacagtaagataaccgctaacttctgaaacatggaagctctagcattgcttggatgatgtcttccctgactgcctgtgagcctctggccaggatccggggtaagtgcctcacaaatcactgttcatctaaacagctaaagctcttctcctgatggaagagggatacctacagcagaaagcaagggagtccaccaggcacgtttggaaaataaaagattttatttatatttattttgactctatagtttctaaattccataaatgaaattttgccattatcaaggaaatatttgctagggagtataaggaaggccctttgggtaagagagaagatattctctaagctgtagcatgtttatgaaccttaaaaattacttgtctgtgtttgtatatgttcagctctgagagtcttccttaacattcaaatgtctctgtcttggcaaaaattagtgaggttttagaaagtagaaaagctggttgatagtgtaaggaatttttaggccaattttctattttttccttctatagactgaattttatttttataccaatagtttcaatcttctaaacttctcccattcctctttactttctcaactgcatccacttaaatacatcttattgtttcagtcagccttggctgctataacagaatggcatagattgggtgacttaaaaacaacaaatatttattgctccccattctggagactaggaagtccaaggtcaaggtgccagtcaatttggtttctgctgagggtccatttcccgactgacagatggccaccttcttgctgtatctttacatggaggagagagaaatcatgcctaatgtcttttctatctccgggcaggtagtgcaggaattgaacttggttggaggacatccagctggtgtctgctgcagattgcttgcttgcttgcttgcttgcttgatgtgtggggaaaaacctccacacatctagcgtcagaagcgtgttgtgagagtataggagaaactgagtttgttttttctacacagaagaatttcctatcctgaaggccaggtaatgaatcctctttctctggttacttgggcaatttatcaatgactgtctgtggatatttatttggaaatattatatgggaacgttccttcattttttatatctcaatttaggaaaccatgtgcttctttctcatttctcttttgtccccatcagcgatctatatttttttaaattgttattagaaacatctcttatttaatctccatcatcacccaacaagctcagcaatgtgactttgtcttacggatgaggaaactgggtgcagagtatttgtggctttccccaaaacctgcagtaagtgaacaactagaattatatccaagccttctgattcaaatgcagttgccctatgcaccacaccaaagtatcgtttacactcttgagggctaaagaatgccagatgtatttatctaacttctgatgtgcctcccaaaatgccctatacagaggataggatcaatacacacttgatttcaaaatttctatgacttgattctacttacacatcttattgatttggagaaataaaggtacttcttgggggaaaacatgactacatgttaaaattctgaatttggcaagtctagtgcaaactgaaatggatggtggttgaagtacagccaactcatggtggtccaaaagactgtggtgaggggatggcctcccaagaggcagggattgagccctacactgaccagaaatcactgcattacagaataatggagaaggcaagacaatgaaactgagtttctctgaaagcttggcatcttggatatttcaaagattaaagttgtatttaatgggaatcacgtggttcaattaactggtaataggatggatcagtgtccacctctaggacttcaatttgagtctaatccaaacacagaagcagagtaggttgaagcccttggtaatgaacactaagcctttcacctcccggtccacagagaaagttcctctcaggccacagaggcctgctggcaattttcctgaagacagtttggtagactatgtgaaacaagtgaacagctatggtcacctgagaggtagtggtactctacattttcaaaagttctctcccaaagcaaaaccatagcaaaaattgaaaagcagtaaatgaaccatggatggagatattgcactatgcacttgtcttgctagcagaagaatgcaaaggtgctttcaccattgtgtcagatgcttggctgaacatttattaaacttttgatatggaggaagacatagaacataaagatgcattttcttccctcacaatgctcatggtgtgacaggaaaaaaaaagaattgttccattaaaaaaacattgaaatgaatcaacacaaactgatgttattattgaatagataatggagagattgtgggataattagagaataaatctggttatcaaagatgtctctggaaggcacgtgtgtaaagttgttttcagctctgtacacctgtgcacactggccaggaaagctggaccttctgcagagaaaactgtcttctccagataggaaagtgtgcctcattgagctttgggctaggccagagctagaagatctttcctgtgtttgggtcattcctagatcagtgatccctaatgaccagttccattccctaaagctaatgttgactctagatctttctgacatttgattcatgctggaatccatagtttgttttgagtcaggtctataatagattcatattcctgagaggcttcctattgaaagtgaagactcaggattccactgactgttctgccactgtttaaggacgatattacagttggattatagatgacctccagtggacacagaggtgcttagattctactgagccaccattactttgcctaaaagaaaataagagggtcaaagggactaacttttgtgtaagttttaaggttttattcaaacacaaacacacacaatcacacacacatttacatggcaacatatctacaaataactatttctctagcattatgttcctcagcctcttgaatgacatcatttaccttcgtcatgttaatgaacaaaattgtagctcactcataaagaagagagagaagaatgtttgtgccctttaaatgtcaaaaaataaatgcttcttcatattgtgtatgagttcactataaactcatggataatttgtgtatctgaagctctgaccggcttccagagggcttacagtgcctgccatatcttaggggaacaatgacctcatgctgttccagggacatttctatttctccatttggctgaaacttactcactttatactttggtagggatactgaattcaagtaaattaaaattaggagatgtgttctctaattattctatcgaaagagcacatagctttgaaataattctcaatgctagtatggtggactcttttcaaaaggtatgagtcagctccctgtgacatgttttccagtgtctgcttggggtcacctttactaatttcatcaggactgagggaaagcactttccttttcatatttctgcttgggtgtccagatcattctcccctacagaggctttgatgctgtcatggaggtcatagggccggccttttttcgaagtactggagctttttaaatttcactttttaaaaaatttttgttgcttttattatggtggttgggggtaagtaaggacccaccttttgaattagaattactgatcttatccaagagagaatgttgtagtgggtgatagttgacgaagaagagaaccataaaatatcacctggatgaaagacctaactgcagcactatctccaggacacacacacacacaccagagtccccacgtgcagacaggcactgctgatatattacagtctgttggccattttgtttatgataactaggaaaggaaaaatgagcccttatttcagtgtgttcatcccaagatgatgacacagtagattccccttgcaggtaaaccgagagagctcagttaatcaccatttatcactcaagtgactcaagtattttgcagatgcattggagccctggagactgagatattcattgggctgcaatgctattctcttttctcattccatctaatataataaaataaactcaaatcctaacatcagagtgatgtgtgctatcttttagagtcccaagcctttaaaatgtatttgattcactcccatagaactagatacattttccaaacgaaatgtgatatcattacaattttaatgacttataactttgctccatctcctccattaccagactattcctagctactaccatcttttgccagaagcctctaatttatttctctgcatctgcagctgacctccttcaaacagtgttattttgagttgattttagtatataaaccactctcagtgggatctaagatagattagtttatgcctaattgagtgagcttttgtagatcctcttattttatataacttattagaaaatatctaagatatattgttctatttgccaaataataattgtgaatcaggttcattgtacactggttaccaatatgcctgagcctagtgagagagaacacccccacacacaagtcacatataggcagtaaaggacagcagaagctggggaatcattttgagctcattctccaaggctcaggaaagctgcctatggcaaatggaatccacctgtgcacgtactgcacctaagggaccttggaaagtaccccactctgggttttataccccaggggcaatatgactcaataagctgaagtgttgaaggacatcctgttctggtaggaagtggaacagagacttggctattccagccagttcctccttatctgagaatgttacatttctggtatattctttagttatttttgagaactacaagtgagaaaagaacacaaaccaggttggtccgaggctacctagagaactttcttccaataggtgaatgagcaggtatgttacaggttcctcatttgatcctctcaccctatttgagttattctgaccacttgtacatcaactattgattaaaatctgaaaaaagaaaatcataggtgaccttaaattaaacttaaattaaacttaaaaaaaaaaacttaaaaaaaattaaacttaaaaaaagttccacaacgaacaggggtcagcaactttttctgtaaagggccagaaagtaaatattttaggcttgtaggccacatgatctctgttgcagctactcatgtctgctgttgtagcatggaagcagccaaagataataatacatcaatgaatgagtccagccgtgtcccaataaaactttatttataaaaacagggaacaattatatttggcacacagtttgctgatctctgctctaggccaatctatctcctccaacttttgcatattcatacctcaaacatatcataaaaaactgccacaatctaaaccgtattatctgatgaccctaagtactaaatctctccattctgaaatgtgtatattaattttttttcaggtagagaatggtatagaatttagacagggaatttatctgagggattgactgaaaatgccttacttatgaaaaaagagttcttggttggtgtttattattcatgtaggtccatttaccttgaagccataatgctaatatagcctgtcatttggaagttagataaatagtaaagcactttaaagaatcactaaaagtttcctcacaaccacagaataggtcttggagggttactcacgctttgctgatctctcatttatagaggagcagctgctcatttttggcctagaatatccacctctaagagaagaaatttctcctttgcatcctgttcagagctgatcatgcatattcttggaaactgactaaaatgacctagtctgtagtaaagtaactaatttagagttgggactatcaactaatgttattttgccagaggagatgaatgaaaagacttccttagggactagcagcaatcagtcagtagggaacagggttaccaagaccagatggagaaaatggcataggacatgtgtattagacctgccactttctggctctgtgagcatgcatttcaaagtttatacctgcaaagtgggcatttgacagagtaggggacagtcggagagcttatcgatacatacttattgctctccttgtgttctgtttgctggaacacaattttagatcaaatatttaaaaattcacacgtgcgtgctcatggctgtgcactcatgtgcatgtgtgcctgttgtgtgcgtgcatatataccatacagaaaagtactgtctggagaatacattagactatgcatgtaaatgtgtgtagaatgtttttcttttttttcatgcaatacatgctctatggatatttgttaagtgactgaagttttgcactccctggtgcagtttctcaatagtggcactattgatattagagccagctatttctttgttgtgtatcattgtatatttagcagcatgcgtggcctcgacccactagattctagaagcactccacttcagttgtgacagccaaaaatgtctccagacattgccaaatgtccctggagataagcatccctgttgaaatcactgccttagtgaaccaagacattaatgtaagaaagtggttcctaaactttagcatctgaatcaatcaccttaagttcttgtgaaaatacatgttactgggcctcacactagagtttctgattcagagggtcttgcactagcactagacccaacaatttacatgtctaatgagtccgctggtgatactgctgctgggggtcttagaacctcactttgtaagcacataagtaaggtgtaagatgttctggaaaaattccagatgagttaaaatgtgtttcctcatttcaaggactgtaatgtttgttgttagtgtgagcacagggcttaaggtttctttatgaagaccgctgggtggttcctcacagctgtggttgagatttagcggggaaaccggacgtttatgggagacgttcagtctgtactggattttagtcagcactgccctgccagctgtcacctgagtcctgccaggagactgctccaggtcttggcacagggctggggcacctatggaaatgaacttgaagtttgccttgcagtcaaacttaactaccaaataaaccagcatgacattggggtctgtgaatgagaagtggatgttccgagtagatttgaaggacgtgatgactcaggatgccagttgtgactggtgacttagagccgtggtagctttgacttgcatcttatttacttgcatcggctgtcttgtccttccttgcttctcgccttttcaggtcatggttcctgatgtcctaagctgtcatccctactctctctctctcttttttttttttttttgcttggagtcagagatggagctgtctcgagctatttatcagtcttatctctctgcgccctctgttagcatttcagactgtggatctaatccactttaattgattgacctcgtgcaaccagacatcagtaaaacaccaggtgaagcacaactgcagccaggggagaggtggatgtaactttcctggttgggtgcaaagttcgctgaggcctataaagatttagaaaaggagaaatagttttcaagccatttaatatgaattttctagggacaatgtatacagatcccagagtcgatgaccttgactgggagacagtcgttgtaaatagagcagtatcctatagggagtgtgcaaatgcctctgactcacctgtcatccatattagtactatttctcagctagcatcactattatcaccatctccaaacccatcattaacatatttttacatcattgtttgtagataccttcagaatttgccaagattttatttatttctcttaataagtactatttaacacaagtattactgttgctcttgtcttcgttatcgtttttctagacaaagcttgagccatggatagttgagggacctgctcaagatcacatggaaaaaataatgtggagcctcaatcagtcccaattcttttgattctaaatctcaaattcttctagaacacaaagtagacattttcctctcccctgcttttcctgccacagccacacttcagcttctcaaggggaggggactgggtcattgtcatgaggtgatcatggactttgaaagatcttcaagctctacagccgtggtcttgtcagtttgggtgatttctgaaaggcatcttctctgatttagatttttcaacggagagacctggtctcttacctctcttgaaataccttaataatgaagtgcttactctgtgcttataaaccaacaactgtccagagtgtagaacaagaagaccataatgttgaaagagtagagactaatgatcttcactgaaagacacttaatagccacaaaaagagcgcaaattatgttctactgagttcaatgttttattctaaagaactgcagtaaaagcctctgttagtcaaagtcaaaattgatcaatcaggtaagctgtaactcatctttttgtattttacagatgcatttataaagcatagtgagatgttttgcctaagatttattgcacgaaatttgaatatggtagcaataatttattttatcctataatactgaaatcatatttggtctcttatggtacaaaaaagattcttctaatttttttaaaatcacaaccacacattctaattcatcatttattcatttccatatccattaatttaacaaacatttactgagctcatgttaggatacttacatttaaaatactcacaattaggctaagtggacagataagttaggcctacataaaatatgtaatatgtaacacatgtatttctgttatagaaataactcaattataacatgtaaaagctgtgattgtcgaaaatgcatggattttagagtcagacctggattctatttttccataagtctcttattgtgtgaattctcttgtaattaattgtaagaatttgaatatacttctattataaaaatatttactgagcacctattctgtccatttaggtagcctggtttatgttgcagtgacaaaagcctcaaacacttggtgctataaagcaaccaagctttgtttctcagccatctgcatgtccgtagcaagttggcttattgccatcctcactcaatgacccggaatgacaaagaagccgctaccaggagtttgctgggtgcagtggttgacaacaaatgagagaactctcgtgggtctcacaccagcaactaaatgcatggctcaggaatgatactcaatttatcagttaacactgttctcttggcccaacccatcacaacgagacccaaaagtcctctcttactacaaccctataatggaggagaactaggaaagtgtggtaaacagtgccgctcattattttctttactaggaaccagactttgaaatgggtatggaagaccttgctgtgcctggcccacaagaggcattatttacatattgccttccttgtgttcttgcctagcactgaactaacaaattctgtgggaagcctagcagttaagacactgagacctgcttccattgcccatatccctggcatacatttgaaaatcccagttctgtttctctcagctgcaattttctaaaatagcggatgatgcattccgtcttccccaggggcagtctggaatgaacgaagagatagccttcagtgacatctttattcctgagaattcttcttgcccctgagcatttctgctcctggagtctgaccctggtgtcggtagcatctcttaggtcagcaccaataactgcagtgtgactgattgaggatagggcagctgaagctggactaatttggggagccaggtgggcttataaacagtcattattgatgaagagtgacttactggctatttaaagacagctggtttctgtgctgttcagttttttttttttcctgaatgcacttgaggattctttggtaatgtcttctgatttaccacttgtttttgtttttaatatcaaggaagaatatagattgaagcaattgtcttggtagcaactttagtggtgatggctgtggagttattaaaatttatagtcatgctgtttttgcagctacactttgcatttcttagagaggcttataatatctggttacaaagaatgtagagagatagcaactaccaaattgggataggaaatcaaccctgcataaattgttttaatatatattctgtttgctaaaatttacatttattttcacaatatgtcttgatgacagtgcccaccaagccaactagcccttagctcatgacactactttcagttacactaatgaggagaaagaagggagaaagaagactgacattttgtgggtccaaaattatccacagtgaatgccaggtgcttcacatgtctgtgctctcctataaccctcacagcaagcttcagaggtaacaactggcccctctttccctccacacatctctttatgaaagagaaatcagaagtaaaataaccagaccagggtcatacagctttaagagccatcgctgttatttgaaccatgctaggctaaaacccacatttattctattgaaacagtttctccaaaaatcagagtgttttatatctgatcaaatgatgggtggttccttctcctgatctgttttatctcatatatttatgtaatgttttattacttataaagtaccatcatgttcatcatattatatcatccttacaacagccctatgaagtacgaaatgctgatatcctgtccttatagtgtattatcaagaagtggcttcagaaaaatcaagtaatttgcccaaggtcagtcaggtctgacaccaaagccaatgcttttgttccctcacatcttctcttttctagacacatgagccagcggagttgatttgcatggcagctgtgcatgatagtttcaagcctgggcaactctatgggtattcgccacaaggcttccgtgacttctaatgaactgaaacaaagcagttagccatggattataatgccaccgtggtcccatgacaaatgacaaggaggttgcagtaatgaaattttattactgcaaatagagaccacatctgagatctagcacggccacatttaccattgtgggaaacaaaatgaaacacctgggaaaggatctccactgactttagcagtgagctaacaggattaagaagatctcccagaaacactgattacaatggcaaatgtgtggcacctaagataaggaccaaatatttattctggcagagattaaatcttttcttttcctgaatcaaatatggatcttgcagaaaatctgcccaagaatatatcttgctgatcagcgaactcactgagccagaaccgtacttggccactgctgtcactgaaaagctacagaatgctgctttaaaggtctccatgcttcccctaaaactgttttccatccatgattaattagtgacttaggggtgaattgaatcaccagctgtcctttccatgcatccaggatttatgtactggtttctcattgaagaacagtggtgcaataaacagccctcatttgtggggtgggcagaggagtaatggtgtctgcagtcatggtttcttaactcctctagtacttccattctgctaagcaggttatggctcacattattacagcctagcttatttaggcatgagggtcgtgggcagtgacacacacacacccttagaaatgaataccagttctttaagagaaagcagaaaagtcatattaccatttctgaattccttgagaaataagaagaataaaatggacaataatattagctatgggcatgaaaagtacaaaaagaacccataatcaggttcatttatatatgcatgcatattttaaagctaggtgcttttcctagtgcagagatgtagatagcggtttcaacaaacagatttacgaaatcatgagtgtgtttagtcacaattttgggaggtacctggaactcttttcccagagaacagaacatggggattgcagacatcattttatattgcatattatgtaatcagggcacaaaggaaatactgaggtccaccctgtatctctgcatccttgaatgctcacagcctgctttggttgatcattctatattcctcgcttctaagatcaagacttctgcatgacttgtccattcttttattggatacaagatgaactgacatactaagtgataaatggaaacttgaggaaagccttcattttgggaaaagaagtgaagtgtaccaaactatatatagaaaccagtgtccctccctccagaactcttaatttgttgactttaggtgtagtaggtgcttaataaattttgtatttgtgtatttaatgaatacatgaatgaataaaacaaatgactaaatctgagatttagaaaaactcttttctatatcttgatttatatggattctggacttttctcacattcttctttttcttttcctccttctggttttcctccttctcttccttttacttcttcttgaataaaaaaataatagaagataacaaaggatcgtgaactagtactgtgactcagtcttgtagaatgtcagaattactactgatatggtttggctgtgttcccacgcaaatctcatcttgaattatagttcccataatcccaacgtgttgtgggagggagccagtgggaggtaattggctcatgtgagcagttacctccatgttgttctcatgatagtgagtgagttctcatgatatctgatggttttatgagggggttttcctcttttgcctggcacttctccttcctgctgccacgtgaagaaggatgtgtttgctttccaggcccccacagccatgctgaactgtgagtcaattaaacctcttttgttcataaattacccagtctcaggtgtgtctttactcacagaatggaaaggactaatacaactactaaattttattatccttgaatgcccaacatattgccagtaatttggaaaactaaagaaattgagcaagatgtctcccttctgtccttacacatgcctccaacaccctgcaatgctatgtctttccaagagcttaagagaggctgattatatttgaatagtaaggttacatttatttcatgtctcattgtgactactagttccaacttttagtcataaccaattattagagaagagtcagagttttaatagcattattatgtatgctttgtgttttagtgcacttcccaggaggttggtgatatcaccaccagcatcaccatttgcatcattattatctgtattagtccatcctcacattgctataaagaaatacctgagaatgagtgatttataaagaaaagagtttttaattggctcacagttctgcaggatgtataggaagcatagcagcatctgcttctggggagccctcaggaagcttccaatcatggcaaataggggaggaagagtctcacatgacaggagcaggaacaagagagacacagggaagatgccacacactttaaacaaccagatctcataagaactcactcactatcacgagaacaggaccaagggaatggtactaaaacgttcatgagaaattgtccccatgatccaatcacctcccaccaggccccatctccaacactggagattacaactgaacaggagatttgggtggggacacatccacaccatatcaccgtcttcactgccatagtgttactcttatctaattcattgcaatttcccttctgacaagtctttgatggccacagaggttctcttctgctgtgttgcataagctctggtcttgaatatatctctctttggattaatctgaggagtagggctacaagttgggaagcatggcagccatctaatcatgaaaattctaggtgagtttcattggcctctactggggttaccttttctatgtggtttggaactgcagaaccattatgtgcatgtgtgtgtgtgtacgcgtgtgtgtgtgtgtgtgtatatttatatacacacacacatatatccagcccctctgacattggctcctaaccattctgtacacctctgctttgccttgatcgcatgaaaatatgctgagaagctcatatttccactttaattgtaaatctgaattgataaatgatttaaggtccagtgtcttggtgtactctcttagtaaacaggcctaattcatctcacagaaataaactttgcattgtcattgcatagctactaggtagttccaggcctgatttgccttgaggggaattgaatgatgtaacctgtgcggtgcagcctgtgagagcaatttgggtggtttttatgccattggtttttatgctcaggatgaaagctcatggagaaatgtagaatgctattattatcttatcttcatgctgacagctccctctgggcacctacaggtttattgctggttggaggatcaagtttaaagggagagaacttcgtggttggtgataactatgccttttgtgtttctttattataggaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggtacatgttgttcgctcaatggtcctactctttttgactctcccattctcacttttcagtggtgatttttctcatgactgtcaccaaattccagaacactgagtgaagtacacattcatgatttttttgtatgagaagataagtcatctctttaggacttgatccagtatagggagcttctggagactttaccaactatgcactggacactttttgtcaacctttgactgatacagcctgactggctcataccaaagacaattacggtagattttgcagggcctgtagatgaggagcagtgaagggaaggatcatctctatcatgagctagtgtcgataatcataagatgctccatttgagacccagactttgtggtgccatttagtcggatgcagttgaaggtgcagatgccagagagagactctaaaaggacaattactgaacttgaagacacagatcaagtcatggtaacaatgagagaaaaactaaggtggaattttattcgtttggtggactttgctagtttttattttctcacttaccctaagcctgcctggatattcaaaggttggtcctagtagtcattttaatagcaagcatgctggtgtggcaggaaaaggggttaatcatctgtttaaattttacagtcaagaaacattcagcaacaaattcccagagccagatggctgaatcaagcacaacgggagaaaaggttgccttccttaaaagagatcattcaaataatccctcagctttccctcttgcctctcacttctcccaggaaaagtcctgaatgctgatcgtaaaagtgccaggaatggaagggacaacccttcagcaaagggccattgttccacaattgcactgtcatctgatggatgcaagagaatagtgagaatattgcacttctcactaatgtgggcatgaagtgatgtgctactctctatcctacacaccaaactcctcacaattttctcaccacttttctctaacttcctttacagtgaggtgggcacaataacaaagaagcttgaagcacattttcacatgtctaagagccattagctaataatggttatgcttgtgagaaagatacaaagtgaatttgcctatttgtaggccaagactttgaatggcttgaaggctgttgtatctccacacctaactcagcattaattttctttaaaagcctatcagaagtatctgcgctgttgggttgttccctaactgctagagtcccgctatatctgtttaagaattgtaagagcatctggaaacagcatgcaagacccccaaggtattgaggcaaaaagctccacccactattgatttgccatctcggtttccataaaacagccagctcagccattgctaggggtctcagaatttcttagattaaggcacataaatgcccttatgaggttatctttgagtatttgaagaaagccaaagctattaacagcttctaggaatttttatcattcaaattcactacacactaatagacttaatttttaaatgcttcctgcttaatccctgatggatgggggagagggtgaaaggaataaaagcagtccagtatcttaaaagctgttcataggctcatagaaaaaaatcaatctctctctccatatgtgttatcattggccttgctagtgttgctgaagggtttgttgtgtttctgttaggaatttcaaagatttctaaattgatgttaaccacttgccttgagccaatatagaatctacaagtttgctgccagcaatgagcaggctctttaatggtcatttttaaagccacagctatgtaaccaaaccggagattcttgctgtgcgcctatcttttggtgtctttctttagttccaaattatgggttgcttcctatatgttttcaaaacagattaagcctttctttaatagcattgctccctcctgaaaactattattatcattggaaactgttatttagtaacgatatgtgttattatttcaggacagggtacagtatagcatttataagtatgggccttggagtcaactggctagagttgggatcttggtttcatcacctgtgagtctaaagaccttgaaatgtcctaagcattgaaatatttggtgcctctccccacatgtaattcaaaatacagtaacactgaaccataaaataagtgtaagaatttctaagagtttttatttttctcctctgatgatttctgtaatgctttcaaaatatattagattctttcttcccaaattctcattttgtactttctctgttttgttgttctttaagaagatgttcattcttctccctgagactgtttcctagtctagacaaccagggtaatgataatacctggttaatgtgaagattaagtgagttgaccacatgtataatgctgggacaattaagtcaatcctcaataaatgttagctgtgaggattaccaatcatttggctagcattttaaattaggacatatttttgagtacagatttcttcattttgaagatgaaataccctatcaattagacaaggtagatattttttattctccatttcaaataaaaacagagacccaaggaggtgctatgcccttcctaaggtcacatagcaagtgaaggaagacctaggacaagatttttctgtttccaattgggcagttttcactattgctcccccagagaattgggggatgttctgaaaaatgcatagctagaaatgagtatttttcttcttgtgtcatcttagatttctttctttaaagaagtgtcatatctcaaaggtcactttccaatgatcacacaaaagtggttattgtgaggtgttgagttcaaaatcctcatttaaaagttttattggcaccagtgaccccaagctgctctccttacaacaatggcaatgtgctcccatgaagcagctgaaagaatagtgagtatttaaaggagctatatccccttaccttgctgcctcaattaaaaagttgttgtgtgatatactagatcgaggtttatgttccactctgccaagacttcctaggagcggttcactttttgagccttggataccttattttctctcctctctgcttccctgtgctattaaaaggatcaatttaactattaataatttaaagtatcatgagaaaaatctggcaatgtttattttaaatcataagatcaaaattccccgtgtctgggccatcaaacaaagccatcaacctggcaaggcagtcttgacagtttctacaaaaatgtgtccttttgttttctaaagtcattctattttattattttatcaataacagtaggtttagaaatcatcaagggtttagtctcactactcacttattactaatgtttaaacagtaaagacatacagagtagctcctatagaagatttatgttaagttatctcacttggagaacatgctctcggggaattgttcctgcctacaaggtctgaatgagtcagctgtgcaccgggatgaatgggtcatctccacagtcttctcatgggcatttatggggctctactgaaacatcccaccgtgaaatatttagaacccagctgggcacagggcatgtagcactggctctttctttgtgaatcagggaagaaacagaatgaaaatagttctatagcaatcggaatcttatatcactaaattctgggaggtagaactgaaaagcaacttctttctttgaacctgaaaatagaaaagctaagaaacaggagagggaaataaaagaagaatcagcccagagctatcatccaggcactgacaaatgttccttataaagtctctgattgttgtccctatacaatgcggtggtaggaacaagggagggggggtgaaaggtgacttgagtatgaggaattaattttagccacagctctaggccccctggaaggctgagctgactgggtttgttccatatcttctctctgctgtgagtgggtggccggtgatactgtcactgctgtaagatccctgagcatggtccagtaaaggcttttcaggtcctatctaggcttcctgggacatgcagactgatacacagcttcaatctttgtatgtcagggggtgctgaggagagcagggcataccaactcagttcaagtgctcttcacagaattcctcttcttcagtctttaaaatgcacacggatgacctacatttaaatcctatttgaccacccaacttagaacgtgaaaaagaggtaaaagtagctccctttcaaggatgctacattagaaaactctctttatatttgagtttgtcaaattccacagaaacttgtctttataggggttggaagagaaaacattgctatggtacttataaaacattgctatagtacttattgatgaccaaaataccttcatatcggttattacatttgagcctcactccatcctgtgaaggacagggtttggtattattactcctgccatacccattttaaggttacgttatcaaggctctgaaaggctaaataactttcccagtgtcacacagcttaaggagcagagccaacacttttctatcctgatcctcagactgcacagcctcaaactttctgctcactttcctatttctcagagccacgattttattaataatgacagtatttctttttgtaaaaacatattctcaaatggaaatctctgcctggagtagtctagttagtaaggtttttcaacctattgacatttggggctggacacatctttgctgttggtgtgtaaggaagggggcggggtactgttttgcacattgcaggatgtttagcagcatccatgacttttaccccctggatgccactctcatgtttccacaagtgccaaataccctctggtcagcaaaatcacccccatataagagccgctgacttagagaaagtttccaacatattttgtttaaatgttcatcatgtttttgtaatttagacagtatacatcggtataagaaagattttttttttgtccacatctcttcctcaattattgagactttaaaggattaaaaacaagtctatgtacttgacatgatgctgaaatttctcaggccttgggttttcattaattcctagccaggaggtttactttccttttctttatgtcttttcctgcgaacatttgagaccttgccagatttgaagcatgcattaaaacaagccccatctacctgctcattcatccgttcaggactagcgttgctttcagttcaacagggggaaaaacagagagagcagagtcctgcagagggaataagaagtataaatacaatcaagaaggaaagccatatttgaacaaggtttcaggactacagacatataagggcaaccagagaaagcctcacttaatgaatgtgtttgaacattgtgaggaacattttaaaaccatcttataaagaaggtgctccaacattcagtcacaaaatgtatcaattaatcactcaaactagtgtatcttgaatattcacactgctaactagtcatcctttccaatttgtcagaaatgaattaggattcacatgtttgtgagtttctatttccaagggaattatttccacattatgcagtttgtcttcggttaacaaaaatgttttaaaagaatgttttcaataggcacttatatatacatatttgtgtaaagcaatggtctgcaacctggctgaaattgagaatcccctgggaagtttaataaattgccagtgctcgggcactggtctcagggcatctaatttaactgaactggggtgtggtccatggatcagcagcatcagcttcccctgggagcttgttaaaaatgcagactctcaggcaccaccccgtacctgcaaaatcagatcccccagtgctatgggtacattgtaaattgagaaacactggcccaggcatttttttgtttgttttttgttgtttttaaaaaaagctcctaaggtgattctctgtgtagctaagtttgacattcactgatatgtagaagctaaaaaatgtgtctttctttcagactgactaccggtactgttcaatgtggtagccgccaaccatatgttgctattgagcagtgtggctggtatgacggagattctgaaatttttgttttattatgtacttatgtcctaggcactgaaggctttaaatacatttctcattcagtcctcactccaacactatgaggctataggttagaggctagtattagccagtgcaggactacaatatgccatcttttatttccttttatgtgttttctaccatgtaaacgatgggcatttgccttcatgtaccttctgaactcatctaatgagttttgatattatacaatcacagggataataactccaccctatccaagcagctgttggagagtcattaaagggtgatgattaagcatgagggttttggagtcagactttctaggtgtaaccaagggcccctggccctgtcacttgccagcttgcccacaaccttgagaaggttcccgctgtcgagaagtttctctatgctttgatctccatgatcatatatatgcattttctcgcattaaaaccaagtgaatgctcagattgacattactataggacacttcacaaaaaaagaaagtactggctagaggtatgtttcctaaacacacatggcaaactaccctttcttaagctatatttgtatgctctgacagcatggctatggtgcaaatctatcaacaaacttgaccctaagaagccagttacatgacctataaaatggggattgtgttcattgttctgtcttagaaagtggaaagttctttgaataccttaaagcattgcatgaataataattgtacctgcaggtgtattgtctggattatctaccacccgtatacattttaggaccattttttatcttgactttctacaatgaagtttacttatgaaaggtgagaataggggactaagagattttccatcttgctttctcatccttcatggagaattccacaatagtagaaacggttccaaagtgagggacatgtgcactgaataaacactttctcccagaggtgtaggaagtggcagatggtgccattcaccgtctctcagccaaactcacccaggtggtgatggctgccatttgccgaacatttatgacatactccccacttcatgggcagcatcctacttagtcttgaaaccacccattaggacagcgttggtcttattcccatttttttagattaggaacagtctatgggagtgtagcttagtttgggaaatgctggtattcaacccagaaccatctgacttaagagtcttaatgtttaatcacactctgctccttccttagattctcgtaaacaccctagaacagttgcatatcctagaaattctgggtttaactcaaatcttgacaatttagaatttttctctcaagttaaattatagaattcccccctcaggttaaatctctgatttctgcccagtctagaagtcagcatttccttgggcatctatacatatttggctttatctatatcatcggtgtggcctctggaagccttgtcagcctctttctttttgcgatcttgttttaccttctagtgccatatctatgcaaaaagaaagaacttttaaatgaaggtttgttttgccatttaatagtcttgcttggggagtgacagagtggcaagaaggtgcttagtatttttttaatttaatttttgttttatcaaggaaacttcctttcttctctgtgaattcccagccacagataaacaggcttgtatcttataagttaaatacaattactgctatcaaacctagagcctttttctctctcccataaatgtctctaagaagctgataagcatttcaaggcaaactggagcttggactaatgctaaaattaaacataaccacccagaagacaaagagaccagatagaaatacataaaacatttgaggtggtgggaacacatggacacagggcacatagaaacttgcccccaaaacattaggttaatacatagctcaaggttatttataaaggaattaacatacacaaaggagctttttataattataaggatttacatcagataataacaattgtagtagccaaagatattatttatctagaattcacttgtgaacagggcatgcttttggtctacagggctgttgagcaaaagaataattttgctgcaaccctctgtaggactttataggatgcacatttacattttccccatttttagtagactatcttgggatttaaagaagaagttggaattttaaaaattagaaagcacatcatatttatttagccatatgttaaatgttataaatattatagtttagggactcagtaaaatgaataattaaaaatttgagggtcacttctaggtacaatgtaaccagggatgtaagataaagaatttcttgatttccaaccataatgcatctattttaattaaataatatctttcaagattagaaatacagtgtagtcacactttatgggatttttaaaattatacttatctgaaatagtgtgacataaataaaaatattaataacatctccctctatgtgaggcatcagtaataacatacattcttctgaattaaaacaatcatcaaatattgcataatttcaaagctggttagtgaattacaagttttgttttccctattgtcacatggaagctctagtttaagtagttaatacaaattctggcctgcagaagttgtctctaattacgaaaacttagaattattatcccagccataaaatacaattaccctgtaccgtttttcctctgccccagagctgcctgaacaccaagtgtcctaccacccatacaagagcatagttttatttatgggaaaagtttccaagttccagtctcttcaatttaaattttgcacaaggttgcagagtctctctagttatttaaagtctaaaaagaacactgagcttctttgagaaaggtggtacataaatatccaataataataatatatattcacatacagtatgtcatttatacttctataaagcagagaaggtaatgaaaggtgctctatactgtaaatcactcaatcgattgtaatcatattgcagctcatctcaaagagataaagaccttccactcctctaaaatccctgtcaatatcctagcaggctgaagagaggggaaagggggtcagaagaggaaggagggaatgagtcaaggacaaagcggcactttgagtcttcagttcatggagttaacatgaatttgattggattcccagtgatatttacagttttctccataagatgcatttcttttccacacggtacttttacagcctttcagtaagtccctgatgctctgtgttggccttgatggcatagtttactaagtgccaatggtagatatatagcacagcataagaagacttagggactaagtttataagtagcaaatgtcaattcgacagaacttaaatgctgaagtgtatatcaaacaatagaagtcgattgatcatgggctagcaaaaaatttatattgcactttcaaacagcagaaacactgtaaaaacctttttactaactgctgttgcctttaatgtaatagaagtattcccctatcctcatcaccggggtagctctgagtggagccatttctttatgcacttattcattcaccttcattcactattcaacaaacatttgttccacatctactttatatgtgaattcatactaggtgatgggtatatggtgaaaaatgaaacacagctcctgacctcaaggatcctcaagtgtagttgaagagaaatacaagtacacaaggaagacatttttattgagcagttattaattgccaggtagggtactgggttcttgtatcaagtctttgcagtagccccaaggggtagatattactgttatcatttcacaaatgagaatctggagcttctcctagggtcaagctagcacatgaatacctggaactgaagcctgtatgtcttagaaggcaaacccaaagctcccgtacgctgccctatcttgaacctacaattccacaaagtgaaagaaggtgctactattgaggtgagatccaagttcagtagcgggtacacataaatgcctaatggagcctgaagatcagacaggggcgagcatggaatacaatttgggatgtgaccttgaattatctggaacaatgccaataagctctgctcccctacctagtgtgaaagatgacatgacaacttatacctttctcattgaggaaattaatgaccatggaattctttcttttacttaaattttttttttacagttttattgagggatgattgataggcaaaaaaatcctgcgcatactttgatgagtttagacatgtgcgtacacctgtgataccttcaacacagtcaaaataaacacattcatcgtaccttattttacttagtgtcatctccccagtggttccaaggtagaagtattaatctccctcatttacagatgagtaaaccaaggttcagggaggttgagcacatttgctgtggtcactgtccaccaagggtcaactctgagattccacacagatatgtttgccctcatttgccctcacaacctaatacccaggttgcccactccacttttccaatgtcttccaagagcactccagtttgcatcatctacagagctcaaattcacatggttgacagatacaaattcacatgcaaatgtactattatttcctacatcccagtgcatgcagaacactgtaatcccattattaaacatttactagaaatgtgcttctgcctgatgcacaattgccagcctcaatgtttaattaaactagatttgttttcattttaatcacattagagaaatgtgtttttctcagagttcagtggtgaaatcttcattccaaatgcctccaagtgactgaaaactgtatatcccagaggaagggatgagggtattacaacctatccttgcataaaatattttaggggaaaaatattaattaataacaggtaagactgggatacactatttgtttttgaatcatcatagcatcctggaaaggggtcctattattattattaccattttagagatgaggaaacgaagtctgagtggttaagtaacacactccagtgttgcacagctagtaggtggcagaaccaacatttggatgtagacagggaaaccctgatatctttatttagattagggatcaccaaaccttttcccccaaaggccaaataacaagtagcataggctttagaaaccaacctatcttataaatataaatatatttagatattaacttcaatattttattaatataaatatgatatgatttgcatgatctttgttgcagttattccagtctgctgttataatgcaaaatctactatagacaatacataaatgaataggcacagctgtattctaataaaacttgctttacaaaaacaagctgtgatgaaccacgtttccccattaggtttagctgggggaaccctgatttaaatcacggatagttggaagcctacagcttttactaatccatcagctttattttttgaattgtcttatctgtttggaataaagagagcaagagtatctctaagtggatgggttaaatccctagagagacagagaatagtactaccgtgtagggtgacatagacctactggtgaggttaattcaggataaagaaataaagagatacaatatgtaagaaggacaggcactccatttacgtatagttaaaaatgacaaacaacaaaatagctaaataccatttttttaattcaacaccaaagacagacacagattccattctagagcaagatttgaagatgatggacagaaagcattgtttctttacttctgttacttctacttaataagccgtggtgatttaaatacacccctctctcctaaaaaaatagtgcttacttttcttttaaattcaagaattttgattagccaccctagcctatttctcatagcccttatgcataaaggtgccagttgatgccttgcattgatctttcttttctcctacccgcaccctgattgatatgtctgtcttctaagtcttagagagcatgcccttcattatctcagcattggttgtccctgtcttgctgctgagagcttcctgcttgagcttcagttccattttcaagccattgatctgatgttctgaggatggactagcccactttagaggtggctcagcccacttcatgctattgagttttagagattttagaatcagatcccctatttattaaagcagcaagaccaggctatcagtttttatagatgtgcatatgcctaaaaccatgtagtatttaaaataaattttgacctacatcctctattccccaccacgcctggtacccaccattttactttctctttctatgtatttccttcacttttattttttgctttttggattccaaaaagtgagattgtatagtattttttttctgtgcaaagttataagggatgaataagtctagagatctaatgtacaacataaggactatatttaataatattgtattattatatattgataatttgccaagagagtagattttaggtattcatacgacaaagaagaaagaaaggaaagggagagaaacaatcactgtatgagatgatgggcatgttactttgcttgactacagtcatttcagtgtttatatgtatatcaagattacatatataccttatatgtatatataccttaaatatatactttttttaaaagccaaactaaagcacactgggtttttatttacaaaatagggacccccttcacagtttgctgacctcaattttgactccaattaagttatcaaagttctaactaccagaatagaaagcatatactgccagatttggccctatagtgcaagaaaagtggtcacagttttcttaatcctcttttaaaaaggaaagaaacaaacatagtaggtaatcagtaaatattaaactgtacaactgaggtttttggagctttctgacttcaatgactgcatatacacaacaaaaatataagttgttatacagcatccttgacaagcattaactataaatacttttataacaaaagaaaaatatcatttactacaaaacttttaagcttttgctttagaaatgtttctttattgaaacaaatatgattttattgaaatattttttatattagtacgatgactctttattggtctcaaagggtggattgccaagtataattaaacaaaatgataaataggaggaagatttcagtatccttgacagaaaaatacatataaatctaatatagatatatatgtaaaaagtaaatctaaaatcttagccaaggtttagaaatcttattacttcatttttatacctttataaaactgttgcgaggtgctgtttcaaataaaataaaaatttatgtaagtaaaatacaagctaaaatagaactgaaatgtctttaggtttacaaaatgaatagctggattagtttactgaatttttttctgtggtatgggtggcactggatctctagaatcggtaaaaataaaggcaatatattgttctcagggagcaattgagctctcctagaggaggcaaaccaagtgaaatctaatagttttgcttcattctgtgactttcccccgctatgacctcagaattttgagctacaagtaggtctataaagggaattttggaatactcttaatagatctgttcttgaaataagtcagctaaactgagtgaggtgctttgccaacacattaactgaaagtcctgaccaaccctgatcccagaccttcatggacaattctcttgttttatttccatttccagtagttgtatgtaattcttctaagagacttgttccaagccaaccttcctagtggtcttgttgaaatgagatagtggttgtaggtatcattgatgaacacataggccaaaacattattgaactattcagaaagtaaatctagcttattctgtggctgcataattatataactgtagctttctgtcaggttacagtggctttaattttctgatcaaataaaacaatcaatataattgtactttgttcctccctcttctggcttcgattctttgatttgtgccactcaccactctcattcttccaacctccccctactccactggcccctgcagctacttagaatagctagctgttgattaaagggaccaagagtttgagcagttactgtatactttcaaaccccactgccatttggaagtgaagtcccaactgacatagccaaactgtaaggacaaaagcaactctaatacctgctttcctttgtttatagcaactgctcaaattctcctctaaaagtattcattaagcatccttctctataaatctctgtggtagaaactgaataataggacttgaaccattattcaatcagaccaagtttaaacccaggttaaggaaagaggaagtctacacgtctttgctgctcactgtgtttagtatatatcctctataattcacaatcaaaagtaaatctttggacagcattcttgtttgggttagaagaaaaatttcaatccttgttcagaagtctaagcacttgtgaggattccaatatgatttttaaaggccaccatccctgatagtcagaaataaaaacattaaaccaagaagactgcaggctttcttctcacctgtccatctcttgtcctaattacaccttatacttactaatgttgtaagtgctttttgacaagacagcaatggtacatcaatagatactgcatgaacttgagtaggcaaatcaagtcactcagaggccttcttttaatctcttggatcattattgcaaagataaaagcaggtttctgaaggagtgaaattcaaaggaacctagtaattagaatggtgaaaataccaggtcacccggtccgtttccctgcttggttcagatatttctaacaatatgtactagtttaattttattcatctaatttaaaatgagagactttatctttcttccaccaagataatatatctgatttctcctctttggcttaaattttttttttcattcacatcttttattattagggttgtcagttgaaattattttgaataatttctttaaatcatggatttttttcttacatctcatatctaggagctatttcttgttgcaaggtgcaaggttctatggcacatacaaaagcatgctttcatttgggatatttataaaatctctctatacacacacacccatcaatgggcaaatataaaaagtattgcctttgtgctagcatgtagttaatattcaatgaatatctttacacgtaaaatcacctataatctttagacatgttcctcagatagccaagatttaatattacatataaagtcatatgaaatagcttaaagaaggaagaggcattgttattttatgtatatgtctcaaatgttataaaggttataagaacctttctgaacatcgaaaacttcaaagctaatagtttaatagtttgttggatacctgccatcttttgaggtggccaatagttgtcaactttttgagtatccttgagcactgaaggtatgtcaatgtttggtttcattgtgtgttaaggagggaattatagaagtagaatggagtaaaaagcttaaaaaagaaaaagcactgcttctaaggtgattctaatttcataggaaaaaaatactttaaggactaatattcaatacagagtagcggaatctgggtgccagataaatatttaacatttgtggataattttacataatcattggccactttcttaaaagtgttttttaaagccctaattttaaaaaatgctattctggccatcacatttacaatgtgaataatatttgagtcatgacgtaactataagttacttctaatgattgactgtcacttgagttgtaaatcacagcatttagcagtgctagttgtccttacttttggtaaccccttagtccctggatcttgatcattttggggtctttactctagagtctatctttgctctagagtctagctgccattcacatgctaaagaaatgccccttaaatagtacctataacatcctaaggaaatgatttctaaactcttctcaatgagtttaaaaaggctgctttttgctaatccataaactttaacaggggctgaagaggcagtgcctgctttttaaaaaccaatgttgcaggctgggcgcagtggctcacacctacagatgcatgcctatagtcgcagctatttgggcggctgaggcaggggaaggcgggaaaattgcttgagcccaggaggtgaaggttgcagggagctaagatcctgccattgtactccagcctgggcgatgagagtgaaaccctgtctcaaaacaaaacagaacaacagaaaaaaaggtaaaaccaaggttgcaaggtaggactgtttgtgtgtgtgtgtgtgtatgtgtgtgtgtgtgtctagttttgatctttaatgagagttttggtttgtttctattgttgtgtgttagtagggaatgtggtggaggagtgcctttctagtctaagtatacgtaagtgtattcatgaccagtattcaaagggtattcataccctgcagggacataaatggttttgttttggaatgttagggttaagaatgaaagtgatggccctgtttgctcagaaaaaaaagaaggtaatccttcagtgctctctgtgaaatcatgtatggaatgaaaaaattcattgatggggtgagaggtctcagtgccagcaagtcttactagtaaattcagaattcagcctgctgttcctagagatcttcctctccactcctcatccaaagagtgatagaaggaggtcagataagtaggtccttgtccctttagggagctacttaactctactcattatcgtcttggagtcaatccccacctcattccctgctcttcccctagtctgtgtctagaatcaaggatcagagaagcatcaacacatgcatcaacctttctccaattttccttccctttcccaactccctcagccttaccctctcctctcaggaactgcattattgcatctcttcttttggatttggtaattctttccttagaaagaggaacagggctaaggataggcaacaggggcccagctgtccatgtctccatccttggacccctaagacttttgccacacaaactcctttgaatctggagactgcaacggagctgcttccctcctcctgctgagccttcatggaaatcctcataggagatagtgtttcctttacccactctcggacccctgttcttcctggatctcctgaattcctggctatatcatttaggttcgctgcattgcaaaccactccaaaatttccgtggctcatgtgagtgtttttttctcttctgggttggcttggatggagctagatgatcttgatggcctcatgtacccctctggggtctcagttcagatagccgagtaggttcacatggctgggtttcttttctcatggaagttcacatggcaatctcaggtgtaggcagcaggcaagggcaagcattcatacacagatggctcttcaagcttctgcttatatcacatttgctagtgcccatatgcccaagcaagtctcacggcccacccagaaccccaagggtgaaaagatagattcaaactgttatgagaggagtaagagtctcactgccaagagacagattttgaaatgggattgtagctattttttttttttttccaatttaacacactggaaaagaagaaaggctctggttctactaatcatatttccctcgtaaattttctccttccaaccctgattcaggtctcaagctgtggttggaaatcagtgactttcactaagggattgtcctttcttttctttaggacatggctttttgaaattaatcttgattctttctgccatatcccaagccttacatttttttcctttttttctctatgtctgatcattttgctttaagtcaaattgattttttaaaaattaaatgcccattaagaaaattatccacattcatgttcccttggatgctttcaaatattttattttcctttgcttttggcagttacaatctatcagtgttatttgtaaaatgtcttatatttgtatagggtatgttctccctttcctcttttcttcttttctttttaaactaagatagatgtgttataaaacagcccccatgctgatccatacttttctctagacatttctgtgagctcagtactttgttgtttatcattatcctttgtttgtagccagatttgaggccatgttgcagttctcacaaacaaatcaatttgaattaatttgccaagtagaattaacgaggcattgtatgaattcaagacatactacaactacggcatcccctgaggttatttcttctctgggaaaattttgattcttgtaccacattttaatagtgtatatctgacctttgaatcttgcactaaatgatacatggctgccagctggtttaatttttgagaagccttaaaaattctatgcagccaaacaaataggagtgtagacaattctttaattattaactttacggggagaaagttgtcttcaagatcgatactctctgatgcttgcttgttgctaggagttctttttctaatgatgttctaagcagaagtttgagaaacatcaaaatagagaatatatatttcttagatggtctttgaggtctccacaacctaaaaatgatgggctccttctctcaaattataagctataaatcccagcaaactctactcccagaaactgtttttatttaattataaaatgggaaagcatttactctaaagagggaccatggtgattacctgaaattccttcactccctaaatggacatctacatctgtcactaatatattatttagcaaaagaatttccttcagactatgatgaccaatgcaaacaaaataaataagaaaatccagtcccctcccacccctcacacggtgaggaaatggtaatagagttcttcaaagaaactctaatttctgggtcttagatgaataacattagaagtgcttaaggaacttgaattctaagcccctttaatgttcgctcagaaataattaacaggagccagtcagaatagaaaactagtctgggaaaagtgtcctaaattttacactgtataataggatggatctcttaaactcgggactgatatataaaacttctccagtgtttcatttgaccaaaaattggcacacatttagctagatttaaaaaagaatatggtgatggctgagaactaacctgggctcattaaaaaacaaacaaacaaaaactcacgcatgctagtgtaactttctcttggatagcaatagcaaattggcaggtgaggaggatattataaataccatgcacagtgtatcttcatttccctaaagcagtatactgtaatgtacagagaactatgaagggatcttaaagagacctgcctgtgttccatcatttgaagctttctggttacactgtaaagtttgaggtaaactaaaataataaaagtaaaatttattatctcacagtttctataggtcagaatttgatagcagcttagttgagtgattctggcttaaggtgtctgatgagttgcagttggtatgaactacggctgcagtcatctcagtgctatctagacctgggagatctgattacctggaaatctttcactcacatggatgttgactggaagcatcagttactctctggctcagttccttgccttatgtatgtttccatagaacttcttaagtgtcttcatgacatgagtctagcttgctcgaaatgagtggtccgagagagagcaccttttatgactcagtctctaagtccacacactgttccttctaccgtgttttactctgtagaatcaagtcactaagtccagcccacaatcaaggttgaagaatcaaacctcacctcttacacagaggagtttcaaagtatttttagatattttatagctccatcataatcttcctattcagggactagaatgaatgcacaaaaaatatgcttattaaatttgcagataacacaaagctaagagaggtatctcctaccagaaacaaaaaatcctagagttaaacattttcttaccatgtttggatgctgttatgaaacaaaaagaatacatttaatgagatataaatacctgttggacgttcataaagtatgttgtatgaatgcaacgtggaacaatttctttgggaagccattcaactagaaactggcttgagttttagttagaaacaagcctaatatgcggtcctgttatgatgtggttgttgaagcaacggttgcaaatcagtatactagtcaggcctcctgtgggtggtgactagaacagtgattgttacttttagatattttgggaataataaattcattcttaggcaagggggttcaaggatggtctaaaatgtctacaattttataaacactggcaattctataggatgtatacagaaggattactatgtcataagtttcttgagcatcggagatattaataatagcatgactttcctgttgtcgggatgacaatgttcctgtgttgtgcagcggaattgtcctcccaaacctcctccctgtcctctgagctgtgtggggacaccacatatgtatgtttaaatgaacagaattttaaaaaatcaaatattctggcattctggcttcaaaaaccttgcgtttgatgttctctacttagaaataaataaccaaacatgagaggaatgagaggagatggggatggggagtgggaggaagagggtagatagaaataaaaggaagaacaacattacagagaagcagagatgacacagagggtggacacgtgggaaggcctggatcacaggggaaagagtgagccccaaaataacactgtggcttttgcagcaaggaggaaataagtgataagaggaaaggcacctggggaaatcttgaagggatcatatgtcaaacggctgaagagcaaacattaaagctttattttgaaaaggatatttgaaaatatttgacaccaaaaattctgtagggaagtaattcttgtggagtttgccttctttttagtttaactcttctgaatcaggtacttgttataacaaatcatatattgagggattattttgtgccacagatttgcaacatgctttatatacatttccttttaattctcaccgcaatcccatgttgcaattattattacgatccccttttaaatatgaagaaactaaaacttaaaatgcactaagacatggctaaaactaagcatggttaccagaaaggaacaagacaaaattcagacattgaaatcaactactgtagcttcagtgcatatttcagaataattgtggaaggaaaaaaaaagtgacatttgaggaaagaaagcaaattttacagtcagtttatgttttgttaatttataacatggcctttttgagaggggctcttaaataaagaattggtgccaggttaacctggcatactgaagaaagtttcatttgaagttgcttgaaaatattctcttaaattataggaatgaataaagaggttgcagtcgcctgggcctagttttattaacctaactgggattgaaagtatccttgatagaggaggagaaatgagcttcaggaagtgagttacaaatggcctcaaagtactgagaaaggataatgattggtaaaatatgttgtaattattgcatcaaagtaaatcattttagtacataatacctcagcagaaatggatttttgatttgtttaggatatgaaagagaagtctaatattaacatgtatgcacaaaacatgtatgttcaaccagcaacagacagcaaggaataggggcatgaacattcggatagctggacgtaatacaccagggttacatctccggcatggttccattcccattccatagcctataagatatttggacatgataggccaggtgtggtggctcttgcctgtaatcccagcactttgggaggtcgaggcgggtggatcacgaggtcaggagttggagaccagcctggccaacacagtgaaaccccatctctcctaaaaattagctgggcatgatggtgcatgcccatagtcccagctactcgggaggctgaggctgcagtgagccaagatcacaccactgcactccagcctgcctgtctcagagaagaaaaaaaaaaagatagttggacatgataactacatgtctacaggctcatcagagagagagcacaggcagaggctagagctcaatgcaaatatcgagactgaaaaaggttttggaaggctctcaaggcaaggatttaccctgactcccatccccctgctgttcaaggctccttactgggagaaagaactttcttttctaagccttaggtgagtgttagggaaggatcctaagaattaaaacaaatcacaggctctctcaactcccaacctcttttgattccccacaagctaagcccttgcctgagttattgcatttaatttggataaaaccatgcaatatagatattaccttttttaaaaaaacaaaaaacagatgaagacaccaagagtcatctagattaaataaattgcccaagttcacagaactgataaatgtctggacttgattcaaagtttgtctgactccatatccaatattcttttcactcatgtttgggccatctttgcttaaacagatcaactagcacagcctagagttggtaaacccatactacaactttaatttaggaaggaaatgatactgtctgctcgtatatatttgccattatcagaacatatccagaagacatgtagaggtgagctttatcagccaacttggtgtacgacagggtgatttgcacttctttccagggtctccctggctcaaggagccacttaaaaagctcccttacttaataatgcccttgtgctctgggtctattaatttacttcccacaagctgatcaattttctgttccaagacattaatttctttaccttggcacattaaaggatcaaagctcacaacatataaatagttctttttccttctgccccaaaggtgtgtagtgaggattaatgagatgatgcttataattgcattttgagctccttggtcgaaaggcactttataaatacaagatattagttttttgctgagatccatctatcacttacaagtggccaaacattctagatggcctttgggtgtgcaacacctccctctctgactctgagttggtctgggacaatgccagaaatgtggctcaagccaagttcagagtttctggagttcccttcctttagtgtcatatactttctctgaaacttaacttagaaagtgttctttgggggaagagacatggcaataacctctaaactgccctagtacttgagggcagcagtaccactacattgattttcttttgcctctgactttaatacatagcatttattctttgactgttcattagacccacagtctgattttttagtgtcaacaaagcaataaagaaaatttgttcctcctttatttcagggctcaagacaaaattcaaaaatgcctttggcattcattttgcacagacgaatgttgttaggatattcctattagcatgtccacgtgcttgacaacatttcaggtggtattaatagtctacctgcaagaaagtgctttctgccagcctggtgcaaattggcagaacctttaagccactctttctcagcttagcagcagtatatcatcattacctgtggctggaccaagaaatcacatttgtcaatgcctgaattgctcttttactttcagtggttttagaaatccactttgttttggaaatgggcttagctgagtatgttagaagatacagaaacatataaagtgatagataagggatttaagggaatattaaggatgttacattttctatggtcagttgatctttggaagatgacttttgtgggaccaaatagaatatggtcatcttttgaatgaaggactggtaagtgggaccaaatagaatatggtcatcttttgaatgaaggactgataaggtagtgagacaagggaagcataccgtggaactaatgagcttccttctgatcactagaaaagagtcgagtcatattaataatgatagtttaaatatgctgtactccctattattctatactaagtcctatggtaaattgagaaatggggaaactgaggccaagtgacttgcccacgatcacacagctaataagtgataaagttagaactcaggaccagatttgtctccagagcccatggtcttaactcctatgctgtattgattatggctttaagagtattagtataccttctaattaaataggacccatgtttggaccaataaagtgtaagcgcagtgttgtaaaagttattttccatgttatacaagagttctatttttcagttttttcacttgaaataattgtattccttggagactgttaataaatttcgagtctcaccttaaagaggaattgatgtatattgaggcctactcaagggtcagtttgctttccgtttctttcccttttacttttatcctaagtggattcacccaaagtggaaaatgtgaggttggagtgtaaaggttggaactatgaaccagttgggcttcaatactttcacctcaaagtattctgttcttcacaatattataattccacagtgcatgtgcttgttgcacacgtctccaggagttgaaatacttgatattagagccagtggtccaaatgaaaatgaccagaagaggccaaatgtataatgttctcaatcccttatcaaaaatagatgggaataaacacacatatatttaagtacaataaaatgtgactaatatgtttttttctaaaacccagtcccatataggtgtcggatccacagaagtaatttaagaatggtttatttgaagatctctttgtataatttatagatttctcagtgtgattaagaaatgaagttattacatttttttctctaattagtaatgcacgtatgcctccttttaatgatattatgatgtttactactcatagggccattctttcttgagtatagccatcactttctgttgaagaattgatttcactctttgtttaaatgtacatacttgttgctatatgaaatatatgactgaatatcattaaagatttagcaagaatgtaggtgaatttggtgaggtttgttcagcttttagagtagccctgtataagaatacttatatttagaaggttgtttgcgcttcagtcaaactagcaaatgaggcatggggcaaataactcattctcatgcacatgtttctaaaacagttcttactaatgtttgagataaattaaaataaacaccaacaagaacatgaaaagagactaagaacaatgttaatgcggcaacttaaacaaatttggttttccaaatgaccttccatctttcacaacttttaacagcatgcaagattgctatccttagtgccagatactatcaatctggtgtggaaaacttaaaacttttttctaaatgtctttaaagctgaggtggagaagaatgactctctgtcactttcagaagggtctaaggttgaatcatgaccatgctgtccttccccatgtcacttactgtttatctaacatagttatctctttttctagcctgtatcatgcccccagattattttctatggtgctttacgtttgaaagagagtagatgatgagggtggggatgcttaggagggacaagggccctgtgtatttggaggaagtaaattaatacagcttcttaattaatttggtgtatattaaattctagaaatttggaattttagttacttctgattttgccctgcattttgctaagaatatttagctttatacttgctatcgactacaccaatctattccgtagtgagtagaatgaaggtcattaatatatttaatgtgtagccaacaatggcagatacagaaaacccaaagtaatagaatacattcaaggcagatctggcgcaagccaattaccttttctcagtatagtattctgttgtgtctaaaaccctagaggatgaatgacatcctttatgatatctgtcacctgtagggtaggattatgagttatagatgtatattcgtttcaaaaaggtacacgttctttttctatgaaaacgtctaaaaagtttactcaactttattttgaatgaatagaatgttgtaccaagatctaccaaggtagaccattataatgatctctaatcgatagctatattctttcgccatgggctattgaaacaccaagaaattaacttgcctgtctctttttcctctttgcctgccctctccatttttttctatgagaaatgattccttgaggaaaattttaaattatccactgcagttcgaaactgttaattgttcctattgcattttatttttcaatacattaatatgttataccctgtaccaaccagatacagtcccaaaacataggctagaagcagattcatagttgcctcttttatgagttcttattttaaaaattcctggtagtaaagatatgagtcagcttgttagaataatttgtctgtatgagaagtgaatggggaaccttgtgaacatcctccaatattgctacccgtttcctatcctatacccccaccctcacaacacagaaggtaggtaccagtttattcccaggtggaatctcctcagccaataatgactcctatatggagatggccctgcaattgaaatgctttagcatgcccctattcatttggtctgatgctatatgcaattctaatattctttatggcttttagaattctttgtaaattgtttccaagccacctggtttgagatttttctttcatttttaatattggtagtttggaatggagttccccaagttgcaatataggcctatgaatcaaaagtaatgaattacaattcactaatttctgccagatcaatgtgaggttggttgatgagatagaacagttcccaaggcatggcttcatcattttgttatttgaagcatattcattaagggtgtatctccacagcaccactctccaagtctgtcctaattatggaaaccattcagcagtgttaataacagttacgaaggaagagggggggcatactggcagttaaaaccactatgtttgagccttgaaactaattagatatttcatgcttggaagaagtattcctaacaggctttatgaatggatgcttgttcagaaaggtcctcttacagtaaggtaagagaaagagaaagcaggagggagagaggaaaggagggaagtggagggaggctaaatatacaaaatcagtgtctattataaaatatcggtgctcaaaagtctacaaatgttgtaccactatattataattacctctatttcctttgacatttgagtttccttatttttaaaaatgtggaacaaatctggaaagatagtgatataaaagcttatctgtactgatctacctctttgacaaagataatgagatgcaaggacatcctttatgtaataagaagtctcccttggccatcaaggcttaaattgtcctctcctcctttcccctgtcggaacataaagctgttgcaaacacttgagaggagaagaaaagaaggacatggccctatgtttctgatgggaatacggtagattaatagtgcagcttgcgtgactgtggagcgagggtcccgtctcacatgtgaaactgatctggcaggtgaattagtcatgggtcaaggagatccttgtgtctcaactggcccaattaaggtgtggttgagatgagacagagagagagtgaaggtaaatccatttccgtaaacggccagacctcttaaggattcccattccatgccacttttccaaaacatgatggagtactgcatggctaagactaacctgacctttaaacctatcgaccaagggcagagtgacttcaactccacctctactaaagataaattgatatctatctctaaaaacttcataaaacaaaccaaaaaacctaggatgttttttaatgacttattgacttttcagattgttctttaagctgttttttaaactttaaaggcaacactgataatgaacgcttccaaatggtaaaacagaaaatccccttcaaatataatcggcctgtagaggagtggctgcaggaaaaaggtaaccgtcattaaaactttcattttaaaatcatttgatcctaaaccctcatttttaaagcctgcaaataaatgttccttaaatgataatcgcctgctgcataaatgactgttttaattttcattataatttgtgtcagcttccacctgccatatgttgataaatcatgctataatacattgccattaaaatacagttaaagggactaacttctagcctgctatcagcatgacaaacacaaacaagaaattccaggaacttctaaaacagaaatgtattatggcaatttaaccactgcatgacattatttattaatttgttttaaattaccttttacaccaaagctttctaaagaaattccaaaagggctttttaaacttacacctggaggctgttttggcttgtagcatgcttaacaaaacaaaaaacaaacaaaaaaacaaacaaacaaaaaaccatagattgactcttgtaacttaaactacttaaatattgtaaggggagcatttttttttaacatttgttcttaaagaaaaaaatgaaaaagatgaattttgcctttaaaacctacagaggcaaaattattttctaagagattaaggttgtgtcctagttgctgactgaaactaaaaacaaaaacaaacttattttacacttcggttgtgtgcatacacttgtgtatttgatgttttatgcaacaaaagtgtaagaagttaacataatgagttggaaaagaaaaggttcatgaaaggcaaaacagcagtctctgatttgctggagacaacaaccactgttaataaaagagggcagcggttataactgatgttagaattttcctgtatagcttctagctgttagaaaataaaccattgtttttcaatgaaaaacagtctctaagaagatacgtattctttgttgttgttgttgttgagccagtgtaagctactcttgtctcaacacctaaagggagctcttaacatttgtagagatttcattgagttatatagaagaagtaaccaggtatattacttagtatacaacttaaagagcaaaggactactacagttttaagttggaggaagacattcagacctttaaacgtggaaaatcctcacggagtgttaactgtttgccctgtttttaatgtatgtggtctaattaaaaataagaataactctaaaaagcaaataattttgtttagtaatcatcagctcataaagtccctttaacattaaagacaatgattgcctcactttaaacaggaaaagcaaactagatgcatgtctgagtctcatgtgcctgagaaacctttttgtttctttcaattttatgttaataatttttattttactccattgccttttaagtctaagtttaatagcatgccaggcattttcatttgtataaaccattataaagttattagtaggcttttagtttttcttacaatagaattgttacccgttggctttcacataaaaggtgctttcaaatatacaagttgaggggttgggatggggggaggggtggctgaggtgggactggggaagatatcctagtttcttaaatatatgtatgattatatatgcatataaatctgaaaagaattatttgcaaaccgtgagtttctcttctacattttgttctctgaaaaaaaatttttgttgtaatttgggtgagtaacatctatgcattctattgtcttacctcttcctctgcctagctaaccttcccttcaaaaggaataaaatataccaaagacttgtaaagacaatgaatataaaggataaagatagatggatgattagacagatgcatttggaagtatttggaatgcctctttggagttatttctgtcactggggtggagagctgggtcatagcattcccaagtctcttttctggctctgtctactattgactaactttctgaccttagacaatccacttaacctctctatatctcagatttcccatctgaggacgggcaaaataatactgcctattccccaagggtgttctgaggtttaattaattagtctttgtgcaacactgactggagacatgcaaagatttaatttaagcagtatgtgaacttgatgtccaaatgaggtaataattaatgacttccaagaggatgggtatctaaaacaaaaagtaacctgctacaattcctctaccagtgtttgttataaccaaattttgcattaagaaagataaaatagttctcagattaggatatatatgcataaatatgcacatatatatatatgtttttatgtacatataatggtcagttattataaaaatctgatcataagccatgagtgaaaataatgagaataatgagatctggcattgatttggggaaatcttgggcaaatgataaaaagaaactggtcagttcttcacattcttcatagggaatgaatagtgatggttttttctgttattcactaacccctgtttatctgagagataaattaatcagagtaagggatggcaggacacgaagagtgctctactgttcctttactgattgctagctttgccattaaccacctaatccaaggtacagggagctaggagagggttttactacagcagaagagcagatctagccagaaacagaccatgaaacaaacaagcaaacagaaaagcaaacactccctatggcaagatgaaaaactgaaacatagacaaccccctttactgtctcactccatcagtgtcttattctcaagaattgattagtcagatctctctgggaaagtagctgtagtcaggagtagaggggtagtttaaatcttgtagcccaggaaacctgccttgcctttcctgatgcttgggtcagtcttgaacaggcaaagagcactttgtggagtgaatgatggcaactggaatgaaggagactcatcatctctagccagtgtaattcagctttgcattttcagttttctctgatcctctttttatttgtaagcactggcataataacaccactggagagataagatgagaactattatagaggttatcattgtgaagtattttcaaggatattagaatgtaagattttctacctgtaatcaagtataactgttaacttatcaccagtgctgaactatacacaaaataaagagatggataaatattatgattcgccagcagttgtgtgcatggaaagtatctcttggcattaggctgtctaatgtaagatactgaattttttcctagaaatctcctgctaggcagctgcttctaatttctaattcattatgttaagctgcttcaaatgcctctgtggggttgagggagaatttattttccccttccatcatttcatgtcttttgtagtaagctcagggcttccagaaaaaaaaaaaaaaaaaactgtcatcaacaataaacagtaaagaggtatgaactccagcatattacttagtattattatgcattgaactttctgctgtgtcttgtgtgaagaggacagaggacaaaatacagacagtgatgcatatgcacaacacactaaatgaattgctgagaaaatgatgaaaatctatgagatctgttttgattgcatccttgggatctgggtaattctgtagtcattaaggccagcagatcccatattcaggttctggagatttttataaagtatagatcattttcactataacaaagttctctggccaattcaccatactgcagtgttgaaagcttccaaagggctattatttgtaaatcattcttgattaatgggcactatgagttgcctagtgtgcagaattaactcttgtctaaggagtatcctctgatcggatgagcattctcttctctgccacttccatttctttcattgttatacattgagaaggtatttcacattatacaccaggaattcaaggacagatcaacattgtgtagccttgaagaccatgtaatagtggtagatttttaaagcccaaacgtgacaatatccctctattcatattggaaattataaagcaaaaagctttataattttgttaaaaaccctctttttattaagtagtcataaataacaaaattgtttctagttatttctagctaaggtaattcaggtgattagattaagaatgagtggagcgttgtttgatcactaagtagagaaaacttcagaaggcgtatatttaattccattaataagtctttcttttttcctttcttcatatggaaaagcaaaatgaagtaatctggagacataacagtaaagaaggccttagcatattgctgttctgataaattgcaataaattttaaaaagctcttactttgagtttgcttgggaaaaaaatctcatacttgagagttttataagtagaaagagttgggaggaattttagttgggtttcattcttctaaactctatactggtatgttttttcattttgatacttttcagagcagtataaatggtgtcaaagtgggaactcgaaataaagtgaactattgatattcttcaactcattaacacacctctatgtcattttaaggagttttatatgttgctttcttcattaatatccatccattttaaaaaatttattaaatctgaaggacaacttccccaggactggagcattaccaatatgcttatatttcatactgagggaataatttagttgtgggaccataatccatcctcctaaaaacaaattaatagagataggaatttatctctcatgattttgttaaccagaaaatagaatattatgcccaatgaagatttataggaaatgatacgtttggtgactagaaatgatacgtttggtgactagtagttcatttttacaagtatgcaatgaatccaagtctcttaactgaaatttaatttcagctaatttaattatcagacctggtttttaaatttagttttctgagtcacctcactgagtttttttggccatatttaattcttttcattctcattattttacttcgtagctttaaacattaatgcagtaggtatccgtaatttattctggtcatcacctgatttgagtgtttctttctgtcatcctcaattatatacccaagaagaccataatacttcttatcattgaaccaagatttcttcttcctcactatgaaggaatagagacttgattgttcaagttatcaaagattttcagctagacagtggaagagataaccataatgaaatgttacttgctaacgtcagtactgaggttttgttgtctattttttcctccccttcaattgctcaaggaagcctgttatgatgcctggtccattcagaccaggtaaggcaaacaaggaaaacgtatgagaataataatgtttcctccacccaacccactaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcaggtaggcctttttccaagtattaattgcgtctgtatttttatctttgcaacattgttatcatggtcattgctttatgtagctaaagagtttgaattactatgtaagaaggatgctggcagatactcatagtaatgagacccaggagaagagaaaggtgaagtcattgctaaagaagtcataaaagtctgtggcactcctgggttgttattcttattgtatttatcactgaaatggtaaagctgttattcaaaacgagcaatggactacactttcagtatgaaatactctctcctttaattttattaccttttcaaataacagaaagggcaagggagggaaggaaaatctgttatcatatgaaaagctatatcctagttcaatttcattcacattctccagatggctttgctataacatgaatctttcattattgaggtcaatgggtaccattaaatcaagggcagttaaagttagaagtgcaactactccttgtaaaatgcagtctttatgtttgttatcaaatcctgattaatcatgtgtcaggtttgtgcccattttgttttctttatatttgatcaagatactaattacagtagaaaatttgaaggtttgagtttggctataccggaagtccttgtttttgtggcagtttttttccacttgaaagtaattatatccaaactaagcttaatactttgctgactcccttggcatttcataaatctagttagtagggggtaggaggttaactgaattattagccttaaatgctctggcataccatgagacattccaattgctgctgcgacaacaattacttacccctatcctagttagtgtttatagaaaaatcagtagattagcacttgtcctgtttgcttctttgttttaagacattatccaggagctcagttgtgtctttaacatcacctttacactgactccaatggacgtggttaacttaaagtcaataatcaattataccacctatgtgttcccatttttcagaattaaatgtatgtgagctaggtaatggtaagtgtattatctgttgccttcctttttccttttccttgagcagaagtatccagacagctctttgcatggctccacagtaacaatttggagttatatatgctgacagtgtcataagggcaattttatcgttttcaaaaggcttctaaaaacctggttagcatagtactgttaccgtcacacatgctattacctgcatacctacacacatgctcacgagaaaaaaaatagctcttctctactgatattaaaccaataactcctgacaccttgctctactcactgaaaagaagataaaaggcaatatatatttctattatgactctctctagctcaagagcagatctgtttattgttggtgaaaggatagttctgtctgcacaggtcttggcagacttgttttgtttctgtcagaatgtattctgctaactctgtgggaagcagagaagcaaatggctttttcttcataggaatggctggtcctgtagttctttttaaggccaaattttcactgaccttgagatgatttaatgttacacggggattcgggaaccaagctgtagtaattattggttttttggctttccctcctgtagcacatacataaatgggaataaactgggtgagttcctgaactctttccgcaaattaagaaagtcagaactttggaagaaaagtagggtacaagatacaaaatcttgctagtgattataactctaaacgttatagaacctatggccattttagaggagatgaacaactgggaatgccttctccaatagcctctctctggcatgtgtttctttaagtccagtaattatcgaactacatctacatgcttttccttttacttccaccaagtctacaaaaatgagttataaacctgttgagactctttggttttaagggtaagtacatcctcttggaggaaagccaatagcctacaagaattgattagactgcgatgagggattttaaaagccctggattttttggaagactaactagaggaaataactttctgccaagggttttggaaatcttttttgttcttgaccactagtcatcagaactctgccctgtgctccattaaaaacttaaaagcctcatcttcaagcctagtctggtcttaaacacattctgttgatcacatcaaacctatgttaggactggggacccaacaactattggattctattcaaagtttaggacaattcccagactctagagactgcaggtaaggaaggtcagtcccagaagcattaatatgcctatgtgaccccactacttttcttagatgaggaggattcataaagttctgatctctgggagatacttcagaagtgagtggggaaaaaaaggtagggaagactggatttcatattcaccgggcccattattcacttttttatctatatgtgaaatcatacatagaacattttccaaatgataccactgttctgtcctcttttgctaaatttaataacattgtcaaagcaaagttttcctaaaatgagactcctctaggagaaagaaaataagcatgtcagtccaccagtataaaaacctgtctgttcaaaaatcctctagttctttcttaaagcataagcaaagaaaacatcctttcaagagttctttcctggtcaacctgaggtagtgttgatttcagatcaaaggaaaactgtaaggtgctttcagtgctgcttttaaccgtgtgtgaatgtgaacaagtagtttttgagttggtatgtctgtctagtgttatagcctcttagaagtaattggtgctttgatctttctgattccattttgttacaggtaagagtgtagaactatctgtgaataacctggctgatgttaatttactcatagcaatcatgcccaagcatcaggtcttgatcctacattgagaaggatagctctaggtactctattgaattttaaaaaatttaagatgtgcattgagaaagcaggtgtgtgagtgataattctcaagtaaaggcctggcacttcataggtgctcagtaaatatttactgaatacatctgaaaacaagacaggctttattacctactttagagtcatttcacaatggaaggtagcatagcttgaggaaagtgtttcctccacagtgatcagggtgctttggccaaatttgttgtatttttcagtagtaaggctatagcatagtgattcagtgcatgcacttggagctagattagctgggtttaaaactttgttcatcctcatattagcttacatgaccccagacaagtcatgtaagttctagttaactatttatatgaaacaaattttcccataacttggtggtttaaaacaattatgtcattagatttcaaaattctgtgagacagaaatttgggcacagttcagcaaggcaattcttctgtgccatctagagagatgattgtgttcactcagtggctgactttgcctggagggtctggctttatttacataccttgtgctttgctgggttaactgggaagatgggactcagcagggcccttttccctctctatgtattctctgggattctccttgtggtttctccagcaaagcagatgggctgtgtttatagaggctcagggcttccagagagagtacttccaggggcaggaagtagagggtgccagttttatatagcctgggctgggtaactggcagtgtcacttgtacaatatgctattagtctaaacagtcacagagctttcccagtttcagaggaggagacataaatatcacttctcaataggaggaggagtagcaataatttgcaaccaacctaagtctaccacattactaaggctaccatattataaagtagggagggtggtgtacttctagtggctatgttatatgattgtcataaggataactgagttgatataagtaaaatgcttaaaataagtgtaccattcaaagtaagactgcatgcgttttaaccattattattatattctgtttcccacaattggtgtattaaatcaagatcctctcaggcaaatatctgcctcagaaaatggggctgtgactaccgacagtagtggctatagtttagagtaagggctaggaagtttgggggaaatagagatttgaaggtggatccaagcagaatttaggggctgaaattagtcctggcaaatcaaaatttctatgatctcaggaacagacttctctgacacctcactacccatctttaaagttctgttttattttaaaccaacttagagttctatgagtctttgaaaatatgttctgtctatccacatgtcttttagggttgcaaagaagacaaatccagattccttaccatcgtggaatttacaatctaaatagggcaagagggtttgacatgagctatccatatgaagtagtgactcatgaatggctctttgtgctggggatggcaagtgttgcatggtgtggcttgactggatctcatgcactcattctactaggccttgttgtaaaaagagcacaattggacaggtggtgagaggaacatattcctggttggtcaaatgtcagccagaagctaagttgttaaaagcagagattataatctctgggagagatagccaagtccaagtagaacagagaatgcataagagggagtttgtgagtagcaaggggtccagaatcaaaatcttggcctgaaactttgccaagtgggagagggcccagaggggtaaactgaattgggttccctgtgtaccttactaccaggaatgccccaataattgcacaaacacttcctctacaactgactccaatattggtgggtaattattatggtgctgataggtcagcttctaaaatagaaaagttcaactcagtctacactcaaattcgttggtcttccttcaggatagaaggaaaaagtgagaaacaagtcttttaccttatgtctccatcctgagttatcagcagaaaaaaaaaaaagctcagtgtgttctgtgcaaatcaccatttggaatcatttataaactatttgcaggatactgatcatgacatactttttctgtgttgggcattggtaaagtcaccttgacattggcaactgctgcctgaaaattgccagaaaatcacaatgctcagcatggattggaactatccttataactagtcaaaatgaaagacttaagaggtttgtgagatttcattctcaagcttcacaaacttggtggttgaatgtgaaccacttttgcaaattccagaaggaagccacaatttctcatgttttgtaaaaattcttataggcaaagtactcttagcttttcagtgtcagactggagacagtaagaagcatgcttcagccttgatactgatgattacaaaacaaagaaaaaactttggattaaaatgttcatcctgcgcaacgtctgttctgggtagagtctcagtgtgttgaagagcgtgggcttttgcgtcagagtttctgagttggactccaggtttttccagttgcttagctgtatgtataagtctgttctcacactgctataaaaaactacccgagactaagtaatttataaagaaaagaggtttaattgactcacagttccgtatgcctggagaggcctcaggaaacttacaatcatgatggccggagagagaaaggagagtggggaaactgcccccctgatcccccctcccaccaggtccctccctctacatgtgcggattataatttgagatgagatttgcctagggacacagagccaaaccatattgctgtatatctctgggcaggtgattagcctctctaagcctcagttttactgtctgtaaaagtggccttacagtacctttcccgtaggctccttgtaaatagtaaagtgcaatcatgtgtgaaaagcaccccataacttttcagtaaaaattttcacataaggaaaccacttcaacctaagggactctcccagaactcacagatctccctagagcttagccttcctgtggggctggataagcccaggaacaattttgtttatactcatacaaactcacaagggcctggattgtgagttcttctaagggccccagattgaatcagagccccaagctcatcaatcaggagagattgctacggcaggctctttcatattctggagtgggaattggctttgctgaacagttacaacacatagactattctattaggttgaagtgtatgaaaccactatttttgtagatcaaaatggttaaatattagcaatatcacatggttctacgatgacacacagatttacagcatgttgttatcaatggcacttcgaggcccagactagaacctcagatattctccaggtcttcaaataatcaaactgccttgcactgggagacaagatagatccaccttatccccaaatactgtgctatagcaggatgtagatcacactgtatcaaaactggttatatttacccaaagaattatcccctctgggtccttccaccttttccctgctgccaccagcttgagagaaatgagataaggaatctacacagttttcatctccttgcttttaccactagacaacagagcctccgggggaagtttatttttaggatcagggctcaactaatattgattaacagccttacataatgtgaggctccagggtttgttcttttcctgccaagcctcataactggagaaggcgctgaagatttgtcagtctaatcagactttagctgccagccaagaaatatcttctgtcttctccttacccttacgcaggtactttctttttccctcttagagaataatttggggggagagaaattgcactctaatttacttgttgcctggtaagattctctggtgacatttactctctggaactgcacagttctaacaacaacagaaaagggagcttgatgggtttaccttcctcttaaagacttagatgttggcagtacaaataggcaagtgaaaagagtgcagtgtagtttgttttcatccttcctttaatacgtaattttggtggatggaacaggtgctttccaaaactaggtctagtcgatgaaagggtcctgagggcagacgaagtgtgaaagctcccaggagaattcatagagatgcccttccaattaggatgtaatatttacaggatggaatttccaccagaactactaataaagtgctggctcttatttctaggcatctgaacagctgggagggaagtggggtcagttcttggctacccacgggtggaggtccctgagtgtttttaaacctcagggtggtttttctaattacctaacagactctttagccgaatctaaagccaaaatccttgctgcgtggcatatggttctcctccttcctattgctctgaccatattttccaccacgttgctccaatcacacaggtcttcttgatccttcttgaacacagagcaagaagaagggtgaaaccggtgaggcaggattatgcaattgcaagcttagattttcatcttaaaattgatatttgactttttgcttttgcagatttttttcctgcattaatattgattttaaaatatttcagcaaatgaaaacaaagttttagcaaacccccgttaaatcttacaccttaagcgagtgtctcattcaatcttctcagccctgcctgaatgtgccaagcgtgcctgtgccttttcacctgccatttcctctgcctgcagcagcccttccctgctattcacagtactcactccctcacttcacccaggtttccgcttatattgcaccttccagaaaggaccttcttgaccgtctgtaaaatacaacactctatcgccttttcctgttttgttacctctcatagcacttatcactgcctgacattatagctcacatttatttgtttattgtccctatttagtagattgtgagttctaggatggcaagatctttattttaggcactaaaatagcacagtgcctagaacagtagcgagcacagagtaatacgcagtcaatgttggttgaaaggtataaatagtcaaccatccaccagtaccttctcagggagtccacaggccacacaatatttacaggctgaatccaagcccctgtttcccaggacccactccctcatgaggctcaccagtgagggtgggcaccactgggtttgctgctcttggatctttgctctaggaataaggagtcccagagatatctccttgtctctggtatgtaagattatttttgttagcttccagtcttgttgctcagccaaaagcaagggctaattctagcacgtatagttttcaaatcacttttggaaatgtaatatcacccacctttccctttccagtttcttcttcttcctttccaaataacttaatccttaattctcctaaaacccactttcaaatatatgcaaataaaaattacttggtaaggatggaaaattaacttgaggcttttttacttttttttttttttttttttggtctgttgagaaaagggcttgtagggtggtgcctgcataaactggccataaaaatatgggacaataagttgttgaaagccacaagaggcctctgaggaggaaagcctcctaaatgccatcatgttcccaggctcagagcgagatctgctctcttatctgtaaacactgtgttcaaaggagaaagactctgctttgaagcattgaaatgtggccagatatgctggctcctagtgaggcccactccccccagctgctctccgataaattaaagaataaatcagtagttaattttatgctgcttcagcacaaagaaaatttacctaaactgccattgctatagattaggtgtatgacacaccgcccccctttcaccgtttcacccctgaacatctgcttcttagagctaagtgattgtactcaacaaatagtgtggagaccagagcttggcgcctttgcagcctccattttacacttggccccctggcactccactctttatgcactcttaacctgtctattctcattcgtttgtcgccaccggacttcgggtaccctacgggtggtgctgaggctggtccccaacattggtctaatggctgagtatattgtgtgagcaccatttattcatgtctgaaaccctataatttgactagccccatatttacccatttttagtgataatttgaaaaaacattgatgattgagagaaggaacaatagctatgttgctcatcattggacatttagagcctagaatggtgcctgccacaaagcagggctcaaaaatatcagttgaagaaaaataaatgtgttaaacgaatgaaagtaagttaagcaaatgcttatcatcagagtgaagaggcagtgggggccaatataatttatttacaaagtaggcaaagggagttaggaggaagcagcctggtacggaggaaagtgcattgaagcaggcatcaggagacttagctcatgactggagaagttcttaaaaccatgactctaggcagaccttcatttctagctgtagaattttggccagggtcctttgtggagctatgtttttttattatctgaaatatggggatgatttccaacttcaagggtaggttaagataatataagtcaagggcttaaatgggtgcggctcaaagattattattgctgctgtcttaaatgggattataatctggtctcagctgataaaccagtattgcaactatattttcttttttattctgttgctagtttgtggtctctgatatggcaattagcttccttgggcctatgctctttcctcagaaaagaaagttttattttaacattatctagcatagtgtcttgggcacacacacacagggacagttaaatgtaggaaacaatgaattagaagaagtaaaagaaaggagaagaagtaaaagaaaggaaaaattgagaaggagagaaagacagcagcgatgctctgtaattattgctataagaattacgtgcccatttcatggatttgtatggcttaggttgagagagatgaataaaatatctttgatataattaaaatcataatataaataatattttttctatatctcccctctttgctgaaagctgttgggtgagacatcacaatgaccacttctatgtaaaaggtagattatagatggccctctgcatatgtgggattgcatctgcattcaaccaactaactgtgaatcaaaaatatttttaaaaaattgtgtctgtactgaacatgtacagacttttttcttactattattccctaaacaatacagtataacaactatttacctagcacttacattgtactagacattgtaagtaacctagagatgatttaaaatgcacaggaagatgtgtataggttacatgcaaatactatgccattttatattgaggacttgaggattttgccatccatgggaggtcctggaaccaatcaatcccccacagatgctgaggaatgactgtacttgataaatgtctcttgaatcatccaaaaaaaagaaaaagccaatggtttcaatttaaactgaggtaagaattgttttttttttttctgaaaatatatgatgttctatttatatataataggaaaacgacttcaagcagcaatcgtcacttgccaggcatcaaggcggatatttccattatgtctatgacaaggtggtgggaggggtgggatgtggtttcatacctttctggtgcatgtttgaatgattgtaaaaattagaaacacactgaggctgttatgacagccttgccttttgaaaccttctaattaatgccttgggttgtctagagagcttgttctgttagctaaatggtgatttgtaaggttctccttgatttcctcatcattcatggatgaaataattggggaaataaaatgattggggaaataaatgcacaccacgtctgtggtggctagcagtcactgagagaattacttgatgggaatttgattgacttgtgtgtataatgcaacctcttatatctctggccccatcttattatgtgtgtgtgtgtgtgagagagagagagagagacagggagagagggaggatgctcgtgtttgcttgcactatggagaacagtgcttcttaaactttaatgtgtgtatacagatcacctgggtaatcttattaagcacagattttaatgcacgtccggggtggtatctcagatcgtgcacttctaacaagctcccagatgatctcatgctgcagatatgtgtacctcactatagagtatagagcaaggctctaggaaatatttacggttccttgctgagtaatcatggtatctgtttacctatctcttccaaatggtcttcccaaacttagctcagttctcttcaagacaggaaattttgttaacccaaagtattaatgtaagtgaaagggtggataccccaactaaggattagaagagaaaactgtatcccatcagacaatgctgctccgggtttcagatgccccttcttcctgtcccttactttactgcatacccccaaggcagatggaaaaaaacataggtaaaatttaacttgtcataatatttatccccctttctgagaggtgacctccaatggaagcagaaggatgtgaatgattttaatccacggtaacaatggggagccagtcctgaccatcttaagcagtataaatgtataaaatgacagatttttctgctctgcctctccactttctcctcccggatactgagagagacacatattcatgcacccacaactcacactataatgcacaatgaaatttcacccagcctttatctcggggctgctgttctcatgattaatgccctactggctgggaagctattccactgaagacagacaaggagagaggaagatgcatgaaatatatctctgaggccatttctcattattattattatcattattagttccttactaccctatctatctatcctgttagaggatgcttgatctattggcaagggggaggggatgacatttgaaagcaggttttatgagggagaaatgaacaaggacaaagagagaaatagacagtttttatgaaagagaattaacctggatggggtttttgttatgattgttgtcctttatttgggggtttgtttgttttattgttgctgttgttttccatttaaagtcaaaaataatagatgcctccatctgcggcttctgatttttttccctagggatttatttttgcatgtgttcttttgtctttattgagtctctgtctgctagaatcaatatgatataacttatgcaaattatatccctgaccacttatgcaaaaaacagaataatttcgttgctctgtaacactcttaatataattacctccatatcctggttgatttcaagcttttgaaagggctactttaaaaaaaaataataaaaatctatttatgtgttgtataaaccacagtgtctgattctctcctgtttctcattcaaagaaagggtgactgctaaatgatttctggctctgtcatttaagaagactgcacagcagtggtcttagttgggaagttgggaccacaataagagtgctattgtaacacgtgtctactgataaaatggcaaattcattagcctagacaaggagtactatgatctggtttcaaaaatgctgtatacttccacagtccagtttatgagggcatgagatatataactgaggtgcccccatgttacttcaattttagtttgactttgaatttcattaaaaaatatttgagttatttgagtgcctagtatgggctaagtactgtcctgggcacttgaacaacatcagtaaacagacaaaaaccctcttttcttatggagaacattttctattccacaaacattgggtgtctcataagtgcaagactttggagaaataaagaatgaaatagaaatttttctgctttagaggaacacacagtctggtactgttcttaaatattttcagactacaagcggactcacttgcagcccagttttttacaaaaactttagcatgctgattggctagtacagttgcaaaggcagcagccatctatatttacagaggtctattccaagaatagggtctttaatttctattcaaaaaagaccaaatttcaaatgtaaacaatatatgttttgactaaaaaagacagaaaccgtaaagcaagttacaataaagtgattgaaacatatttcggtcctggagactaaatttgcaatgtttatggcaaatatcttcttgtgttggtttgagattatagttttatggaatgtttatattggaagaatctcagagattgagccccacacaaccagatgagcttcagagatgggccattctggtttcaagtactagtttcattgctcaaagctctacgtccaggggcaaattgctcaaccactttataaaaaatgtaaacaacaggtaatttcacattttaatttatttttatctaaacaatatattcacatagtttatttttagtgtatatatgtatatatatttatttcttatttatttcttatttatatatttatttatagagatgaggtcttactttatttcccaggttggtctcaaactcctgggctcaagtgatcctcctgcgttggagtgctgggattagaggtgtgagccactgtggttggcctaagtaatacagccacacaatttaaaaccttgaactgtgcctagatatcccctttggggaaaaggcatcaccttagttgctagagtgctggctgatggctgttggctaaatccttcacgaagaactgcctttgactattgaagccaccttgcccaaccaaggtcaagccccttcctgaagggtggcccatatccaattaatgatggtgaagggtggcccatatccaattaatgatggatgatggagctggggggatctatcaagactcagcccattgtctcaagactggataactgggaagggccttttagctagagagtttcctaaggccagctgaggtctctattgcatgaatgttcacctcccccttctgcccagactctgatgtcactctccccaaacttcccaaacacgataccgggcctcagactttgttttctgaaaacgcagctgaagatagatagatagcatcgtgagacttaaaataagaaaacaacaataacaaaagaaaaacagtagtatctttctaaccttgccctaaagtcctgctctatactggtaacccttttatatccttttcagacatttcccttcatagttctagcaatatgcttgcatttctatttcttgactttttcagtttgacatattaactaatgacttctgcttctggaagtaaaagttgagctttctcatgctctccctgccctacaacccacacacacttttttaccttccagtttcccagtaaaattctatcgcatttcgattaaataaatgttcagagtttgttattatgactttgtaatatcgcctattgaaaacaatgtaagatcatacatgaactgacttgttccacaactattcaccagctgcatagaatgtgccagacactgttctagagactgaggatacagcagtgaaaaacaacagactatatttctacctctgacaaaacattatactgttatgacaatttctgttttcctgtaactctttgtttgttaatgaataccctcgttatctcgttagcttatttttctagccacccatcagtgccacagccaacagctacaaaagacctcacaagataaaccgacaggactccattatttctttttctgtcttggaggtctcccttctggagtcgtctgacctcctgctttagtctgggctgggcgctcgctgagcctgcctcacagctatcatcctgcgtcttccttgctcgtcatgctggaaaatccctgggccctgctcctgtattaaatcctagtttcagctctatttatttcctcattttcaaggtgcacattgtcctgtagcctcctgagaaaggatagctaaaaagtaaaatcattgagacattgctcatctgaagaatgttttattccattctcacccttgacgataatttgcctgggaaggacttgtatcttggaaattatcttcactaataaatttaaaagcatccgtccaatgtttttgggcatccaatgttgcagctgttgacatcacagtttggtgtctaattccttgactgcactgatttttacttttttttttttttttttttttttttaccctctctctgaaatatccttatcagtggacctcaaagtagcacttacaactcaggtctcttgaaccacatgctgctgccccctatagttcttgcttttgtaaagttgtggttatttgccgattagctgccctgtgttggcatcctgactttggtatgatttgatgagctaagctattactaaactataacacacacacatacacacaaaaaatgaatagctataattaattagcataaagttttgagggtaaccaactttagtagagatctgagatatatataatgtatatatatatatatatatttgaacattttgccttgggttagagagggaattggtggtacagtaattcttactggaattgtgtagtgatagctagtttatatatacatatatatatacatacatatacatatacatatgtatgtatatataaactagctatcactacacaattccactaagaattactgtaccaccaattccctctctaacccaaggcaaaatgttcaactcttttttgtattcccttaagagcccttattttttttttcagtttcaccaatcatgttcatttcttagccacctcagaaagaatgagaattaaataatatgtataaaccctttgaattttttacatccagaaatgagcataagctcattcctctgcttcacaccagatgcttatatttttgagaggagcaaggattagaattgtcactctggaatttttatgctacaaaatgtcaatcaatatgtttgcatgtcactgggttccatcctacagtgtttggtgataaagtcttttcatttggctcccagctttatcaccataatatatttatttactttaccttacatgtgctagttggtagaagctgtagaaaaagaattactcccacatatttctttcccctaaagagaaacaatatattgtaagaacacagatggggctccacacaaaaagaatgccgaattaatgttggatggatgtacatatacaagaacttgctatcagtacacaattccaataggaattatatatacacacactgaaaatagaatttgattaaataattacactaggtacaagctacattttacttccattgaaggagagctaagtggaaactagtgtgagacaatcatgaatagaaaagtgcagaaggaatttgatgaggatgttcccagggctatttctagccagaaaacgaagctggaggctttgaagtaaatcaaaatatttgaagaagtaagaggataaatagcaaaactcacttccaacatcatactaaaagcaccatgcaaccatatagaaaacatgcataatttattttgactcaaataactatagggagattcttgttttttttaattaggagatttgaggtaactgtctagactacctatttttatgttgcattcagcaatatgtctgctaataattagagggaaataaattacataaaacaatgccagtcatgtcattgataaaaaggaaattaaagtgtgattgtgtttctctttctctctctccctcattttcagtgagctacatcctcttgttgtcctcctcacctgattaggcatttttgtaagggagtttgcctccgtcctctgttgtaaacattttccttacctcagcatcctttttaaattcaaaagacactttcctttgcaatgcactatgaaaggcgattgtgttagagaatatcagagatggctttgtcatgtctggtgctcttaaatccttttcttttttttcttttcttttcttgagacggtgtctcactccgtcacccaggctggagggcagtggcgtgatcggggctcactgcaacctctgcctcccaggttcacgccattctcctgcctcagcctcctgagtagctgggactacaggtgcccaccaccgcacctggccaattttttgtatttttagtagagatggggtttcaccgtgttagccaggatggtctcgatctcctgacctcgtgatccacccacctcagcctcccaaagagctgggattacaggcgtgagccactgtgcccagcctcttaaatcctgttgtgtcctaaagagtccactaaacgaggttgagggtatgatttgacaattgaacaaggcctcagccagctctcctagactgccccaaaactccctgagcagagagacccaggtggtgatggaagtatttttcctctaaaagactgtggagattctggcaaacctatattttgggtttagctttcaaggaagaggtggcatttgaaaagccaggggcctttgtagccattttattcactacctaatgtgaaggtggtggcagggaatggaaaagggaagattatttagtcgataaacacttaatggccactgcctgctgtgtggacagatctggatagagttaaaaagataataaagcaagtgtaggatgcctgtcttcatggtacttatatcatgggaagaaggcatgaacaaaccaattttacacataattattcaatcacaatcatgacacagtgtgataaaggaggacaggcttctaagacagcagaaaaggacctgaggtagtgttgtcatctggggaagctttcttgtagaagcagtatagaagctgtcctgtgcaggatgagatattagattgcaaaagaggacaagggccagtgttcccgccaaaggaaatagcctatgctgaggccctgctgtagggatcatactgtatcgcgttcctctggctttggactacgcattgatgctaaagtctggaagcataccatattcgaccaagtaaagtgaccagttaaggtccccacttaatgggctaaagataggtcattccaagagtgagcctcccattattatgactcatgacaaaggggtgtgggactggttggaaaagagtttccaaagctggactgcatcacatggtcatgtggaatgggctgcctgctctcccagtctgaaccctacctctgtgctatgccaaaggtgcagatccccttagtgaaaattggagacatgaatcatttaaggcaatgcctcacagacccatgtgcaaggttccatggaatgtgttaatatatcacactcatctcaattttgcacggtacatgaaactatgcttgctgatgagggaccatacacattgaacagatcatataatggttatggatgtaatgtcaataatgtcatggaacctatcatatgttgtaatatcaagaaaccttttagcatgtacatttgtctaggtttctggactttacagccttctggtatttcacttgcttgtgtctttcattgaacactaataaccagaaatcagcaacgtgaaaatttgattcttcttcctatttttctcatgccttactttggtctttctttctgcttggtggaaactgcggagttcagtggaagttttcctgcagtctaattagcccctctgtttaattttgtaataaaaacgctgaaccagaagctggagataatgtgcccaattcaattcacagatgtcaatttctttttaattgtaatccttttcttgagttcttcccactcttacttccctggcacagctgaggcttgggtgattacaaaactttcatgcctacgctggagattatgcctcctgctttaggattaaattcattcgttatcattgttgtaattattagtagtaacaatgggcatttccacccaaacctgatgaatagtagttttcacagtctttgcctccaaacttagcttatttcagttctttgcccagataagttcttcactctttaatggcagggagcattccgttttctgttgcatttaaatgctattttgagatcattcagaagacaaggctctttttcctttttagcaggttctcctgggtgtggagagatggcttctttccccagagtaggagtcaccacttagtgaatgctaatggggtcttttcttcgtgatgcgactgctgctttgaagatgcatttgaactggcaaggggcacctcttagctgcaatctcttccttagaagggtgccagctccaggccctaaaaagcacacatagctttgacttccatgctgactccaaaagaaccttttctctgcctttttgatggagtagtccctaccactaacagaacagcagtgtggcccaaccaacttgaaaatggaactggctcctcagcaacatgctaattctttcaaacttccttgtcagactcaaacctcgatgtgtcttttgttcttaaactgcatttgtagtaagatcttcaggaaaagcaatcagtgagagactgggtcaggcttttatttaattactttgcactttttttccccctctgaaccttctccaaatcaaaagaaagcaatgcagtttaattctgaatatatgaaatgtttgcactttaaattataaatgtctctcaacgataacaccttctgaaaataatgctccgtgggctctttagaagaatatttaggacagttcatctcaggtttaaggtgcccaagctactatagtgccctttcttatcttggttttatgtttttccactatggcttactgatataatttcctaatccttcttatctcaaatgtctcttagaccgttaaacctttgcctataaaatgaaggggtttgactttgaatctaaaggagtggaccatccctcaagcaccctagtctctcagcgcattcattccacaaacatttttttgggagagcagggtgattcctgctatggacccatcacccttgtagactctgaggctgcaatgaaaatacaataaaatcagtaattctagttcttatggaacatacattctgggagtgggggcagagactaccgataaataaattagcaagagaatataatatgcagggacaagtgctatcaagaaaataaacctgcgcaatgtcacacagaatgcctgatgggtgggtaggtagtttaggggaagttactctaaggaagaaacatttaacctgagattggaatgataaaacatgtcaggtctgtgaagtctgggggaagaacatttacagcagagggaacggttagtgtaaaggcctttaggctggaacatgttgagcagtgtttgaaagatgatgaatatggctgtagcagaagaaatctggtgtgaggtaagatctgagaagtggcagggactgaaacagacagggcctgtttggctgtggaaagcagtttaggttttataaaagtgcaatggcaaactattagaacgtactaagtaaaggagtgacatgatgtgacttatgttttttaaagattactctgccatgttgagaaaatattgtaaagcagcaagagaggaggcagagagacctaatacatggctattgctttaattctgatgaagtttgattgtggtttgaactagtatagcagccaggcccccactacaggcccacccagcttgatggcctcaccctgcatcttgtcctgtctctgaactgctaaatctcaaaactttaaagccctaatatcttgctgattaaccataatttccaaatcttatgcttaagtccaggcagtttttaatttttttttattttttggcttcagcaaatttttcatttgtctatatctataaagtacttctcatcatcaacccagattcctttttctctctgttgtgttcattctagatcattccaaatggtctctgttccttctgccttcaacctggtcttagaagacttctctgttttttatctctcccccattccacctccaactcttgatcagcacctatttcaaactctcaacttggtctcctttttcactttttacacacttggattttaaatgttaccttcttttagaaaacaatgctgaccagtcatgagtttctttgaattcctccatgcttatccacatcagtccttactttaggggaatcccttcgtccctttgtttgaaatcttatgctaattatctcttcactcgggtctcttcccaaggtttggacatcatttagtgttctcattttccactggtgccattaatatcatcccgtcatcatagacatatatgtgtgtgtgtgtgtgtgtgtgtgtacatatatatgtatgtatgtgtatatgtatgtgtatgtatacacgcgtgtgtatatatatgtatatatacacatatatgtgtattgtgtgtatgtgtatatatatgtgtgtgtatatatatgtgtgtatatatatatatatatacctttcccatttcaaaaacaaaatcaaaacaaaaaaggcaattatctatgaacctgatttctgtcccttctattagcacttactgtccccagatgaggacactctttcacttccccatatgctcaaatatcctgaattttatactctcactgattttactttctaaacaaggaatatatacgtattgtagaaaaaaatcactgtgaagtaaattccacccgtgatccaaccctccagagaaaatcgtgcataaaaggtcccgcagattcccacctgtctttctttccttccttatctaccaatattttttcacatgcatgcaacattctagtcataccttgttatactttcagacatgttctttctacttgagcacatacaacatacaacttgagcatgcttgtttatctataaaatgaagataatatgatcatttctgtaggagttttgagtcaaaaataaatttatgtatttcaaatgcttagaatagtgtctgttgcatagtgacctttcaataaaaattattattattattgctcttttgtccactttatctacctggaaaagtaataatccctcaagactaagttgaaatataacatccctggggagtgtattagtctgttctcacactgctaataaagacatacctgagactgggtaatttataaaggaaagaggtttaatagactcagagttccacatggctagggaggcctcacaatcatggtggaaggcaaaggggaagaaagacacgttttacatgtcagcaggcaagagtgtgtgtgcaggcgagctcccatttataaaaccatcagatctcttgagacttattcactactgtaagaacaatatgggggaaactgtccccatgattcagttatctcctccttaataatccccttgatgcatggggattattacaattccaggtgagatttgggcggggacacaaccaaaccatatcagggagttatccttctcctctgccatcctgtttcactctgccaggctccttttctcagtgcctccacaagtggtttacttgttgtgatgaacactatgcacagcagagagtttaaggaccttagtcatgtttcctaccaatcagcggttggcttcctattaaacctttctcgatgttctggacctctagagagccattctgtgctgctatgcaatctataatgactcttcaactaggtttctattcatttccaagtcttccctaccactgagatacttcaaggagatatgagtggatcatgaataaatatcctaaaactaaagacagttaagtcaattgcactctcaatattatcagactattttaactaatatgctatagacaaataattcttcagaatggtgtttgctttgtgtgtgtcataagagattcttgtctttagagaattagggaataatattaaaatgaataaatagtaaaggtgggaatatttttaatattattaaaataaataaatgattaaagtagggagcatgtttgaaggtccattttaaaaaatatatgtagacagaggaaacctaagagttaaaatactgagtgagttttgctctgcatcagtggaggctataaaatgcagtatttatctgtatatgagttctataccaatgtgatctatctctctaattagatagtcaactatttttaaagagctgcaaataagccttacaagaatgtcataaatgcattccatttagaaacatcttgcagataaattgtatttttattcttcctgcagcctcctgtagccttaaaagaataacaaaaaataaattcttactacctaattccagacacagatcattactaccagtagtatgttaatcatgcttgccattccttctccttcgatatcattatgctttaggatagaaaaggtgggtggtatgtgagcctccttggataaacaaaacgttggagtgcacaggcttctcaagaggtacaatgttattttcatgcaaaaaaatcccaagtattacaaaggggcttgaaaatgttgaaaacacattgtgaataagtagaattactaacaagagcactgtatcttttgcttcgataggctctttcaagatgtagacaaattggaggtaggccagacagaatctacgggaatgattaggggaattgaaggaatgacttcggaaaaaagattaaaagagctaaatacgtataggttggctaagtgccaactcagagaaaatgacattatgggctatagatatttgaaagtggctggctataagcaaagcaagggattacttaggtaattggattaaatcaagggggtaaacattttaaactcaatatctggatttattttgttgactataagaattattagattttagaactatcccataacctactgcttggattaaagcaagaggtagggtgtggtagcatgaagtctctaatagtttacccagttctgagcatcttgttgccaggaagcagatcttactcacttttaatccctaggatttagcacattaaaagaactccatagagagctaagtcatgtttagttcagcgagaagaaaatggtctgtggagtcagacattacagattttatatctctgctgttttattgttctataacagtcagcaagttacttaacctaagccttatccataaggtgcgtattaatatcaactttataggattgatgtgaagtttacatgagttgtcttgatctcttcttttacctatttaacagcggttaaatacacccctcctctccatcatcactgccattgtgttccttctgactttagtaatgtcttcaatggtttcctggattccaattttgcctatcttcaagtttccacaatatagtcaggaataactttttgcagcgcatgtatgagtaagcaagccctagcttaaaaactccaatggatcccattgcctgcaggataaaatcgaatatccttaggatgacaaacttcatgccatcatgcctgtctttctaattccaactcatattaccctacccttctcacataatgctctaactacattcacttgcttgagtttttcttttgtaccttgtacaaatgtataaacatgctggttcctctgctgagaacccactttccactccaatttgccatttctttgccactctttgtcttctgccttgcttcacactctttctaaaatgccaatctcagattttacctcttttgagattccaggtgcctctcccatgtgtttccacagtaaatggagcttatcattatcctgctattaattctactgtgttctaagtgtcttttcactctgcctctcctaatagatgttaggattcatttgggcagatacttagattagtgcctaccatttagtaggcattcaacatatttttagattcaaagaatgataaatggtagatggatagatggatggatgggtaggtaaaaagatatatggagtgtaacaaagtacctacaacataagaaattatcaattaatttcagttttctttccttggagttttgagattaagaaatgcacttcgttgtcccgaataagcatagtcttgagtgggctttagtcagagttatttgtgtgcatttatgtcgatactacccactccattctatcatattgggaaaataatgcaatctcgaaggaataggagtctaggaaacctaggatataagtgagcacataccggagaaaaatatgccaacatagtagcttggaggaaatacttggaaatatcttgcctttatagctagatatagaacttcattttttacaactagaagctttgtgacttctgagaccatgactgaagaaaaatggaaatgaagacaaaggggactgaaatgggagtggaagtaggaaaaggggatccatagacacaaaacaaacttttccttttacacactccatttccctctctggtgcttgcccatggcccagctatttaaccttaagacacatggccagcccccttgtctagagtttgccctaattgttgggcgcattgtagcgtcttagatgatcaattgctcatgccaaaagcagagtgttaagattcatgaaattcgagtctgtgctattaataacctgagcagggttttcatgcctccttcccctttgttttctcctttgccaagtctccattctcactcttttgtggatgtgtgtgttatggagacgaatgaaatttcagacacagcaatgaattgccacctaaaaggatacaccccagggtcttctgtgttcctttgcagctgtgtgataaattgccatctccaaaattaattgttaccttttcaggaagtgtttactcattttcatctcctcactggcatcagtgaacctctgagctagaaaaaccaactttcctttcccttctcaagcccttgatatgcagctagaacggcaatcagtggagctgacaagggcgagcagtggtacctccgtgttgttctctagcccatgaattcaatgaacatccaggctatgcctttcatctcaactgccttttaatagactaacccatttctctttacttttggctccacattaaaatgtctataaaattttactccaagctaggtcttccaggtttacggaagaaggaacatacattcagcaaaacagttttctctttttgttagatttctgctgttctcaagagctgaaaaaaagtgtgatacttcacatgtactctttaaaaaacttactaagcctgctcagcttttacacagggtacgccggcacacaagtgtgacctggtccttactccatcctcaaagataagttgtccccacagtctgccaaaaagatgtccctgatgcaatgagaatgagctggagtcctgactgtgctacatttttagtggtatcctaactctctattccacagacatcagaaaatgtcacaacatactctttgtaactagtccctttattatgtccatgaatgtaatatatacaatgattttcaaagagggtgatttttcacccctcttctctccctgccccacatacaaaggagactttgcctatgtctggaaacatttttggttgtcacaattgaaaaggaatgtatggaggtgttgctgttatccagtgagcagaggccacagatgctgctatacattttataatgcacatgaactctggaatatataaatcaagtaaatctcagtattctgccatgtactctgggagatacttaaaattataagccatgacttctattttccaagcattttggagaaaaacaaccaattttgtttttgatttctgactatatggtagagttcagctacacagtatatggtactttaacaaagctatacggtagctgcaagacaacaccatggctgggcccttcagagcctcataagtgtattggggacactgagaatctagtaatagactaacacatatgtaccaccattgagtggcatcaaacatgctttcatttagtgctgaaattgatgatataatggaggctagaaagatctaataatgaaaaaaagaggaatttaaccagtcttgaggtgatcaaatgaggaagcagaaaggtaggattgattgtaatgtgtgcacagaggagtgaagcctgattacctgtactactcattgccagaccttcaagaatcgcgtgccaagtgccaggtgcagaagttgcaaaactgtttgggagatcaaagagaaaatatcaacctggctttcaagtcttttcagggtgctttcttagaaaaactgtttttggtcttgaaacatgggcaaacattggctgcgggccaagaaatttatagttcctgaggaactttagattgatacatgtctgacaatttccattttgcaaaacaagagaaggcaaaagtgggcttggaaggcattcaatctttgatgttgtctttgcttcagctgagcagaagtgagaatttagacacactgagccattaccagagtttaagaaaacttaccatcagtgtggtttccccctttctctcagtcaagcacatgggtgtgtgtcattgtaaaaggactataggattggaagtggacacgtgaattccatttcttactctccactaactacctgagtgacattaggcaaacttgcaaatgtggaagttgggccgggctaggttatgttccgctctaaccttaaacactgatttccccattgactttcttgttccattcaaagagattaggaggaaaaaaaagtggtatatcccaggcacgttttgtgatatttcagtgaaatattgaaataagcaatgtcagcagcctcatgttctcgctaatggtctggtatactttatgaataaacaacactagctttatattactggatctcatttccagcagatttataaaattgtaactctacagtgttttctgacagagcttctggaaggggaaaaatgacagtgcagttgtttgctaacatctgggtgtactttttgcaacatggggagaattgttccaaggcagggagctaatctgattcatatctctacctagaagcacttaaagaagctgtcagatgattcccacagtgacaaatttgagtcccaaggagatgatggagtgaaatcagacacattttgggaagaaattcctactatcttttcaaaggataaactcccacagtatttgtgccaatctcttttacagcattcctatctcaaaaaccagagacttaggctaattttttttgtttctgttattctctaatatatttgtttaaaaaggaagttttaatgaaaagtcagtcatgtgacttagagaattaaatgtagggctctagcaaggatttgctttaaaatgtttctctccgatttagttgctgcacctgggtaataactaccttggaagtattagtgttgtttctctgtcataaaattgacatgcttggtgtggataagaatatttgattgtagaactgcttctacctaactgcattctgttatactaacaatttggctagcagaatttttttttaaaatcctccatttgcagctttttgtactctgatcacaatatattaaatcccccagaagaactactaccttgaatacaaagcacatagcggtgctcttttaattgatttgtaaaggttagttgctcagtactagtggaaagtttcatgattacttaattgaattacctgcttcccccagtagagtgcttactgggcaccatacagtaagctgagagttttacatgcctggtactattatttccccagtttacagattaggaaagcaagatgtagcttacaaaatatgctgaaagaccactggcataaaagccttttaattccttgctgaaaaactccctgggttttgaaatatgataaactacatttttgttgttctctgaagattcaggttcatatagtatgacagttttatttttgtgactctcaatcatatatgagataaatgatgggggaaagagaccgctttgaggtcaagcagacctatgtccaattctaacatcaaggagaagccacgtgctttggcaaagtttgtgtatttacactgttgggaaaactaaaagtaatttatataaagtacctagcatagtatctggcagggtaggtgttcagtaaatgttgctggtattatttttgctagtgataacattattcagccatataaacacatagcactaaggttaagcaaaatatgtattgacattacagcatgcctaggtatttattgcctaaaatatatttccgataagcttttcttagcatttgctgctttctactaagagttgagtgaaactacgatgaccacaatttagtctacttatttaaacctttaattggttggcttccggtaaattgcagtttgaatgactagcccaatcatgtatgagtagccgggaatattcgataggtatagaattcttcctgcctaatcaagtcagggataccgatgttaatttctgaaataaatactttctcctctcaagatctacccagtggttcgttgccccttgggatcacttctacttttcaacaaagagcaagggacagtaattgcaacttcagggtagaaggagagtttgcatgcctggcccagaatgaaataaatgtggaggaacagagcccaaatgacttgtatgtttcaggtacagctccatgtatgctgcagatgatttgggttaaaaaaaaaaattggccagcctaaactttgaggcaaagaaattgcatttcccaatgtctcatttctctttccttttactttacttcatctactgtgaatgacccttatttttttgttgttgctttatggcaataaataaacgaacccccattgtgcaaatattatgctcttctcattggcctggagggaaattgctacgagagaaatcctggacttttttcccctttttagaaggaaataccaggttacgaatggcccttctcagtctctagattgagactaggattcttctgtcacctcctcagagccctggatgcagaaagcaattcatttcacatgtgtgcaaatcagacacagaaattctgcaaggcacctcttggcagtaaaagtggactattaactctcaaattgctggcctctactgagaggcaacttctccctgaagccaggtgggagtgtccctttgaagccttacacaacccgacttctgttgctagggtagagtactttagagcaagagtagtcctgcggtatgttaactgagtaggtgtttcccagaaaattaaaagcaaaagtaactacctggaacagtctgatttttaaagcaaagcaggatctttgtacgtttaaaatttagtccagctacttgatagcctatagagcccccaactccttcttccagcccagggagagtctgcagtgagcaaggtaagaggtagctccagcattttcagcatggggttaggttggaagtcccagttgacagggacagtccttcctgctctcacctgccaaaatctctctcctcccaggagatagctcccttttctccctgattgcttcctctcatgaggagaaggtcattggcgctcaccacttccagggcaaccctttatgcaagcagtgggtgcctttgaaaggcaaaccgcagcaggaagactttgaaggcaagaagagactttttcatctttgcaggccccagccagaacattggttctcagtgcagtacaagcagtttcaaagttatctcccttgctgatatggatgtgataacatggagcggagaggtgccataatgatttcctttcaaatggctgcctcaccatttatctttgcacactgtcaaagactgatattgtcgggagttagcagtggcatggaataattaatctcgtacgggggaagtaagttcttcatttgtctcctgagaaattagcactgcattgacagcaaaagtagatgatatcatcggaaagggaaagggaggtgatctttgtaactccagatgccaaattgtaacattgattcagttctgtgaagttttgattgaacacctactatgtgccaggtgctagagatacagatacagattcctgtgctacagtagatcataatcccttgagggtcacagcttatttcaaaatccttgtcaccttgacaaaatgctcaagaccaccatggtgacatgtgtgccaccatcattattattatctaaagagttttaccaagtgtctgtatcattaatatttattgtaaaggctcaacttttataagaaagaatccttgtctcccacaccaccagtgcaaagtagattaacaaagttggcatttatttattttattttttctttaggggaaaatcaagaagttagtgatctagggctaatggggatattgtgttactcccaatatgtggttcccatatttggattcaagtttttcctattttccaatcagtgggaggagaaaaagaaaagcatgcctgcttatatcctattaaggccacacctgtctgcaaaacaggtgggatccatgtgaaccagaagcaagctattaaggatgcaagaaaatgtagtgactagttggatggccatataccttgcttaaaaccagttagggtcttttatttctgaaagaaagaagggaaactagatatttggggatgataagcaatctccccacagagattctgggtgaaatcctttttgcttctctgaatttccaataactcacctcttaaatgagagaattgaaggaggtgtgctgtgtagtccttttcaatttcaaagtcaaaataacaactctaggctcctcctccttcctcagcttctcccaggcagtaggcacagtgatgggctctgtgctgggaattttgttttgagcctgtttcttttatttggaaacatcaggtgctgaacctatcctggattcgagtgagtgcagggcatggctctaagaagcattttgtggaaagagtcaagcttgtcatcctcctcctttgaggcactaattgggctgactgggccaagcaaaacaatggtatgatccatgtgaaccaaaagcaaattattaggcttggagagtggtgggtagtcagagaagcacttctgttgtagacagaaaaacagcatcatgcttctcagaaagaaagggggctgctatctgggtggaaagcttagaatcaagggagaattatacatgtttttaatggaccgaggaagaagccagatttgtgtatgcggagtttgatagggaagggcttctcttctttttcctactaaaggaatagtgtttttgacaaggtgccaaaaatctaggccacagcatcccactttgtgccacagcatcccactttggtgagccataccaggttgcaggaaattaattgctttagactttgggctggctgagtggggcctgaagccaccgtagtccctgggcaagccccctcccactacacaggcctcctccatctccctcattttctctgtgtgctgtgatttggaaaaaattgacaagcacttgatagaggctaccaaccaattagaattggttcacacgagacacttgggaatgaactcagctggtcactatggtgatttaactaaattgtgttatccagacacattagtgaatcaagtctggcatttcaattttctctataagatgaattgtggaaagaagttcattataataattaaggaagatttatgcagtgagtacatttttatctctgtagcctgttataatgctggtattttgtgaccaaaaaaattgagttgtagatattaactatgtaattccacaaactgtgctcccgaacgagttatttatatagttagaatttaataaatggaaactttttgaatgcacctgcttaggaaaatattgaaagaaaacttactgtaagtttttcagcacagtgaacaatcatcccccagtgaacaaaatgctagccttaacccggtcagtaaattatttggccataggcagatatctcatctccctgtaaaggaaagccagtttcctccactgtaaaatgagtcttagtaggaaagggggcattagcaaagtaatccctgtgcctacccaatcgttctaatgtgatgtttcctttggaaaaaacctacaactcagaaatatattgaatgaaaatctccctattacaggaagacactgcgggttgctaaggagtgtggtttctgtggttggagtagagaaaaatagtggtgttttctgagatctcaactcaactgtgcagggtagatcgaatgaacacagcacaagccacagccactgttctgcttctgcctgatttgcttctccagaaatttcccagattacaacaatgccgaagtgcccattggctaccacggagataacttcataaattgttaaacaggcagagctcaggtttaaagaactgcctttattttgagctgtgattttacttgtgtttcagacattccctcagatattttatttaaaagatttcacaggagcatcatgcaaaatggtaaataataaaacattctataaaccacacatcccatctaggactaatcattatattttccaatttaacattcattccttccagatatgttcttactcgttctttaaaactatcataaatggaaagctaccatttaagcacaaataaaactcttaagaaagctaagaaaatctgaactcattaaatatttctaactagtgaactccttggttctccaaatgacctattttttcccttccttcttttttttttttttgtatttttagtagaaacagggtttcaacatgttagccagcctggtcttgaacacctgacctcgtgatccacctgcctcagcctctcaaagtgctgggattacaggcgtgagccactgagcccaccctccttccttccttttttaaattagaattttttattttttatttttttttttaattttttttttggttgcttttagccacctcagttaccttgaccatccgatttcacttactgtagccagatttctaaagtatgtgtttctgtggcttttccatagtttttttccccaatattttggcagtggttgaatagaatccttttattcctccctccctcacccctcccaatcagctccacctatagatatagaaatacaaagtgaacaaatgtgccatgcaacttctatttttgtgcccgttcttcctctttgtctctatttttgcctctagcacatagtatcctggtaaactggatttttttttaagagacatggagaacacagtgcagtgctcattctctctcagcctctctgtttttactgtaatgaatctattctacataccatgttctcaggatcccactgtatgtctgataaactaagtcaagctaaggtcattattaccaataagtaatcaataaactcaatgtttaccctaagtttgatacggtaacttagttattttaagaggaaattttaagttcttgtgtgtgtgagtaagaaggagcatgagaatagggaaagggccgtttcacagaagcggtcctatctggttggcctcaattgtgcctctcaggcttgtatctcatctgcttagctgtaaggccagtcctgttaggcaagaaaaaatttaatttgcaacctagtttatgaaaggataaattaagggaccttgtgggaatttaaatcatctaaggtaatagaacatgaaacttgcctagattaaaaactgggtcttttgtgaggtttcattcattatggccccataataatagctacatgtctatgcacttttgagcttgggtctgtttaaaatacttatttgttatttcacttaattcccacaataactgtacaaatatggttctcttgcctccatcttatatatgagaaaaattaggaacaaaaaaacttaagaaatttctttcactttctatagctgataaactttggagatcagtttgaacccatatactcttaaacactatttatacagtattaatgtgatttgacaaaagtggcataaagagcaatgactctttaagactcaaaagaagatgttcagatttatattttgatattaatattaatatcagcaagataagctgttaaataagcattacatgtaagaatcctgaccttggataaaattaaatctttgtcataaatctactactgtgacaaaactgcaaaatatgcagtgaataattaaatccagatgtctcttccggcaacagcagcagcaaaaactggaggtgggggtgaagggaagatggaagtgacagactccatattcataaaagctctgatgataaatttttttaaaaaaatgtgtttgttttaaataccagtcttccatgaatcctaagaattgcacagtaaaaaataaaatctgcctaccatttaacagcccgcaatacaaaaatcttactgtgtcaaatgtaatatgcatacctggcttcccaatttggttttcttaaggaggagtaatttagttgtcattaaactctttgggaaaccgttttaataatgttctttggttatcaggggtatcctttttttccttaaggcaaagaagagaaaacgtgccgctaaaacctttactgtgtgtggtaatgaagttggtccatttctgtgcaggattgcaacaattctttatcacttaacacgatcggaggtgtgagagcagacagtttctcaaactgcaggaaaatgctgaattcaccgattgctatcttgacacaatgaagggaccatacattatatgaagcccacatttggtttgctgttgttgttttttttttttttataactgtgattattttttgatggaataataatcacagaaaaaagaaaaacctgtaagagaagacaccactgtatcatctttttatggcaatatgcaagagggtagaaaaaatgagagtgtctaaatttatcttattttcctgtgggattttcagcacagacatattcctaccactacaaggaccaaggacattcacttgcctgcttgctctgataatggccagtagctggtcccaatgttgatacaattaattaaaatgataaacatgactctagctagcttcagcacagtaagagtaccacagcattttctggatcatttattcaagattcactgacttggagtcactgatggtaccaatcattttatgaaataccttccactagagacagaaaaacgttgttttgacaaattcatggtctgcacctcccccaaaccagtgcatttctaaacagacttgtttttcctctaaatagctttgccaatccggccaacaccccaatatttctttatattttgaaaagtaggtctttcacctgctgataatggaggatccaattctgtgtaaactctggaattctatttaaaattgcagattttaaatgtagggaccaagacaggatgtaggttgtgtcaacttgggaatgctgaatgactgaactgtcatgacatttacaatccagatgtcatggcaagctgggagacaagacagcttggttgataattagatggcagatgtccatgcagtctcacgtgatacacgttactttttgtatattcaagatttgggactttagccctgaaagataggtgatacatcatcttctctatacaataaaaaatagtttcaataattgtatattattttgttttgctttttttctcatttatttggaagtagcaaatacaagaaacaaaaattactcataacccctatttttggtgtatctctatgcaggcaaatatactgatgatgattattttcattttttgaaaatttagattctcacactcaattaaaaaaagaaagcctgaggaaattaaatgatttctaaaatcacccagctaattagtggcagaaatgagaccagattccagtctcttgctttcccgaataccttattctggaattcaattataagtacaaggcatcccactcttggcttcctttctgaataaatgcttgcaccaaatccccagtggcttcttgagaaagctggctacaaatcttcaaagcctcagttgaagaattcttattaagcctactaggtaccaaagcaatagcctgaagtttggaaaaattctagttggtgaagctagaattttattcaatttaaagaatacttggtaggggggaatgtaatgaattcactccctagcctttcttgaactctacctatttaacaccctatttctaatacagcagcttctcactatagaatgttaggtttatcaaatctctcttccaccctgttatacggcattttccatcccttggatgtttcaagtccaggaccttgggcttaaaggcaaaagtaaaatctattacacatttgtagctttgtacaccaatcagggaaaagtagtaaagtgggctattatgtacattattttacaatgcagtatgttagttgtcaattgttacgcaagactaattttttccacagcaaaaaataaagctattttaaaatattttggaagcaagtcatggttgaagagaagcatcccttgaaaaattagacttaaagctgcaaacttcccggggttgacattagcttgaacttgatgaaaaaggaaaaattttaggaggatttgttcagctgtcttctgagttatgaaagcaggaagaaatgagttttacatattgcctggaggtaatttgtgtacatataagtcaaaaacaattaaacttcaaacttcacacacagccactgtcctgtaaagggtggtagtgtataagcagaagaaaaatgactagaagagaacagggttataaagcatccagacatttcccatgtgaggatcttgaaaaacttctgcagccctgtgactggattctttctcctgatctaatagggctgtttggaggaagtatttctactgctcttgagttgttgctagttttcctttgaatatcctgctcagttccctgccccagttcaagcttccttccaaaatgtgtttaaaataattagctcttcctgttggtataggaaaaaattagtcacacataattggtaattcacatattgtattataaaataatgtacaaaattaccacccttacttctttttggagggcctgtggcttgtaccaatggatttatcttgttccagggcattgagaaattttgccttactgatggcatcaccacttacatttctcaacatctttgcctcccatcagaccaggatttcagttactaggtatcctaccttgttccattgatctgagaccctcattaataccctagctgacagtcttaactcagcactgtcttctattttctaccaaatagaatacaataatcagatacattttactctctcttctgaataaagatattaacaaaatttccatgagtacttataagggtgagtttccagaccaacctagatgagttaccaggatatatagtttgaaatattaactttaaacatttcttgatttttctgaccccatcaggtattttttggaaactggtattaggcttgtagaaatggacaaggagctctaccatgcttgaagatggtttaagccttcagcaaaataattgagagcttcctcttctgaatattccgaatacacaggtctatcagttagtgtatcatgttatgtgtagatgtgtgttggggtgatcagatccaacaccaggtcgtgggggtgacaaaggccggcaattcaaaggaatgagaaaaagacagtttgagagagaaagtgggaccagggggccatcgcgagtgtggaggctgtgaaggccccaagttctgggagcccatgttatttatgggtgctcaaacaggtggtgaggatgtcgagtgaatgagaaacatatggctgtttgacataatgggagtactagaagcaagaagccagcaagtctagcagacatgcaagccctgcctcagcttctctcccaacactcagcttttctccaacagatgtgtatgaataaggcttattaataacaaagcctggctccacaggtgagagggaagatgtaacttaatctactggaagtcaccaacatagccctctaaaatgagtcattattttgactcaaaaatgaacagattaaaaaatgtttcagctaatcctcttagctatttgatgtacatcaagcatccagatgttcacaacatccaagctgcaattttttgtgtgttatttaaaagttttacacttgcatatattattcctttcctcaaagacaaagtatagaacccaaactggactttttaaattcactccttaaaagtgtggtaacttaccattccagagctggtgggtccccgattattggcccatgggttgtccactttgtggttttgctgttaggaaatgttggctgatggcttccttaaccactcagcagttaaccaacaataacttggaatgtgtctaataagtgcagcctaatcttaattttattgggagttatctcagctaaataatggaaaatttgacaaacctaattaatgaattatccactgttaaatcttctgtgccactgagtcctctttttagtaaaatgattaaaaacattaactatagtggtatataattactattaacaactattatgccaatatatattgttattcctgcctaagatactatgtctcagcacggagtttatattaggtattttattttaacagttttctaattgctgccactttttcgtcagattgcatattttgacccacaacattgatttcaccttaatgtcaccagtgggaattaattatctgaagcttggcataatattaattaaatccatatgtcacatcatggtgtggcattcttttctttctttcttttttttttttaagtcagggtctccctatattgccatgctggtctcaaactcctgagctcaagcagtcctccctggttggcctctcaaagtgctgggattacaggtgtgagccaccatgcccagcccattgtgcagtgttcttacaaaagtattctaacaatccaaaatcaagactacttccaaaagtggcaggcttcatatagaatccaacattctgttgcaatgagattgggatgagtgggtttagaccaacattgatatcaaaggccagtttccctttaaatcaaaatcacctgtaaactagcatcttgacattcaagatcccaccagggggatctagctgggaatgtcaccatgcatgtcttgagagagtgcattagcccacctgcagtaggttgaaaaatatcttccaaggataatttcttaagctgtatattttaccttatttagaaaaagggtctttgtgagtgtgattaagttaaggaccttgagatgaggaaataatcctggattatctgagtgggccctaaatatcctcaaaagtgtccttataagagtgaggcagagggggcatttcccccgccacacacacacacacacacacacacacacacacacacacagaggagaaggtgatggaggcagatactggagtgaagcagccacaagccaaggaatgctgacagctgccagaacagtcaagaaacagattctcttttagggtcttcagagagaatgtggccctgctgatgtcttggtttcagctcaatgatactaatttcaaatttctggcctccagaactatgagaaaataaatgtgtttttgttttgttttgtttttttgagacagagtttcactcttgtcacccaggctggagtgcagtggtgcgatcttggctcactgcaacctccgcctcccgtcttcaagtgtttctcctgcctcagcctcccaagtagctgggattacaggtgctcaccaccacgcccagctaatttttgtatttttaatagagacagggtttcaccatgttggtcaggctgatctagaactcctgaccccaagtgatccatctgcctcggcctccccaagtgctgggattacagacatgagccactgcgcccagccaaatgtgttcattttaagtcactcactttgtgccaatttgttatagcagccacaggaaactaatacaatacttgtgccaacttaagtaacagcaccagccaaagtacataaagtggaaataaaggtatttttagaaagtctcattactataaaatatggtgtaaataaaaacagatctgaatatgcaaattgaagtttcaaaataagtctcctgccatcccatttcaaagacactggaaatcttaagctcttttctttacaaattctgaaactatcattgcctgtgggttgggttgaaatgaaggcacgtgggtgtttcaagggtatgttctgtgacaaagagacagaatagaaaaatccaaagtcatagcctggagctaatacagtaatatgaatacataaaacaggaaggacaagaatataaaagtgaatttggggacctgagaaagtcaagaaaatgattggagaaatacaatttgggagaccactttagaacccagccctcactgggcatggtggctcacgcctgtaatctcagcattttgggaggctgaggcaggtggatcacctgaggtcaggagtttgagaccagcctggccaacatggtgaaacccgtctctactaaaagtacaaaaattagccaggcatggtggtgggcatctgtaacgccagctactcaggaggctgaggcaggagaatcactggaacccaggaggcggaggttgcagtgagctgagatcatgccactgcactgcactgcagcctgggtgacagaacgagactctgcctcaaaaaaaaaaaaaaaaaaaaaaaaaaaaagaacccaggcctccaatggtgcgatcaggtgccaggtactcttgtctactgtgctgaccatatgctgttgaggtcatcaccagctacgggaaagggcattctcataggggcaagcccaactctatgtatcttacgttatttaccactatttcccaaataaacctgtttcaaagaataccatctttaatgtctttcacaggtacctatcctccactctgcatccttttccatgctatcacttgcagtgaaggtctgttcaccccttttttaacctgtcttccatcttgagttccaatttccagctgccctctgaatatgtccagaggatgctggctgctgcctcagactcactggatgaaacagtttcctgttttctttactaaaactgccaaccttccttttccttgtttgagttagtgtatcactgtcctctagcccctgagctgaaaccttggaatcatctttcactcctccctccccctttatattcagtcaactgacagtaccaatatttcttctcttctccttttatttcttttgccactgtcctactttgggcactaatctctcttctgaagtataacaatagcctcccaactggccactctgctttagctgctccatggtccaatctcccttgtcacatgtgttatctttcccaaacactgtcacaacttgtcagtctactgcaaaactttccgtgactcctggggggcctgcaggagagagtttcagatttctgagtctgccttcctggctcttcacaatgcagcctgagtccatcttttcaaccgtctctctggatacataccaacacttgccctttgtctcaatgaatgtgcctgccacttttgtatctccttacctttactcatattgtggtttaactatgtggttgtcttctccaccctgacaatagatacatctattgtccatcagcccaatttacaacttttgcatctcttctgatttctatcctctgctaatgacacttattaactactgcctttccactggactttgcatttagttttttatatatatatatatatatatatatatatatatatatatatatatatatatatataaccttacttctgcttttaaacatagatcattatttccatgtctaccttccactttctccaacactagattgcaaatttctacagggtgaagcttatgttttcatcccttaacacccagcttaaatgtcacctcacatactgactaatgctttttatctcagttctaaaacattattaatgtacatcacataatttaactccattttgaaaattagttcttgttccagtatcttatctcttaaaatagactggaaccatctcaaggttagagaggatccactatattaaattcttatatatccctcagtagatggcactttgttggatgatttaattgacgtatcttcttaaaaaataaaaatatctggctcttcaaataattagctttgtgacctgaggcaaatcatttatcctctaggacatttagtttactacatggtgaaataaatgataccttcattccttaaatatatagatccagtgacatgttgctttgaatcacagaatttggtttcgtgctaaatctaagaccaaaaacagagcacaaacaattcagaatcaacagcatgctttctggaagcaatatgaaaggtgttattaatagaattcagcattattctaatttcctcttaaaatttcaagaaatatatctgacatttgtcctgtcattgtaagttgaaatatgtgtgtgtgtgtgtgtgtgtgcatgtatatataattttttgttgttgtttttgagacagtcttgctctgtcacccaggctggagtgcagtggcatgatcttggcttactgcaacctccgtcccccaggttcaagtgactctcatgcctcagcttcccgagtagctgggattacaggtgtgcatcaccacactcagctaagtttttgtatttttagtagagatggggttttgctatgttggccaggctggtctcaaactcctggcctcaagtgatctgcccacctcagcctcccacagtgctggtattacaggtgtgagccaccatacctggccaaaatgtgtatacattacacacacacacacacacacacacacacagagtatgtatacgtatatatctgtatataggtaagtgtgcttatatgtatatacacagacatatacacacacaacatatacatatagatttgttgtctagatattataagagtattgcactaatgtttctataaaacaccagttcacaggcttctgtcttctaacaatatccttatacatatttgtcagccactatttaccttaaaatgaaacagaggggagcctgatatataattacggtcactgtgctttgttctattttgtttatccctttgcaatatagtgtggcagacagaaaaatgtatgaaattaattcttttggtttagaatgacattcctatcattgttagaacaagggattacattatacactacctctaaactcaaattttctgagcactttaactattaaatagcaataacagaaagcattgtaaatcttttggagttttgcatgataatgtacctcttgttaattgaattgagagatgattgccctatgattacctcgattcatttgctgcataatttaccataatgataattaactccttgtactgaatgaggtaagatgtgtgttagttagacaccccctccctcccttcttgcctttccttctttccctccctattttagtgtttaaccattttacacacaatttgagacttgtttcagaatctctccacctatattatcatgtcaatccaagtatttctaaataaaagtagaagttgggccatgtttttaaaatttctagctaattgcctgctacttggcttattgttgtgatctaattatgttctggtttttgaaaaaaggactattgcctggcccactgtatgacatttgatttatgtagtctcacctctccctaaatagcccatagttcacaatgcagcagagcctatattaccgcaatttcttctgcactgaaattagacaattatgaagttagtagattattaaactaacgtatgctttataaatacttcttcattctaggataagggagaaggaagtatactgtaattcccaatatgtaaatgccctcacacatttgatagttgatggttccattttttagatgaaaaaactaaagcacaaagaagataaacaatattttgttctgccctataataaaataagcaggcaaatatttatggatatgattctgggttgcctcaaaactttcagggtcagggtaggcaggcagttggagatatgagataatgttagccatgaattgtggctatttttgtggcacctgggtgatgagtccacggaggttcatcacatgattttatttacttttgtatgtttcatattttctataataaaggtattttaaaggaatatatttaggtatccacagtgtgtgacacctgtcaaggagcacatgctagaggcctggctctgccagtgacataggctacgtgactgtcggtgggtcacaacttcctagacttcatttttccctcattaaaatcaaagtattagaagagatcagtggttcccaaggaggtggagttgcttagggaactgtctaaaatttcactgacaactcagaaatctatttggatttagaagctggaggggaatgtatatttcaaaataacttctcaagtgactgtactgtgaccattccttacacacaaacttgggctaacaatgagaatgacttaaccccccaccccacaacactttaataggtttaggatgggttctgagaaataaagatttttaaaacattccccaagtgattctaataggtggtcgacatgccatactttgagaaacacttttttagctcatctcagggtcccttccaactctgacacctcatgatattacttgagcattcttggttctctgcttctatgatgtactattccatgagcaactggagatttagttacaggtgtatacaagtgtacaggagtcaagaaaatgatgctaagtttcttgcactgactgaggaagcaaggtagaagcagactctggcttaattggaattcatgtttgaggcctctgggccctcactaggaaaaatattcaatttatatgtaagcatatgtataatacacatatctcaccagcattctttttgggaaaagagaatttccaaattaaatttaacctatcaattttatactgactaagatgaacacattattttaatatattgtttcctcttgcttcctaatacttacattgtatagagtttcattctttatgctaatcctaatgcatagattggtaaattgagattaatgagattcttcctttactaccacctgtttttaaccaaatgcctacatgctgcatgagcaggaaatgaggtgactactgttgttggccacagagcttcaatatgtcgtgaacaagggttagatgtgaatgtcagaaaaaatgttatgatcaatttctgcctccaacaaggaactacaaatatgggtcacaaaagttctactagtagccccaaatacattttttgaaaggagacaatataaataaagctgaaaagcagtcacaacgctttaatgtgtcattctcttcttcacctttctatccacttagatgtttcctaccccccaaaaatgaacttatgtcacatcacacttgtgactcccactgacatctaaagtagtgtgagccacacagatagaagcacaggtaaatgcctcaaaacctagttattatatttgaaggaatttctgattcagtagtgtttctgtaattgttactaacatcaacgcttcgcttgcttctaggaagacaggatggtaaattcctaacaatggaattgcaaagttcacagtgtgctttaaggagtccctttctccataaacacagctcttgtgatggctttgcagattttgtttctgcatttagtgtagataagttgaacaatcctaattcctgagttctaactagtgatagagcacattatattgttaagaataatggatgttggagaaagtcaggacaaaagtaggtatgaggtgtccctggtatgtggccaataggaaccacggtcctgaagtatccggagcagtccggacatcctcaagtagacccaaatcagccctatcaggagccaacagaaaagcttgctagggcaaggtcagaagataaatttattagccaggaccagtttaagtcaaaagttgaatataagtcatatctttagaaaaaaaaaaaaaaagcaggtagaaaggcacattgtttttagctaactctacaaaaagttcagagcgaaaagaaaaacagtgatgcagaactaggggagaaattaaggagcaaacattccaaaaatagaatgagttgtacacttggttaatttcattgctcagtgatgcctccatagaccagattcttctctctgccatcctcagaaataggctctagggatgctcttagataggctattctgtatgcaagaccttctgtagctgttctagatgccagatcctgaaatgacaacattcagtgaacaataatagctcttcttctacgtcatttccttagatgtgaagaaaccatttccagcaaactcccctcatgtccacaacacctcattaatcaggattaaatcatatgttcatttctaaaccaataagagaaaaagaagtatcgtggctatattatactgaaatgcaattgattttggagagttaaaaacaaatccaaaccagcagcagagcctggggagaatccacgtctccttctcaatccacaagacatgatgggtctgctgcagtgtggtactaaatttggggttacaagaaatttttggcttattagtttcctagggcttctgtaattaagtaccacacactgagtgccttaaaacaactgaaatgtattatctcatagttacaaagtctagaagtctcaaaacaaggtgtcagcagagccatgctcccccctgcaatctgcaggggaataatttcctcttcctagtgtctggtggtttgcccagcaatctttggccttttttggcttgtagttgcttaactccaacctctttcttcctcatcacatggtgttctccctgtgtgcccctttcttcatatggctatcttcttgtaagacactagttatattggcttagggtctcactcaactccagtatgatctcatctaacttaacaaattacatctgcaaccttcctatattcaaataacttcacattctgaggtagcggggattagaacttcaacatatgtatttttgggtggaacaaaattcaagccataacaggcttctatagacctctctagttttactcagtctagatcccaatccatggagtttgaccaaatgagttagggtgctattccctaaacttgctgaaacataataattgctagaggcccttagtaaaatacagattcctggccctcacaacagatgtactgaatcagtctctctaggggacatgcctagaaatctgctttttgacaactgcccagttcaattttatgatgaagcaagtttggaaagcatagagtcagggtgctgagcactttttgagcatctttgagcactttttgaccatgttattcctggctgtgaaagaattctttttgtatgaaatctcatctacccataacaagtcttggaagctgctcttgtcatcctcatcacagacctgcagaaatggaggttaggtaagagtggggctggaaatggagctaggtccaatctcaaaatacatactttttcaatcatactaactcatcatgttagtagtaagttaaagaatcttgaatcatatggtccactgtagtttacttttcttgccttattcccaggagttttgtttttatttgttcttgtccttggagggaacaaaagacagctggtagctgttccctgtttggttttgcatgtattcaaaaggcatcatcttctactgctctcttactcctttactttgtggtcatttgttttgcagctatttagacagttacttcttaaagaacccctaaaactatttagacagttacttcttaaagaacccctaaaactatttagacagttacttcttaaagaactcctaaaactaccatttgttcctctagaaaggattaaagatttgctgaagcaaagttctcctgacactttacctagagcaaggctgaaacaaaagctacctacacctgtattttccttctcttatccctcaagtacacaatagggcatttggctctcagcagttgatgccaagttctgctagggaagaaatgagacttcagagctccctacaagttgaaatggagtcagaaaagctacatatataaatgtcagaaaagctacatatataagctacatacataagctacttataaagtttctgcaaaactacctcaaagggcaggtagttttgcagaaactggagggacactgttttctggagcactctgccactaggattttacttttagtgtaatgaaggatcactgaagacttttaaaccagacggtgacatgataaaatttcatttcagaaatttcatttctgaaaattatgatggctgttggaaaaaagtagattggaagaagcaagaaaatgctaggttacttcacaacttctccaggaaaatagtgcagtgggagaaccctgaactcaggaaatatggcccatttcctgcactatgtttcccaattcaaaatatcctattgtggaattctacagctcaagtcaagagccccttctgaactacaaaggacaaggactgatctactaaagccgtgtagtaaatgtgaggaatttgcctaactcagccaattgatgtgtcaaaatctaaccaatgtgtctaataatctaacatatattgttattgatttcaggttttaagaaccagttttctaaaaatgaaaaacaaaatcaaagcactctagaggaagtaatcatatgtttaatgtcataagtcactgattgtatacttaatagtaaatggtggatatgaacttgggccctggagtcaaacttaggtggctcggtcatgcccttgatgtgtgtctttgggtgggctactgaaactctgtcttagtttcatctataaaatagaatgctaacatcgactttatagggttattgtgaactctaaataagacaacaaatggaaacccaacacatgttctcactcaaaagtgggagctgaacacgtagacatggggaggggaataacacacattggggcctgtcggggagggggagggagagcatcaggataaacagctaatgcatgtggggcttaatacctaggtgatgggttgatagctgcaacaaatcaccatggcacttgtttacctacgtaacaaaccttcacgtcctgcacatgtagcctggaacttaaaattaaattaagtcaaaaaaagctaaaagcaagctttatgccaaaaaaaattttaaaaacttaaaaaaaagcgcctcttaaagttataagggagggtacacagtaagcacttagtgagtgagtgttgtggttgctgtttttcttaataaacatatttttatccaaattattaagcagaaatattggactggaaaagggtaaagtgtggattattaacggttgacattggaagagcaaagagatagagatgttccatgtggttcctttgccaagccatccagatactcacctccatccttttggtcatttcccctaatacacagtatatttatgatccccttctgacaaccccttgaagagttgcttgcctcctgcacagtgctgagttatggacgatgcatttgaagccatatattcactctgtcttccccacatgtgcctagtaactatggcagagctcaataaagaagaggccagtggcgggtttactcatttttaaaaaaatttccttgttgttcttttctgtgattgtaatggctagcactggtactctttccctctctctccccttcttttgccatagagctattgtcaaatgtacaaatacatagtgaattgcgatggtttctgggactgacagagagaaggaacctgttttccccataaatgctgtagaatgaagggtttgcaaacattgtgattgtggcagattaaaaaaaaaaagtcaagcaggctaaattgaaagggaggcatgagaaaagctggtgcaacctgtcagctcctggtccgaaagaagctgatggtattttttttaatattgtgaagagaaggaaaattttttatagtaagtctatggatctgctttaggaggcttttctcttgatctaattgagctgtttgaagtgtgcttgaaagttctcacccagcctgtgtcagccacctgcctgctacaagctgtgagaagttaatcgtcttgggcattgttaggaggagactgtctggtatctgatggctttccattctgaacaagggtgtacggatatggaaaatgtgtgtgctcacatttgtctttggggtgtggggctgcttcactatgcatgagagcacatccacacctccatccagatggtgcctgctcatagtggcagtgctagataaattcatgtcaaacaggcagataatccaaaaaagcaactgtaagtatccacattgctgttttctgcttccaagcttcagtgttgtttttttttttgtagtgacagggtattactatgttgcccaggcttgtctcaaactcctgggttcaagtgatcctccagccttggcctcccaaaaatctgggattataggagtgagccaccgtgcagtgcctggttttttaacatgctattcccttgcctgaaacaaccttgccatttgccatcaacactggcttcatcttccaatctctttgcctgttgcctcacattggatgtcaccaatctgggaagcctttgtcacccctcaccacattgaggtgaggggtacctcatattctctccctgttccttgatttcccattcaaagcacttaatgcaccaaacatttttttttattgcatgtctgaatacattccttagtagttcaacattctttgaggttatatcatgttcatcacagaatttaaagcaatctcctgtgtatagcagattgacaataaattagctatgaaaacaaatgaataactatggtttgggaagaaagacattgtctgagcacacagaattctaactcatgacttgtgcactgtcaagaatcacttgctttcagataattttgatgagtctgattttacgcttttcagtttgtatgtctcatgatttgtccttaatagactgaagaagtcctagcccttataattgaccagtgcctggtaggggaagggcagcagagaaggactggattagaaccatctcaaatgcttctattctgattagtacttagggttggttggagagtaagaatagggactcagcctagttgaaggaaagcctgtatagtggtgagtctgagtgacaaaccagggagaagtaataagacaatttatttctatttttttatcctacacctgaaatgtaaacaaggacacattaaatttttactggttagcattttttaagtaattatgtgctcaactatgtccttatatttgcattcttaccaatgtagactctgttatggaagtaacccatgctgctgctgcctttggacctgaatctctttttgcccttgtcccatttgtgaatttagactttcagcaagttgtctttatgattctctattctatgacatactttgtgaattcatctgtaatcaaatctgtttgatgaaggtcacaaaagctaagtcaacatgagacctgaaagtagaacctgggggtactgattttcctacccattaggaaacagcctccccacccaatcagggcaggttatagtattcaatgccatcttgtcttattgactgagtcatacatctctcattccgcaaagtcagggtcctaaaatacttctgtggagtcgcaaggactcttcctcattagccatctttgactttgtcattgatactattttctacctgtttctgataattaaaaccccccaaaaagtaaaatgtcagggtgaccagagagaaccttagataggacagctaatctcttgcttctagagaaaggtatgaaaatatactgtgcttattatggggatgatggtatgctctctgaattgaaccttaccttttaacatgaaatttctaattgaaacaaagctgtgatgcctccagctttgttcttttggcttaggattgacttggcgatgcaggctcttttttggttccatatgaactttaaagtagttttttccaattctgtgaagaaagtcattggtagcttgatggggatggcattgaatctgtaaattaccttgggcagtgtggccattttcacgatattgattcttcctacccatgagcatggaatgttcttccatttgtttgtatcctcttttatttcattgagcagtggtttgtagttctccttgaagaggtccttcacatcccttgtaagttggattcctaagtattttattctctttgaagcaattgtgactgggagttcactcatgatttggctctctgtttgtctgttgttggtgtataagaatgcttgtgatttttgtacattgattttgtatcctgagactttgctgaagttgcttatcagctgaaggagattttgggctgagacaatggggttttctagatatacaatcatgtcatctgcaaacagggacaatttgacttcctcttttcctaattgaataccctttatttccttctcctgcctaattgccctggctagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgctggattacattgattgatttgcatatattgaaccagccttgcatcccagggatgaagcccactcgatcatggtggataagctttttgatgcgctgctggattcggtttgccagtattttattgaggatttttgcatcaatgttcatcaaggatattggtctaaaattctcttttttggttgtgtctctgtccagctttggtatcaggatgatgctggcctcataaaacgagttagggaggatttcctctttttctattgattggaatagtttcagaaggaatggtaccagttccgccttgtacctctggtagaattcggctgtgaatccatctggtcctggactctttttgcttggtaagctattgattattgccacaatttcagatcctgttattggtctattcagagattcaaattcttcctggtttagtctgttttggttactgcagcctatactacaaggctacagtaaccaaaacagcatggtactggtaccaaaacagagatatagatcaatggaacagaacagagccctcagaaataacgctgcatatctacaactatctgatctttgacaaacctgagaaagacaagcaatggggaaaggattccctatttaataaatggtgctgggaaaactggctagccatatgcagaaagcagaaactggatcccttccttacaccttatacaaaaattaattcaagatggattaaagacttaaatgttagacctaaaaccataaaaaccctagaagaaaaccaaggcattaccattcaggacataggcatgggcaaggacttcatgtctaaaacaccaaaagcaatggcaacaaaagccaaaattgacaaatgggatctaattaaactaaagagcttctgcacagcagaagaaactaccatcagagtgaacaggcaacctacaaaatgggagaaaattttcacaacctactcatctgacaaagggctaatatccagaatctacaatgaactcaaacaaatttacaggaaaaaaaacaaacaaccccatggaaaagtgggcaaaggatatgaacagacacttctcaaaagaagacatttatgcaaccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggaccaagaactagaaataccatttgacccagccatcccattactgggtatatacccaaaggactataaatcatgctgctataaagacacatgcacacgtatgtttattgcggcactattcacaatagcaaagacttggaactaacccaaatgtccaacaatgatagacaggattaagaaaatgtggcacatatataccatggaatactatgcagccataaaaaatgatgagttcatgtcctttgtagggacatggatgaaattggaaatcatctttctcagcaaactatcgcaaggacaaaaaacaaaacaccgcatgttctcactcatagatgggaattgaacaatgaaaacacatggacacaggaaggggaacatcacactctggggactgttgtggggtggggggaggggggagggatagcattaggaaatataactaatgctaaatgacgagttaatgggtgcagcacaccagcatggcacatgtatacatatataactaacctgcacattgtgcatatgtaccctaaaacttaaagtataataataataataataataaaaagaaatttctaattgagttgcctaagcctgcccacctgtcattctcatatgcctaacacgatgtgagattttatatatacagtcctctgtatatatattcacaggttccccatccacagattcaaccacccatggattcaaaaagcaaagcaaacaaacaaaataacaacaacaaaaatacaaattttaaaacacagtataacagccatttacacagcagttatattgttttaggtattatacctaatttagagatgatttaaagtacatgggagagtactttaaaaaaaaagtacacaggcatgggggcagtggctcatgcctgtaatcccagcactttgggaggccgaggcaggtggatcacgtaaggttgggagttcaagaccagcctggccaacatggtgaaacccctgtctctactaaaagaagaaaaaacaaaaacaaaaacaaaaattattcaggtgtggtggcacatggctgtaatcccagctgctcgggaggctgaggcataagaatcacttaaaccagggagaggcagaatttgcagtgagttgagattgcatcacttcactctggcctggacgacagagcgagactccatctcaaaaacataaataaataaagtacagggaggatgtgtatagattatatgcaaatactgtgccattagggacttgaacatctccagattttgtatccacaggggtcctggaatcaatccccttgatggatacagagggaagactcactctcactctctcttgatatatatatatatatatatatatatatatatatatatatatatatatatatatatatatgcacacatacacacacacacacacacatatatatacacacacatacacacacacgtatgtatatttacatgtatttataaactgatattttattcaaatgtttcaactggcccctaggaagaaagatccactctgatgtgttctggctctgtgtgcccacccaaatctcatcttgaattatcatctgaattgtaatccctgtttgttgtgggagggacctctcgggaggtgattggattatggaacggtttccgcatgctgttcttgtggtagtgggtgagttctcacaagatctgatggtttcataagaggctcttcccccttcgctctgctcttcccttctttaagctgccatgcgaagaaggtctttgctttcccttcatcttctgccataattgtaagtttcctgaggccttcccagccatgcagaactgtgagtcaattatgcctttttcctttataaattactcagtctcaggtatatctttatagaagtgtgagaatggtttaatacactctgtaaaagcaaaataatcactcttcagaagcagaaaaaaactttttataagtgactcaaagtcaagatgacccatttctcatttatatgatataaacctatacatatcctctcacgtactttaaatcatctctagattagttataatacctaaaacaatgtaaatgctatgtaaatgcctgttatactatgttttaaaatttgtatattttgttgtattatttatatttttgttttttgaatctacggtttatatgaatatcattctctctccctctgcatctatctgtatctacatatgtatatttgtttttttcttagaacataacctagattcctctacagtgtaaatcccttgctttctggttttctgcctaataaaaggctctcatttctatcttggtctggaaatacccccacttccattttttatgaagtaaaaataccgaagatttttttttttttttgctagaagtagtttactgtctttctctacaactcattctaatatttttcttttcaactccctaccattcttattgtcttccagcaatgtctctatgatcatagagagacaaactgcagccacacttagccaggatcatttacatttacttgcatggctctgtgtagcttgctttttatgctaggcaggttcctgaatagtcagataggaattgaattcttggaaatcatgccattgtttaaggatgaggaagaacttactattttaatgaactttattataaaccttttttctaagcaaataatcaccccttactttatcttatctcctatgcaaatcctgattttcacatttaagctttacttaacagtgtcaatttgtatagttatctttaaacaatggtcagtccccactcttataattgaaaagtaagtaattttcatttactttctggcttctacctccagaaaatctcttacctctatctttattttggtaattctcttgtagggactttaatagcccctggaaaatcatcatagctctgcttcaatctgaaaacataactggcaggcatgagtctggaacacatacgagggaacgaagtacccagagccaagttaaatgaactgttgatgacttttctgaaaatcatagtaaaccatgatttcctcacaaaatatagaagtgtctgatttttggcatttaattctcaaacatactcagatacactttccttcttcctctcccactctgggttcatatcatcatataaatcagaaatgggtcatcttgcctttgagtcatttataaaaagtttttcttttctagctctgaagcgtgattattttgcttttagagaggatctttctttctggggccagttgaaacatctgaacaaaataaaaatcaattgaatatggatatgaaacttaacttgtctttttaccattaaatatatatttgaaaaatgtgctcttcttttatagcttttgtcacatcagcatgtaccaattccaaccagagaacgaaatattaatattctgccccaaagtgctgttttccagcctgtgccaaagcagataatgccagtaacagggagttttccaatctaactttcttataccagtcaaattatccatttcaaaaaagcatccagtcaaagtgctcccaataagtgaatattttgcctagagaattttgggcttgagttatccatccctctgaccaaaatctataagcccactcacccaggagatctgagaatgaaactaaatataaaaactggctttactactgggaacccgaaagttcagctagtgagggaaggaaaacaaagaatagaatgttttccgacaatccttgcttttgtgagtggtcagcagatgttttgtgcctctgctgtattccttagctaagggttcacatgaaatgtaccctctgaaggctgtggccttgttggaacgccaaattagtagttattcctcatgctctgaggtctagcttcaccttcagaaccaggtgagcttggtccccacaaagccctactggtacttaagcttcccatttcaagaggacatttgggttcactacacctctccaagccgtctgattaattgcagctgtgtgcaaattagttttcttcaggggctctctcctgctctcagattagcaacaacgtattcagatggaaagcaaataaagatagttgtaaaatgaggacacaaaagagatgcaacatgtttgctcttgatgggtgcattgatgtcagaacaactagggggaaataagaccaccttggtactgttatcatcgtcctgatgatggtcccgtcttgcagaaaagcccaaacagaagcagggcgttgtctaatcactgatgggtttcctgatattattgagaagaccaagcaaaattaatggtgatattatatctggtgaaattattataaattctccctgcagttttaattagctctgctctttttctcctcctgttttaatccaaagcatatgtgtatgtttgtatcagcaatttcaaaattctgtgaagcatttggtgtcatccatctagtttcaaaataggtacagcatgatgcagtgggaagaatgctagcctagaagttaggactcctgagttcctgcctaggtctgccgctaagctgtagtatgaccttggacatgacctttcaggaccttgatttcttcttatgtgagatgaaggattaaaatccaacagtttgttaaatcactctcaactttttagatactattaagtttaggatcccgtggagaggcctatcatccgagagaccatcctatcatcaaaaggtgaatatcaggtcaaagcaaaagaaaccacattaatttttttctgttgtcagctcacaaagctattttaagcctttggacaataagaaatatactttttttcccctccaataaatatacattatccattaaagtagagtgtgttgtgaactgaccttaagggaatttgctagtttttttgtttatttttgttttttacaggaaactaagtcctgtggaacaaaatagaattaccttcatggagcaagtttaacaaattgtcttcatttttggtcagcaggttgatttctaattccctcttattccctttatatgtatttttggcttcctgtctttgttttgcgttgctataaagaaacatgtgagactgagtaatttacaaagaaaagaggtttattagggctcatagttttgcagcctgtgcaagaagcatggcaccagcatctccttctggtgctgcccctaggaagctttcactcatggcagaaggggaaggagagctatgtgtagagatctcatggagagagagggagagcaagagagaggataggaggttcaggcagtttttaacaatcagatttcatgaaaataaaagaactcactcattacctcgaggaaggcaccaagccattcatgcgggatctgccccatgaccaaacacctcctactaggccctacctccaacattggggatcacatttcaacatgggatctggaggggacaaatatccaaactattaaattcctaaaggacataaaagggtgaactgcacaaggatactatatctccaaacaaatgcccagttaggtccaggacgtgttcaacagtgtccaaaatccaaagagaaccagagatagtgtggcttagtagaaggtaaactgattatacacactcagcattgcaagaaaccttaacgggactgttgtccaaccacacaagcattattcaaaaacctttttacctctcaaggtttggttttctagcatgggttgccaagctacaactgcccagagaagtcatttaaactgcaagagactcagctttctcatccttggaagagagaaattggacaaaattatctttaattttttgtttgccttaatatcctcttattctactaaacattttcagtattacagaaatcagctcttggaggaaaagacattgcagggggtgggagacaaagttggtgataccatgtaataagatttttttagatagtggcaagataaaatgttttgaggtttggcaaaaccatctagtagtttcagttctccctgacagtaagaagttaaggaggccaatttctctttcaagtcagaacttcttgttataactgggtagtaaacatactttttaataagaagtggctaaggcttaagaagaccaactgctgatacccagaaatagccaaagaatacttcattactgacagtgcacactttgatagacctgtcttttactattgacagtattctttctctgctgtttttacaagaaaaaaagcccaatgaaatgtaaaccttgttttcttcagttattggtcctaggagtattcagagtaaataaaaaaaaaataccttacgtatacttctataaaatcttttatttgagcaattaaaaaaagctatcttctttcagtcttatcaaggagagcaaattcctcctagaagtcttatttctacttctaatgacaattgctttattatgtgacattcaaaggaaaaacttgaagtcatatttctagtaaagtatttaatttcagaaataatttaaactgttacttcaaagcaaatatctgctattcctgacataaagtttttacccaagcttggtaataaagttatcataagaataatatggattattctcaggatggaatagaatgtcttgattaggaagaaacacacataagaaattcatttttttggaagaaagaaaatctgtgctgtttatctggcaatggaagtcagatcaaaatatatctatatgacatttgaatggggtcacgtgggaagacaagatctgtctgtatgaatatttttagcttctgaatttgacataagaataggatcaggaaaatgaattctgtgttacatgactaagatgcatattagaactcaggcaagatgattcctgtagttggtctactgggaaattaccctctgcctacagctttcaaatacatatatatactatgtgtgtgcatgtgtgtaaatttccaactgagtacatcagcacataaaatacacttgtccaaggtaaaaaagacaaacagttattaatagggcaaaaataaaatggggttatatccaaccatggcataatacttctcattagaaaaaagtgtggcgagctaattaagacccagtgatagttagaaagtctgagaacatttatctttaaaaatggagtggtaactaactaaaagaaggacccagaacctcctaatacaaatatcagttatattccctgagatttaaaaatataataattcttatttctaattcaaaggcctagagtgtaagtagggataacttaacctttttttttttttttaagcctctgtgagaaataacgcagctgtttggcccgtggtattctctttaaaggaaagaagttacaaagacaagaagaaaaaagtggaagagaaaaataaggagaaaaaatattcaaacagtacataactaaaaaaaaaatttttcacaaacagcaaggggaatcttgaaacaaaatagatttgttttaaaatgcaaagaaagagccttacccgggatgaattgctcagttctcttttgttggttgagttcacttccttccatttctgctaactttgaccagctgctaacaagcaaaagagcttcatagaggccatctacacgtgttctcttctgggttatcgcgatgctgacaaagtgcacctaccgcaaattagaagagcacaaagatttctgtgggtatgcctgcaaaactctggctgcgaggcatcacctcagctcagtagccttggatttacatgtgcctgcccccctgcccatggttactgagggtggcctgaggatggattcacttcataacccttttccataattatgtgaataacaaatgagctctatccaatagagaaaaagaacacattttaatactttgtgaagtgatcatgaggaaggggacagaggagttgagatggccaagagagatcccgccctctggagatgtaatagaacagtgacagataatgcaaaaaaagatttaatatatttttatatatttaatatttgtcttctgttgttgaccttagcttttgagtcaacagtaactaagaagcattttgtcatccgacggctcctcttcctttggccttctgtattgtattatctgataaggaagcagcgaacttaaagctcagttcaacgcaatgatccttcatcatagctgggtgtgaagaatgttgttccctcaaatatgacacaaattgtttggtcaatagagaagagaactgcattctatttttttccaaacatctgttatactccaaaacctttctccttaggccatggctgtctgaccaacagtaggtggatttctttgaaatcttatcttctgtagaactggatctcatcctggccaacatggtgaacccagtatctactaaaaatacaaaaattagctgggcgtggtggcaggcgcctgtagtctcagctactcgggaggctgaggcaggagaatggcgtgaacccgggaggcggagcttgccaagatggcaccactgcactccagcctggcaacaaagcgagactctgtctcaaaaaaaaaaaaaaaaaaaaaaaaatagatctcactagaagtattctcaattcagcagtagtgtccagttttgaatcaaataatttatattttgattatgtgtattaagaagctaaatctactcatatacaaaaggaaaatctttagcttttcatgtgttctggctaaaggccagaattaaaaggaagaggatgtcttatctatcagacatttttgtgcctttgaagccataaacttgagagaaacattagcttgttcctgaccctgcactcagcataagcatttgcttgtagcagtcactcttgggtgactataaattcacaaagtcaagaatttgcatcctgaattgatttgtgtaagatgtctaggggaatgctgattttatattggaaacaaggttagggggaagcctcaaaactgcctttatggagttctgtatctcagcatattataattcttacttctaccatactccagaggaatcagtctgggtgacttcataaaacagtattagaaaaattgctagcactacgaaatcaagcaggttatggcagtatattccttgtaagaaaattagtgcattaactctttccaataagtgattgaattagttttgcacataatctgatttatgaaatgctgcactcgcatgctcaagtagttagaaagtgtgtcgaagcagatgttgaactgaagaaagaaggttgcttgaaatgtaaaggtattataaaatggctaatctgtgggtatgacccaaagctttcagagatttcctggcttcactttttttttttcaatttaataaattttttttcttaaaaggtaaaattgccaatgagttaaatgttgatgctctgatgttagcaagactgagttcatatgtccatcgcttattaactccattttcttatcaatatgtttggcttctgtaagtcttattttcttgtttgtgaaaggaagatctaataatagaactggccttatagaattgttgtgaggattaaatgtggcaacccatggttattggtttcgtgcgatgcctgtcacaaagaaaaaacccaataagttgtagtggctatttttcatcttctcattatcaccattacttaagagagaggcaaagtgatagtatcatacaaacattttcatggagagttaaatgaacatctgttttttcttttcttcaattttttaaaaattatactttaagtcctgggggacatgtgcagaatatgcaggtttgttacataggtatacacgtgccatggtagtttgctgcactcaccaacctgtcatctacattaggtatttttcctaatgctatccctcccctagcctcccaccccctgacaggccctggtatgtgatgttcccccctccctgtgtccatgcgttctcattgttcaactcccacttatgagtgagaacatacggtgtttggttttctgttcctgtgttagtttgctgaaaatgatggtttccagcttcatccatgtccctgcaaaggatatgaactcatccttttttatggttgcatagtattccatggtgtatacgtgccacattttctttatccagtctatcactgattggcatttggattggttccaagtctttgctgttgtgaatagtgctgcaatagacatacatgtgcatgtgtctttatagcagaatgatttatacatacgtgtgcatgtgtctttatagtagaatgatttataatcctttgggtatacacccagtaatgggattgctggatcaattgtttttaaggacaggttgcataaaactgactaatgccattcatgacagtgagtttcaaaggcagatagctatcttagtccatttagggtgctctaacaaaatgccacaaagttaggtacattataaacaacagaaatgtatttgtcacggatctggaggctggggagtctgagatcaagaccctggcagatgtgatgtctggtgagagcttcttcctggttcatagatggcgacttccagttatgtccttacatggtggaaaggacaaggggtctttctgcgaccagtttttcaagagaattaatcccacttatgaggtctctgccatcatgacctaatcacttccccaaaactccacctcctgataccattacactggtgattagctttcaatatataaatttgggtggcggggtggggcacacacattcagatcatagcaatggcagctaggaggaagtaaattttgaatcctcatttccatgtaaagacttcatttgctttaaacaatttatttaacttttattgtgctttttctgaaaatgaaataacatttagctacacacagggagggtatgttgtttctaaagtaaaaattaactcttttgtaaatgtggcattgtttaataatagttcaccctgtccaatgatacttagcttttttatatatgtaaataaattattaggttactggtttttctttttcttttggtgggtggggggggtgttaagatcttattctcagtcctcaaaactctgttgaacagggaacatctgccctcattttcaaccttatttctttagtaccaattgcagccatgttataatctttgttttcatccaggtaaagctgagggaagggaaggagaatccactgagaaaaagattttccccaaagagtgactcagcctttgaaaagaaaatcagctatatgaaaagggaagagtatttaatcattcggagcaataattgcattgtaaatattagctcagctgataaggagtagagaaccaagagaatgagggagccgttacattgttttatcttgtttgatgcctttactcagtgctctagcatgggggccatgtctagggagggaatccactgcagctacatttaaggtcacctaataaaccgtgctgttttctttcttttcttctagactctattccttcattttttttttctgaactttaagcaaggaaactgccagtcatagagcatttccttatacacttccatgttactgttatgcagagaaatctgactggcaggctgatggccaggctgctctggaggaaagtaattagctatgtgactttatctaggccaaaaaaatgggataaaaaacatgcaaaaccattcacctatacagacctgttctcaaggcagtgtttaccctagtgcatctgctaattcctttcaagtctggaaaactgttttgtttgacatttttggaatgctgtgatctgaaccattagactatttttttctcctttaaggtactaatattctgatttttaaacaattaaatatgctctaaatttgtctcgcccacttctacatcttcttccaacatttacatagacatccatgcacattcatgcacaccacacaactacaagtcatttcagacaaatggtcttatctaattctttttagtgtttccattttattatttgtcaaattgaatggaacttccatgttttgccctgctgacatttaggcagacttgcataaaatacaagattatttctagctggataagaagctcagctatcagatagtgttgctgatttatacagtaggaggaaggagaaaagaccaatgggtgagtataataaatagaaacgtcctgaagcaattcacttgtagcctatccaaatcttgcaaactctgcataaaacatcctcccagttctctttcaatggaacaatttttcttttctttttctactcttcactgaacatttcctgtattctacatgcaacagtgcaccttttacattcgtttggcttatgtgctcttgcaataaccctttgctgtgtggtaatatctcatttgtgggaacttctgtgacactattaggggacagatacaatggctatgtgcctagcaatgccttcaccgtgctctatttaaatagattgctcatttatttgctactttgctcatcaccctgtctctcattcactataatatctttagcaaatcacatagtgccaggtaaataaatggtactcattcaatattgaccatatggatgaatctctgcttatgaaatatgagagccccgtgcagggtcattctgtccaggaactcatcttctctggcggtgtgagaccatatgtttaacatgaccagtaaggaagtagaaggaatcttccactactttttacattcttttttctttcaaaaagttttgtaaacttcaagtatgtaaaaaaacagttcttatatgttcatacagtttgctttcaacaataactccacacatgtgcattgacatgtaaagatgtttccagtataaagtagaaaaaaatgggttttaaacatcatatataaaattaatcaattttttaacatatagcatacctgtattcaggaacatgttctttggttattctcatttaaacagtcccctattgttgaatacttgatctgtttctattgtttcattttatatataatatatcctataccaaatatcctaatataacttctctgtgtgcttgtctaattattttgtttagataaaaggtttcatatggtgtccacttcatgccattatgtgatatgatttgcctctcagcctctaggaatgggtttttctctaaggatagtggctgccactctatctagtggctgaagtaatatggcttcatgtcatgtggctaacgattcatgccaaaggttgtccgcatcttatgtatcagtgagttatctgacacccctaatagacgcttatttcttttttcaaaaagcttgttcctgagctgaatttccatgatcagatggtggcaagagccaagtcttctcacataaagagaaatcacattgaatctgctacctacgaccactggccaaggggtcttgtcatcattgcattctggggaattggattcaatttaaaaagttgaagctgcttgctggcttccttcctggtagttttgaatgtgtaatctcacaaagatcttcttagctctggcaaagctgagcctgtctaaaacatttatgttagaatttacatgagttcatttgtgctggcgtcaaacatttcttgagtatttaccatgttattggctgatcttaaagccaagctacaaaggactagtaggggttagcaggcaggcaggaagaagaagggcatggttggcagagattgccacatgcacagaatatagtggtgaacctacatggtgcatttggaattgcaagtagtctggctttgctggaagtgggtttgcaagctgaggagtaacaagaaataaggccgaatagcataccaggaagtggtagatggcagagacccctggatcaccgtgatacttatgacactacttgctcacttgttttttggtttatttcctgataagctttgagccagaacattaatgcaaattcttgttcttgtgtaaaaattactgcaatgacttcccattgctcttggagaagacaaaatccttaatatggcctacaaggtccagtacaatctgtctcctgcctctgtagtcttattcttcactaggtctgccttcttcctcccagccctactggggcccattctctgggcttcaatattacagaccttactttaatttcactaatgggaaatgttgctgccttccaacaaagggcttttgcatgtgctgtttatatgaaatcctcttttcttcctgccactcttgcctattaatgttcttatttctcagcactcacgttatttttttactcagagaaatcttccctgagttccctgaccatgtcagatttttcacttatatgctgtcataacctcatgcatttctcttttacagtgctataaattgtcagtgacacatttgtgtaattaagtgatgaatgttcctttcttcctaataagtaacatcatctataccatcattattaaatcagccagcatcagctggggtacttatcatatgtcctatactgttctaaacacattatatgtattaattcacttaattctcataacagtccctattaaatggataacactgaggaataaaaaaagtaagtcacccaaagttacacagctgataggtgatgaagttagaattagaaatcaggggggaggagccaagatggctgaacaggaacagctctggtctacagctcccagcgggagcaacgcagaagatgggtgatttctgcatttccatctgaggtaccgagttcatctcactagggagtgcaagacagtgggcgcaggtcactgggtgcatgcaccgtgcgcgagccaaagcagggtgaggaattgcctcactcgggaagcgcaaggggtcagggagttccctttcctagtcaaagaaagtggtgacagacggcacctggaaaattgggtcactcccacctgaatactgtgcttttccgacgggcttaaaaaatggcgcaccaggagattatatccctcacctggctcggagggtcctacgcccacggagtctccctgattgctagcacagcagtctgagatcaaactgcaaggcagcagccagactgggggaggggcgcctgccattgcccaggcttgcttaggtaaacaaagcagccaggaagctccaactgggtggagcccaccacagctcaaggaggcctgcctgcctctgtaggctccacctctgggggcagggcacacacaaacaaaaagacagcagtaacctctgcagacttaagtatccctgtctgacagctttgaagagagcagtggttctcccagcacgcagctggagatctgagaacgggcagactgcctcctcaagtgggtccctgacccctgacccccgagcagcctaactgggaggcaccccccagcaggggcagactgacacctcacatggcagggtactccaacggacctgccgctgagggtcctgtctgttagatggaaaactaacaaacagaaaggacatccacaccaaaaacccatctgtacatcaccatcatcaaagaccaaaagtagataaaaccacaaagatggggaaaatacagagcagaaaaactggaaactcttaaaagcagagcgcctctcctcctccaaaggaatgcagttcctcaccagcaacggaacaaagctggacagagaatgactttgacgagctgagagaagaaagcttcagacaatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaacgcagaagcctcaggagccgatgcgatcaactggaagaaagggtatcagcaatggaagatgaaatgaatgaaatgaagtgagaagggaagtttagagaaaaaagaataaaaggaaacgagcaaagcctccaagaaatatgggactatgtgaaaagaccaaatctacgtctgattggtgtacctgaaagtgaccgggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcagatctctcagcagaaactctacaagccagaagagagtgggggccaatattcaacattcttaaagaaaagaactttcaacccagaatctcatatccagccaaactaagcttcataagtgaattagaaataaaatactttacagacaagcaaatgctgagagattttgtcaccaccaggcctgccctataagagctcctgaaggaagcgcttaacatggaaaggaacaaccgataccagccgctgcaaaatcatgccaaaaggtaaagaccatcgagactaggaagaaactgcatcaactaacgagcaaaataaccagctaacatcataacgacaggatcacattcacacataacaatattaactttaaatgtaaatggattaaattctccaattaaaagacacagactggcaaattggttaaagagtcaagacccatcagtgtgctgtattcaggaaacccatctcacatgcagagacacacataggctcaaaataaaaggatggaggaagatctaccaagcaaatggaaaacaaaaaaaggcaagggttgcaatcctagtctctgataaaagagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagattttaacaccccactgttaacattagacagatcaatgagacagaaagtcaacaaggatacccaggaattgaactcagctctgcaccaagcggacctaatagacatctccagaactctccaccccaaatcaacagactatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacatactagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctaccagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagagaaaaagagagaagaatcaaatagatgcaataaaaaatgataaagaagatatcaccaccgatcccacagaaatacaaactaccatcagagaatactacaaacacctctactcaaataaactagaaaatctagaagaaatggataaattccttgaaacatacactctcccaagactaaaccaggaagaaattgagtctctgaatagacgaataagaggagctgaaattgtggcaataatcaatagcttgccaaccaaaaagagtccaggaccagatggattcacagccgaattctaccagaggtacaaggaggaactggtaccattccttctgaaactattccaatcaatagaaaaagagggaatcctccctaactcattatatgaggacagcatcatcctgataccaaagccgggcagagacacaaccaaaaaagagaattttagaccagtatccttgatgaacattgatgcaagaatcctcagtaaaatactggcaaaccgactccagcagcacatcaaaaagcttatccaccatgatcaagtgggcttcatccctgggatgcaaggctggttcaatatacgcaaatcaatcaatgtaatccagcatataaacagaaccaaagacaaaaaccacatgattatctcaatagatgcagaaaaggcctttgacaaaattcaacagcccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttcagctgataagcaacttcagcaaagtctcaggatacaaaatcaatgtacaaaaatcacaagcattcttatacaccaacaacagacaaacagagagccaaatcatgagtgaactcccagtcacaattgcttcaaagagaataaaatacctaggaatccaccttacaagggatgtgaaggacctcttcaaggagaactacaaaccactgctcaagggaataaaagaggatacaaacaaatggaagaacattccatgctcatgggtaggaagaatcaatatcatgaaaatggccatactgcccaaggtaatttacagattcaatgccatccccatcaagttaccaatgactttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaagcaaaacagcatggtactggtaccaaaacagagatatagatcaatggaacagaacagagccctcagaaataatgccgcatatctacaactacctgatctttgacaaacctgagaaaaacaagtaatggggaaaggattccctatttaataaatggtgctgggaaaactggctagccatatgtagaaagctcaaactggatcccttccttacaccttatacaaaaatcaattcaatatggattagagtcttaaacgttagacctaaaaccataaaaaccctggaagaaaacctaggcattaccattcaggacataggcatgggcaaggacttcatgtctaaaacaccaaaagcaatggcaaccaaagccaaaattgacaaatgggatctaattaaactaaagagcttctgcacagcagaagaaactaccatcagagtgaacaggcaacctacaaaatgggagaaaattttcacaacctacttatctgacaaagggctaatatccagaatctacaatgaactcaaacaaatttacaagaaaaaaacatacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagataccatctcataccagttagaatggcaatcattaaaaagtcaggaaacaacaggtgctggagaagatgtggagaaataggaacacttttacactgttggtgggactgtaaactagttcaaccattgtggaagtcagtgtggcgattcctcagggatcaagaactagaaataccatttgacccagccatcccattactgggtatatacccaaaggactataaatcatgctgctataaagacacatgcacacgtatgtttattgcggcattattcacaacagcaaagacttggaaccaacccaaatgtccaccaatgatcgaccagattaagaaaatgtggcacatatacaccatggaatactatgcagccataaaaaaggatgagttcatgtcctttgtaggcacatggatgaaattggaaatcatcattctcagtaaactatcgcaagaacaaacaaccaaacaccgcatattctcactcataggtgggaattgaacaatgagaacacatggacacaggaaggggaacatcacactctggggactgttttggggtggggggaggggggagggatagcattgggatatatacctaatgctagacgatgagttagtgggcacagcacaccagcatggcacatgtatacatacgtaactaacctgcacaatgtgcacatgtaccctaaaacttagagtataataatgataaataaaataaaaataaataaaaataaaaaataaaaataaaaatacaaaaaaaaaaaaagaaatcaggcagactggatctggaatctgttctcttaacctctctctctgctcaccggtaggttatagacctaacataaagtagttgctcaataaatatttgttgaaagtataaatgaataaactaattaataaatactttatatgtgtcccactcttaactggggaaaattgggtgggtagatacaaaagaaccctagtagactgttcgctggcaggaatgtgttctagaggattggggaaagagaaacccccgaataactgtacgtgatttatgatgaaaatctttcaagtagtggaaagttataaaatgctaaccaaaagattagttatttggtttatatgttgatcactgtgatctttcccaatattgactggggtttgttgagtgtctgtaatcccacaggtggatgttcatgatctgaagtgacaatggtatatttgctcagcatttcctgtacctgaaacaacccttgaaaactgaaatagaaagagcaagtcaatggtaatatcatccagcactctgccaggcttatggcgaccttgcttacccgaaagcaaattacttccctctcatttctatataataagtactttacggctttgtgttttcatgcattgagatttccctaggagtctgagaagatgtccaggaataaaagagggaagaacaatgattaaactatttctaggactttagacattggattatattcagaaacccataatcagaccgttaatgaatgtcttcgcattcattatcagactctgaaaaagcatatccagtctctccatggactggccttcacatatgctttgctatctggtagaaatatctgcccaaaagattattttttatggaaataatagtgcacatgcagattctagatattattttctatttatcaactgcattcaggcagtgctaagtagatgactgatgctgaaattttactagatgatctttgctctctattttgttatatgacacatggggcaaatacgtgagatgagcaattagtgaaattctggaagggacagatttatgtcatactattgaaagggacaggaagtggattaagtatgatatatatatagtatgtgtgtgtgtgtaggtgtgtgtgtgtacgtataacaagttagtttccttttcctaccactgaaattgttaaatggaatggtgacgtagacactttacttctctactcctggacttactagtaaagaagaaatatataaaagagcaagatagtattgatctggggtggtactatggtatgtattaataccataccgtaattctatgatctattaatgtcacaaccagctacatttagctggcttttatatacgaatgtgcatagtactgttttgtattaaatatcaccagaagatatttgtcacataaaaacagtgagattaatgtttatatattttggcactcatgctagagttgaatgaggttctgtctgtggggataattctaggtatcctggaaaacctccacatatacaccaaacccagaatcaattcagataggcattactgttcgcagtcatctaatttcaagttagggtagtaggatatggattggggggcgtgattcttagtgccagagaaagattaaattattcatagggaaagatattcagcctaagatggataagactgaaatcaggtgcctggactctagaggattgggctctaaccgaaaaaaaaaaaaaaaaaaaaggagaatccagtaggaattcattgagtaagccaaggttacaatctgctggacttcagaggtagagttctagatgcccattttaccaccctaggtcagaagtggggagcagagagacagaaggctataagtgaggagacagtactgagacactaagtagacattctagccaactctgtagaggattctcatgttatgagctgaagtagaaaggctatgtttgaagattctgtctgattttgggcatcttggttctagatctatcataggtgcagattaaattgtttccaggctgtacttgatagttggtaaggatcaaacaataccctcacataacttgtcctagaactggttgtgctatggcatcattgtagtcccacatcctagcatggagcctaaaaaaaagtaggttcttcataaatagccaaggaatgaattaatgagtgatgggatgagtgtgagtggagaaataagcaaaattcctagaaatatggggtgggagtatggcagacaaacgttggcatcatccttcaaggaccagatcaaaatgccacatttccactacagctttctctgagttaattacttctctccactgttactatggtgatgtatttattctgctttaatagcatttatcaatcattttgtggttatattttatgatttctctcttcctcctagactatgaaatccttgactgtagaattgttggtttgtacctacattactgcagatagtatctggcaagggctgggctctcaataaatattgaccaaattgaggctgtaaagattccaatggaccaatatggcttgtgacccatgcttcatttacctaaatgaggccacaaggctctgtgatcacgtggcagtcaaataacaaaactctccaaaatcaggatttcttcttccattccttcaggttccctcccccatgggcatggttatctcatcctttacctcctggaaattatatattggaggttgtcagtgtgtgctgttctgtattgccctatagttaatgcacttctctgacgtagaggactgagctctctatagaactatgcagtgtcaaggaccctctgccttgacatagatgcttggaccacactgttaggtaactgagaagacaaagaatgtggctagaggctaaaagggacagagcaggaaaagcatgaagggcatgaaggaaggagcttgaatttttttcccaatgtactggggagcccaggagtggcatcactttgtactccagcagtgacattttaatttacaagccaagaatgcactgatcgccaactgcaaaaattgatttggttgttcatctgattcaacccatgtcagagtttgaaagtaattatgatagtggggctgataggcaggcaattacatttttgttctcttgctttctggctccttctccctctctttcccttcccacacctccacctgcaaggttgttcttgtcaggaaggcaatgtaagcaggagacgagagagtaatctttggagatgtggtatatggactcttgtggcagaggctataataaataatagtatggctggttctttatcctaatttttgttagcctcttatgaactctaaccagataaaagatgcaaactattttgtctccttctttaaagtacaaaatagaaaaagcacatgtactgtaaggcagtttctgtttctgatttaaatttgagttgtctttgcaacatctatagattcggtgtctttctaaaaaggtttgctccaaatcataatacaaaaggaacctgggatagggagagatttaggcaaagctaaaatccatctgagttggggagcagattccatgggagactgaaaatgtgtttcaaactgtagtgcaagaaattgaacaaagtattggaatttttctaaaaaaaaaaaaaggttcctttgctgaaagtagtacctggcatgtaaacctaaagtaatatagaagatgaagtggaaaagtatatcacaaggcaaaaattactttttagactgatgaagagatggatggatggatgtgaattttttttatctatttcttattttgaaggttatttatttattcacaaacactggaaaattcagtgtttttcactgagcaaaatagcttgtctggtccaaagccagtaaaataagaattttgtgggtggggtatctactccattagtatagcaaatgttgagatatataaattattttaatatatttattttattgacaatataaaaaaaaatttaacaggctccacaccaaggtcaatagaattcagaagcacatctgtcctcccaggaaacttgtggtttaactatttactatagctacctcaagattttacagaaaaaaaaaaaaatgagaccttctcttgaaaactaccatatcccagatctaggcttttctatgcactgtaacttctctataaacctcctttctactgactgccccacttcaatttggcacatacaccctttaaccagtaagcatgtgcatgtagtcagtgtgtcagacaggtttggctgaattgatataagactggtagcataggctgggcgtggtggctcacgcctgtaatcccaacactttgggaggccgaggcaggtggatcacgaggtcaggagtttgagaccagcccggccagcatggtgaaaccctgtctctactaaaaatacaaaaaattcactgggcatggtggtgcgcgcctgtaatcccaactactcaggaggctgaggcaggagaatcacttgaacccaggaggcggaggttgcagtgagctgagatcatgccactgcactccagcctgggcaatagagtgagactctgtctcaaaacaaaaaaacaaaacaaaacaaaacaaaaaaagatgagcagcatggaacatgatgttggcatgaggccctactacccggcagcagactatcagggaataaactagataaacctggaaaatgttttaacttcagtttattttattcacattaagtaatggagtagcatgttgtttgtttgtttgtttgttttacctctaaacctcctgtatagcccccttttaaaagaagggcaggggaagaggcttaaaatatggtagtattgactcccaggcctgttcagtctatacgaattttcaggctgtatagtttaaaaaaaacattgttcaatttcttatacgtttttactagtgatattactttagaaatgggcctcgaaagactcaggttacttttagatttgttcagggtttaaagcttcttttaggcacttcttgggcttcttctacctttcactgtaatatagtggtgaagagaaagactttggaatctgatagatttgggtcagaattgtagttttgccactcattacctttgggtaaccaagctctgtgaacctcagtctcttctgcaaaacagaaatggtgacatatttcctaagtctcttggcaggattaaatggaatacagtgcacaaaatactcagcacagtgcttggcacatagtaaatgccgaattaatggcaatgaattgttgttgttgttgttttctttttgagacagagttttgcttttgttgcccaggctagagtgcaatggctcaatcttggctcaccgcaacctctacctcctgggttcaagtgattctcctgcctcagcctctcgagtagctgggattacaaacatgggccacccatgcccggcttttttgtatttttagtagagacagggtttctccatgttggtcaggctggtctcgaactcccgacctcaggtgatccgcccacctcggcctcccaaagtgctgggattacaggcgtgagccaccatgcccggccaatcaattgttattgatttattactgagattgctttaaataaattcatccttatttctgttgtagtctttaccttgtctccagatctttggaagtctcaggttcatttgtctggactttgggggttttgtttaaaactgcctagtctctgcagccacatcctccaccactgtagcacatgatcaaaaaacttttctctgaggatactgagtatttcttagacctatgtcactagctccctgggaactctctctacccccatcccatcaactctctgaccacaagttttcaaggaatcttcctcattatactcatctatcattcttgcagttttctgtctcatcttgagctgttggtcaagagtagaccagagtatccatttctcaactcatttcttaataaggcaacaccatgttcaatgggcattcattgggccagttgaggctcctctgtaattttattttattttttgagacagagtcttgctctgttgtccaggctggagtgcagtggtgcaatctcagcttacagcaacttccgcctcctaggctcaagcaattctcctgcctcagcctcccaaagttctgggattacatgtgtgagccaccacgcccacccttctctataatttaaatgttatctctctttataacattttcataagaggatccacaattctattttcccattcacttataaagaacaaaaatatatccctaaggttccacaagtacctctggcctttggggaaaaaaaaaaaattcacagatgcttttttgaggaggtaattatttgtttgttgtgtccttgctattcattttgagatagatactcaagctctacacctcttagcttatataccagtttcaaatttatgtctttattatttattataaaatcttttaccagctgggcatggtggctcatgcctgtaatcccagcactttgagaggccgaggcaggcagatcacaaggtcaggagatcgagaccatcctggctaacacagtgaaacccggtctctactaaaaatacaaaaaaaaaacaaaattagccaggcgtggtggtgggtgcctgtaatcccagctacttaggaggctgaggcaggagaatggtgtgaacccgggaggcggagcttgcagtgagtcgagactgcgccactgcactccagcctgggcgacagagcgagactctgtccctaaataaataaataaataatctttaccttgaatattgagatgggttcaatacaatctcaatttagaatacttaaaagatgaaaagttccataaaataaattttctaatcaacagaaaacattttgttaagatgttgctgatgcaaataattctagcatgtatcactgttagttttctatctttgaaaactatcattcaactaccatcgtagttactagacttccattcaggatcttgcatgcctaagagtcatttcactgccaaaaatgaggaaatatagaaaactgagctgtgtttttatcatctaccatttcaaaaaaccctgtggaaaaaatatttcttttagcaaatctcagacattatcttgacttatatgtaagatgtacctctctctttaaatccaagtgcattgaaacttctggctcataaggtaatttttttttttaaataattaactaaacccttaaaactacatagaagtctactttgttttataaattaaccccattattttaggaattaatatagctttgtcttgtgagatgctgaagttatttttcctggttcttaatattcagtctttccgcttatctatttaattcctgatcactagccaaactatatactacagtttggttcatccaatttaaatagctggcctgtaactaagaaaagaaaaatatattttgtgaagaataggtatgaggtagagaaattagtggtagtatgatacgggaaaagagtaatgtcaaaatgcatggtaatttatgtgatatgccgaggactgcaagaagtcaagaaagaaacataacaagctaacagctgtcaccaacaaatagcaattaatttcagcattcattcccttgctcatgcttcatgaaagtatataggtaaacaggattcgtatcatgttctattttcttctctgggcctcaggcttccagccctctgagctactgtcttataacattctgaggatgtaagaaagaacttgatcctgttttctttttcagtctggagcagagacacggtgaagttcagtaaggtctgacacccattagcattttgtgtgactcaggatacgaatcaaacctactgttgtggaagcagctttccatataaatctaattcccaccaactcctgccaccaccaaagctaatagtcaagtgcttgtattgctgatagcaaaggtccaagattattcttattgttttactggggctacttatcaaaatctatttacttgtctattctatggatggggaggtggtaaagaaaaggcttaagtgtcctacagagattcattctatgctgcctcaaatgctttgaagcagtacaatttctcttttaactgcctcgatgtaggtgaagagtcttgcaggatatgttcactgctgaagagcaagcctgcctcattcataaccactagtagctgacaacctttggattctttccacagcttgaaaattcctccattccttgaaagcaccctgcactaatgctcgaagtattaagtgtgtttttatttcctagaaggatgcattttacacaagtcacttaaaagcttctggaagctttaattacaggttgactaatatttagaagaattgaaatacccctctctctcctctgtggtatgcatgagccagattctggttcattaaccagaagtctattacttttcccctatagtttcatggagtaaaatggtagatgcaaaccaagagaggtcaagggacctgagcttggttctgtctttgtcacaactaagagtctgaccttggatgagtcatggtaagactctgtgtcatatataaagagtattctgagagtaaaacacgcatacaaatgaaaagtatggttattatggtctcttgaatattcttagatcaatttcacccattggatggggctagtatatggttgatggatggtatttgtttcatttatctggcatgcatttaaatcttcaggtgcattaaacgaacaacacaaatttggtatatgattttcatgctctcttgcatgatagatataaaatcttaatcagtgattgtctggaaaccacagtctccaaaatgctgcctaggagtgctaaagagctgtcagatctaacttatatgagttgacaacatagagaagagaaagaagttgaattcagttaaacctggaaggagaaacccatagggtggaattatctgaatttgaatttttctgagttttattcccccctacattatgacacactaataagtggtctaccttgacccagagatacgaattttggcctcatttgtagaatagcacctggattcaggaataactccttgaagtgtcccccttaaatctctatgtggcattcaatgttcacttactcatagaccaaggagataaggacatttatcttctcaggtaaggtccctctgttgaacactgaaacaaaggggttacattaccactgcctatctttcagaaaaatgactgctgtgatagcataaatgtcccgagagctttgctttgatagaagtgtgtttttaatgatatgattttggtgtctggccctctgtggatagcttggcatgtgtcttgttctatttaaacagcactgactgataaagtggacgttaattggcagttagtgacgaggctgcaggtctttgttacccagcctttcagctaactgatcattaactaggaggaaatgtgtgacccagaaggtcattactgttattacgtgggaaaatacatttaaatgttacagattgcttttttatgaatcaggtgagcatttttagaaaagagagagcttgatttacaatggagtctgttttcagtcctgctcttttcctgtccctttgaagactaaacggtatatttctagattcccattgctgtattgcctagaacctcacaatgttgatattgactaaaaaacagaaatttcttcaactccattaagagcttttccaaaatcttaaaatttccaaataaaatcctttcgtctggatgccactcactttaacaagctttgagtaactttttttaatgaaaatgtgatagaaagtaatgtaactgcatatgttttattatgtaaaattctgatagtatcatgtatgtctttagaatttccgttgtcacacattgtctgtgctttgtaggattttgcagattaagccttagcactcattttgtgaggacagtgaatcctaattcctcttcttcattctttctgtgacctttttgattttgcctctttagtaatctcctcactgcccttgtaatgcaaaaaataagaataaaaatggtctgtttgggtgctgtgagtcttggcaattaaaacttcacatgaaatttgtctcctgagagaaaatattattctcccttttaataaaaggatacaattaaatactccctgaaacctctctccttcaaatatattgtcttatgtaaaagatggaaatggagccttgtttagctgaaaaactgaagagccaaaaacatttctaactataaattagtttatgcatattaaatatcccagccttagctctaataaaaacaaaaaaaatgtgaagcatggtgtgctctgtggttattaacctgttgttgaaaccctgacttcagttctaggcccttagcatgattacttctttccttctttgggttgcatgatgcttcaaggtctagaaatgccaatgtctttcccaaggggttttaccttttacctctgaagattgaagaaagcaactgagttgttcagaaatctctttaaattagatttaaaaggtactgggtttatttttgcatgtcttctttattttttcctccaaagattaagattgtattttagaaggctcttttggctcctttaaaaagaaagtttatccttgtatcatataggactgaaggagataggctgcagtttgaaggcaagagcatctgatctccaaagaatcagaaaatctcttcttttgttgcatttgtaggtactttttgttgtgttgcttttttttttttttttttttttttaatacaggtaaagttcaaacgagcacagcatggtccaaatggtgtttaaagctgtctaagtttcctttatgtaactttcacttcaacaagtatgttccagctgggagtctatcgggctgttaaaattaactttattcttcttttgttattctcatgcacacacacatacacacatgcctacatgcacatgtgcacacagacacacaggtgtgaacatgaccatttaatcacatccagcagggctgaatgtcactctgcggggctttattgactgttgtacaggctaaacatttcattcagttgcaagacagaaaaactctgcaggatgaatttcaaaacagagagcagaattgttacccacagataagaattctttgtaaggctttcaccttctcataaaagtgttagttaagaagaggtgaaaacaggtattccattcatctctgaagtgtatgcagtaatggcctcattcggctgagatttcccagcagcaaaaaatgtgcttggcagaacagttgctctaaatacctgggacatacattctttctaggattaaacaaataatacttgctgccctttgtataaaaagatcacttttctggtgcaccattagtgtacatttgatttgatttgtttgttaagcagcaaaggtgggtttccctggagccacttacacctcctctcggtcctctttgcctctggctgtatatgcatgttcattctaccacctgatgacttcatgcttactctgtgttctaactaaatcgaatgagtctcttattcccattccttcctttttactttcctgcctctaggcattaatttgtgccatttacctggactatctgctcccacctttgactattaatatcctatttattattctatcaaagccaaagaccatcatccccatgaattcctctgacatcccactcagaatctatctctctttcctcagagcacagttttttttctttttactatcatttaaggacagttaggccaaacacttacctacttaattataagcttcttgaggatttgggccacttcatatggcttttggttttccccaaagcattagctccaaaaagaaaggttgaatgaatgattggtgagtcatcaaccttggcatagttgggactaccctttgagaccactaaccagaatttttctcaatgaaatgaaatttattccccgacaaattgactgcaccatgttagtctccttaacatcatctgctgaaccatctcttaagaaacactttgatactagatggtaaataaccactgtgtcaagacctccaagtgccctttacctccaggtcacctgtgttcctgcagcaagacacacctctgtccccaccatgaggcagaatgaggcttgggacagataagacttccagaacccagctccagcactgtggccactgtctgattaatcagttcttcttctgcactgataattaaatactcactgttaaattttatattacccttgctagtatcattgttataaccaatgtgacagccacaaaagagaattaaagctatagactgtttatggactgtcttcacttcagcacagcagggaagaaaccagggatctgaataagtactagggatccttgctcattttcccaatttggctacaaaagttaatgaaattggggccaacgcttaaaatgcagatattgttatggatacattttatgatataaatagagatacacttgtttcatggaggggtaactagggacttagatttcatttggacctatgtgtgccgagcaattggaagcatattaaaactgttttatgtgtaagcatttattgcttttgcctataagatgttgcttatgtgggaaattaagagtccagtccaatgtattcctgggtatacagcttatgaaggcatttaaaacctaaagcatatttattctgcatttaaaagtgtttagagactgccttgtgtgttaatgtgtgctgtgcgactagcactatttaaatcctatccccctgcatgcattaatgtgtgcgtcgaagggaagaagagcaagggatgataaactctgttaactgcccaatgttcaactaagatttatgtaagaaagaacagtctagtgcattaatgtgaatattctaagatagatgtttatcttaatggactcagaggtacttacaaacagcataattgctgaagtcattttacagggcatttattcagagtgattacactactcttacttttctttacataaagaattccacttaagggtttaagtgagacaggctagtgtggccaaagaatcataggttcctcctatctgctgctcagcgctaaggctatttgaaaggaggagaagcaaaaccccaaatctccattttggcactttgcaagaaattggtccaaatgttcaatcactccagttttcagatctacatgatatttgacttactttaaacctatagtcctgcaaataagaaatttatctctctggtacatggttgtagaattcaaacattagttgtttatggacttttatggaccactgaggcattttctgtcttgaaagcaaatgtactcttccagagaaactcctgttctttttttaaagttttatttttaactgacaaattaataattgtatatataggtacgacgtgatgtttcaatgtctatattcattgtggaatgatcaacccaggataattaacatactcatcacctcaaattctttgtagcaagaacatttacaatttattcttttacatgaatgaattttaaaatatataattttgaaataggcaattcattattaactctagtcaccatgctgtgtaatagatcagaatctacttctcctgtctgaaactttgtagtcttcaaccaacatctcctcattccccattgacctttcctttctcagcctctgataaccaccactctactctctatttctgtgagtttgactttttagatttctacatacaggtgagatcatacgggatttgtctctctgtgcctggcttatttcacttagcataatgtcctttagctccatccacattgttccaagtagcagaatttcctgctttttaaaggctgaatattattccattgtgtgtgtgtatatatatatcacatttaaaaaattttattcatccattaatggaaaaccttcattcttgaaaaaatagcttataaagctatttatgtccctgatacctccaaagatcagaatgagtaataatctcacaaggatgggaaatacttcctctcttccaccttttgcatgtccatcctttgaacatgactcctggtgtgttagtctagtctgttctcatgctgctaataaagacatacctgagactggctaatttataaaggaaagaggtttaatggacttcacagctccacatgactgggggggcctcacaatcatggtggaagacagaagaagagcaaaggcacatcttacatggtggcaggcaagggagcatgttcaggggaactcccctttataaaaccatccgatctcatgaaacttattcactaccacaagaacagcatgggaaaaacccacccccatgattcaattacttcccaccgggttccctcccatgacacgtggggattatcgcaattcaaggtgagatttgggcaggacacagagccaaaccatatcacccgtcttacccaattctgttgaaataaacagacatttcctgagtacctgctatccattcaagttttttctatgagctaggctctggtccaggagtatagtaaccctacgggtgatttcagaccaataataagtaacactattaagaacacatcacagaagagtaacatctctgactcgctgatatccatttcaaaccacataacaatagcatgaagtagatgtcactgactcaaattaacagaagagaaaactagggtgcagtgtttgtgattaccttggactctcaccataatagactgagctcatgttttctgactcaaaacacaaaacttttcccttgatatagttgcctctagaagaagtcccttgtctccctcaaatagcaatcaagtagaagggaaaatagtgtaagtcaatatatattaagtactttcagtgtgattccaagaaactattgagttgcgatgctaaagggagcattttatttttcagccttgggatcagaaaaacattacataaagaagtgtttgggttggaccttaaaaaaaggtataccatttcagcaggtataaatggaatgaaatgcaaatagagttgggtaaggagcagtataagccaaaacataaagttatgaacttaatacccttgttcagagaattgaaaacatttaatagtcagtatgtggaggcatttatagggacaaatggtaatggaagatgatactacaaaattacactggagtccagaggtggaggatcttgaattttaattttttttaagtctagacttttgatagtgagataaatttgaaccaacagagtgaaacatgaaaactatatttttatcctggaagtactttctagagttcattaacaggaggaggtaagggtagacagggagtctgggtagggaattttaggattcatccacataagcaaccagggaagtaggaatgaaaactggagtaacattttagagatggctttgcaggacttggtgcctggaggtgtgacggggagcaggaaggatttgttacaggaaagaggtcccgacttagaccccaagagagggttcttggatctcacgcaagaaagaattcagggtgagttcacagggtacagtgaaagcaagtttcttaagaaagtaaaggaataaaagattggctacttcatagacagagcatccccaagggctgctagttgctcatttgtatggttcttgatgatatgctaaacaaggggtggattactcatgcctcccctttttagaccttatagggtaactactcttgtcccttgatgatatgctaaacaggccatggcatttgtgaactgttatgtcgctaatgagagtgtagcagtgaggatgaccagaggtcactctcatcgccatcttggttttgatagattttggctagcttctttactgcaacccgctttatcagcagggtctttatgacctgcatcttgtgctgacctcctatctcatcctgtgactcagaataccttaactatctgggaatgcagcccagtaggtctcagcctcattttacccagctcctattcaagatggagttgctctggttcaagcacctctgacagatttaaagatgaccctgagagtttgggcttgttcctagagagtaaggacaccatagacagaggccaggaaggcagcagagggaggagttaatcaattcagtctgggatatgctgactgctcatgtttccaagatatttaatcaaaaatattgtcccttatgtgttagtctatgttctattactataaaataaacttctgagactaaataatttatagagaaaagaggtttatttggctcacagtctgtaggctgtacaagcagtgccagcatctgcttggcttctggtaaggcctcaagaagctttcactcatggtgaatggcaaacagggagcaggcatgtcacatggtgagagagggagagagggagcaagggagacaggaggaggaggcgccacccttttttttattatttaattttttgagagggtggcacgatcatggctcactggagcctcaacctcccatgctcgagcaatcctgctgccttagcttcctgagtggctgggactacgggcctgcaccaccacacctaatgtttaatttttttttaattttttgttgagatgggatttcattattttccccaggctggtctcaaacttctgagttcaagtaatcctccctccttcatccccaaaagttctgtaattacaggcgtgggccactgtgtctggcccaggctctttttttttttttttttttttttgagacagagtctcgctctgtcacctaggctagagtgcagtggtgtgatctcagctcactgcaacctccgcctcccaggttcaagcgattctcctgcctcagccacccgagtatctgggattatagatgcatgccaccacacctggctaatttttgtgtttttagtagaggcagggtttcaccatcttggccaggtgggtcttgaactcctgacctcatgatccacccgccttggcctcccgatcttgtgatccacccgccttgacctcccaaagtgctgggattacaggcatgagccacctcacccggtccagctcagactcttttaaacaaccagatctcatgtgaactcattactatggggagggcaccaagccattcatgagggatccacccctctgagccaaacacctcccaccagccccacctccaacattagggattatatttcaatatgagatttggaggggacacacatccaagctgtggtgggcattgtaatcacggtggagctttcctcatcaggctgatacccaagtcccacccctgggtattgctagaatgtcacctggtgactaatgagtgccaaaggaggagaccaatcccgtggcgcccttgcatcctctctgcttgtggttgctctctctgtattgttctctctgttatgattggctctaacttccattaagagaaaacttgacctgcagtgactgaagacaggatacattttcttaaacaagaattccgaagtttagagaacataaaactgcttaatttggctcctataataggagccaaatttttattttataataaataattataataataattatatattgtaataattataattaattatatattgtaattataattaattatatattataataattataattaattatatataataaattattttattctaatttattttataattgtcaagtttaatatttgacaatatctgagtcagcttcccagttcttttcttggctttccccccaacttgccaccttatgggcacaagctgattgctgcagctccacatgtcccgtgcaaacccaaggaagaagggaaagcagtcagaccagccaagtctttttcgttttatcaagaatagaacaagcatttctagagcctctagaggatttccttgtttagctctttgtccagagctaccacatggccacttttagttgcaaaggaggcttggttaggccggtcacattgccagctctcgcaaggaggaagaggggaatggatattgacaatgtctgcaatagtcatcttccctgctacgctgaaagcactttaaaggcaaggaccaagctccgtcaggccatacttatgtccgtgctatgccacacttctcacctggcactttgctggacatatgaagacctgagatgagaagggtttgaggagacacttcctgcccactgtgctaagcactttcttgtgtcttttgggttctctgagcagctgtaggagtatagaagcctccagatatacgttaaactctttttcagcacctctcaaaacagaaaaaaaaagcaagaaaaagactacaagctgggaggaaatctatgctgctgtaaaaatagaatagggctggagtgcattcttcagtaatgaatgcatgaaaagcagcctcttcaattataaatgtggcttctcttgtttgttgcccagtaattctgttttattgatttctgtttacttccaatcacctcaaatgagactgtgttgcttagagatcttgatccctaaaagtttgtcattaaagctactctgctgtatttagttattttttgctcaaagcatttgaatcaatatgtatacaaacgaaacactttttcctttgctccctagaagactacaagaaaaaagaatctagaaaaactaaataaagatgcttagatttttttaaaaaaagtcccagcaaatgacatattgatttctttcaaagaggcagagtgtaaattaaaaatatttttctgacacagtttttaaagatgccactgactcagcagagtttgtgcttattgactttctcttcctagagggccagggtggaaaggccgcccacttttcctaagatcagctggctttcaaaatcctttgagggaagttagccttaaagccaatgcgagcaaaggttcttgattccctgtgatcaggtctgagttccggttttgtcatctaccacatcacttctgtgtataaaaaggtgttgtaatttttttttccagaaaattatatggtcatcattctttttcaaagtggttgcattaaaacccagaattctcagaggtggaaataaacaaaagctgcgcccttattagagaatactctctggaatgttattaaatgggtctgggcagatagagaggggagttagagtgggagcatgtgcattaaaagagccacaccaatacaggaatactagtgctgtttcctcctggtacctttgagagaataaagctagtttagacccacagtcggccgggcgcggtggctcaagcctgtaatcccagcactttgggaggccgaggcgggcggatcacgaggtcaggagatcgagaccatcctggctaacccggtgaaacaccatctctactaaaaatacaaaaaaaaatcagccgggcgccccagctattcgggagcctgaggcaggagaatggcgtgaacccgggaggcggagcttgcagtgagccgagatcaagccactgctctccagcctgggcgacagagcgagactccgtctcaaaaaaacaaaaacaaaaacaaaaacaaagacccacagtcatgaggctaggagggaagcacgagggacctggtttcaggaacataatctatttgtcataatttgagtttctgaaaccatgtcacactcctttggcctgttcaaaatcatttttcagaactgttctcagggttagctatataatttgtggaaaccaatgcaaaataaaactaagggcccccttgcccaaaaatccagaaaaaaaagtgttaaaagtgctagaatagaatttcttttctctttcttcaatagtctatttgttatgttttttatttgctattgaatgacatttaagtaaataaaaatgtaaattagcatgaatattaccattcgtccttatattgtgtgcaatgccagttttaaatccagatataagagcattcagctcaaatgcagaatcattgaaataacacaatttgtatgtcatagcccatatatgcatgtgtcttttgttcttattggaagagtggaaatgccatccaaaagtaacttactgctttttgtttcacttcttgatgcatgcacattctaccaacgctttttaacttcagcctaccgatgcatcaggtagaaccaaaaacaagaggtctcttgccctgtgcaagccaagcctttctgattagcaatcctagagagaacaggtggctcacgcctgtaatcccagcactttgggaggatgaggcaggtgaattacgaggtcaggagtttgagaccagcctagccaacatggtgaaaccccgtctctacaaaaaatacaaaaaattagcagggcgtggtggcaggcacctgtaatcccagctacttgggaggctgaggcagaagaattgcttgaacctgggaggcggaggttgcagtgagccaagatggtaccgctgcactccagcctgggcgacagagtgagactctgtctcaaaaacaaaaacaaacaaacaaacaaaaaaacaaaaaaaaaacaagaagaggtctccgggttgccctatctttccctttcatgtcatcgtctttactgtaaatggttggttgatacagagacttaagaaaggatgtgataggttctcctgaatgccattgccttctctctgtcttctaagcaacttctggttcaaagggagagcatgagctcctggggatgtcagtgttcctactcagcctgtagatataacatccttacctattatacagaggacacgatatagaatccggagagaggaaaagcaaaggaggccagctttggcctgagaacttaccctagtcactcttgcctagaagacagtaccaacctcccaaggagaaacattgggggataaattcaaataaagctgtttgattcagattactcctatatgtaagtgaatccacaggatcctgtgccattggggcatcaggaacactatatgaggatgagcagcaaggaatggaagtggacacacacattgcatgtatctcctctgcttgctttcatgccgcactgttccactgaacttcacttacaaaacacaagtgcaaagataaatgattaggaatttcaagatggtaagagcagagcatacaacctaacaaagggtctttgtgagcaaaaaaccctgtggatgacctcatggatctcatgcctgtgattacacctgctacatttccaacacccattttgacagcaaatgagtgttgctgtttatgaactggaacggggaaaattattagcctcactgtctatcagaaatgagaaacaattcatctcatctctttccacatagaagttctgttgtgtttgcttttgtaaattattttgaatcaatatctaagatgggtttatctatttactactaattgcagcctgggaataaggatgtgacttctggggttgagtgggcccatctgggtttctgaacttctcaatttaatagcacctgaagacattccctacctagagattttttatataaatcatagagctttatgggaacccatcctcccacatttctctgtgggaggttggtatttccttctaggcatgaatagggataaattctcaatcgaaagctgacctcctctgcatttttcctctactgggacttcataccatgttctcaaattgactctcatttttccttcatagttctgtctcaaacttactggccacagatcacttgtaactccctattttattaagtccagtttcaaataccaaaacttgctttaacttctgctattgctgtaacacctgtctctgacttttctaacattatattacatggctgagtgggatatactttttttttcacagtgtaataaggaaaagatagccttgtatttctagaagttgtattttatattcacttcattgcatttgattgttctggataagttttctgtgccacatactaagttttgggatgtactaacatgcactcttttcttgtgtttacatcttcttgagcttgcatctctttcttagagggaaggcatgagggaggaaaataagaagaaagaaagggaaaaagggagggaaaaaagtagatttggtctttggagcttcagttaaatttcccttataatggttagaccctaaatactcaaaatgagtatttgtggtgaaaacaaaagagctgacagtggaaacacagccaagcctttctaattagcaatcctagagaggacagcaccaataagaaagaagagcagccatcaaagccaggcctttatatgtatgtaatcaacaggcatctgatctagattcttaaagatggtgtggtttgggtgggtgattttatttattttatttttctgtctcctaaataatatgtaatttcttcaggccaagaaataaattgaaaggatttagagggatttgcttatcagtggaacaccacgtagcattacattcctcctgcttttgggaaggtacattgaagtttggttaatcttctgtggttcaatactcctcttccctctgtcagcctgccttgaacaacagattaatcccttttccacccactctcttctccttcctccctcccctctctcttgatctacccttccctttttgagcaaatagaagaaaaatcttaaaagtggggggaaaaaaaaattaaactgctgcactacatttatttatataatcctagaagacctcaagggtagaaataaaggatcccaatcctcggcacaaaatttggccaagcttagcttggtttttctactgttaattaaatcttgagtctgcaaagggatttccttaaagactaattcattagcaaaagttattataagtcacgtcattctttatcctgctctagtatatgcattgtggaaaagaagaaaaagaatatgctggctattgaggatgggtagaggttttagggagtgggtgatacgatttgcttgaattcctatgtagtctgctgtctttagtgacaatgaataattactgttgggtgacgcttatgagcccaacactaattttaagattttatagctaatgatttggcaactaatcagtgttttctggtttgacttggcttaaatctcagtagtctataaagtccatgaggacaaggaccaggtcagcctggtcccaagcacagtgattgactggcacatcataggcaattaataaacacttgtcaaggaaattagtgagtgaatgagtcaatgcaaatgtcagtacaaatgtaaataaaatcatatattcagaatatttttttaattcagttttagagagctctgttccaataacctaattttggtcagacagaatgcaatatctttagctcagggtgattctctttaaagctatctcatttcatggctatatgagcaagtaagttatgcatgtagtcatatcttggcaagtgattatcttcaggagtaggtagagggaagaggggaaagtaatagctggaagaacccatggcataaaccttgtaagacagttttaaaattcacagggtgttgttccaatcgaaatacttaagctcatagacataggatacaagggtcaccttagatagtatcttaacaagactagaattctgtcccttcacctccaacattcaggacctgcttcatgagatgcccccatctttcacacctgagtatgacaagttagagtcatttatgtttcatttgatcataacaatgtcagtggctttcaaaggtaactataaatgggatgtttaatcagaataaaataagagtataggtatgacagtcatacaatcttaccacactgtgaggttgtttctgtattgggcttaaattgagtgagtgagagggatgggggagagagggagataatggcttctaacaagcttgcccaagctctatgttttttctagttttgattacatataaaaatcattggcaagacatagtggctcatgcctgtagtcccagcactttgggagcccaaggtgggtgactcgcttcagcccaggggttagagaccagcctcggcaacatggcaaaaccctgtctctacaaaaaaataaaaataaataaattattcaggtgtggtggcgtgtacctatagtcctagatacctaggaggctgaggcaagaggatcacttaagcccaaggaggtcaaggctgcagtgagccatgattacgcccctgcactccagcctaggtgactgagagagaccctgtctcaaggaaaaaaaaaaaaaatcatccagttgtatgtgtgggtattagcactgatcaaagatgagactgtgatggccacaatttagtaaagaaaatcttaatagatacatttaaaaaaaaggtcaaacttttcaaatctcattaaaggttataggtttacttagagtcaataggtattaggtaattgaaaaactcaggcagcttgtatttaaatagagaatgaacattcataatgaagctagatgggtcctctctcatctgagatattcagagctccaactccatctcagaatgaaggtatagaggggaaagaactaaaacagcaaacatttaaaggaatttaattctttttagcgtggagcagctgcagagatgtatggctgttttctgtggggcttcagaatatttatgggcctttcccttttcctttttcaccggaagaaaggagatcatcattcttgagtgtgttatttataatttcataaagctgttctgtggcaggacttattttatctcatactaaatctcaaataactgtgcttccaaggagatgggtggggaaaattgattatccctcaaaatgattagcctattaccagtgtaagataaagagctgaagggtggaatttgaagttacaaaaggcagttgggcagtaaggaggggacagagtgaaacggtcttgagcagttctgatcacagctcacagcagtagacacttttctcatgcccaataatggattaataacgaagaacagtgtagaaccattgccaagaaagggtaaaacccttctgagtacataattagaagccaatgattatagaagcaataactcactggaggaaaatacgtcagatttgtgaaacttagggaattggaaggtaaatatacccataaatttacttgggtggacagagttctgagctttcttctgtcccagctttattctaaggtaatttcaataaacaatgttaggaggaaaaaaagaacataaatgcaataaaaaatcttccaggaaaggaatacatagggctcctgccagacagatattttattgaaagttattataatacctatctttagttttatgagtcctaacacagaacaaagtaatttcaacacgtggattaaaaatatgaaatacatattttaacatgtagtagtatgaattattgttttaaatataggacttggctaatatataggggcagaggaatatttttctccccttgagaaagcaagttaaggtgcttaatatgcattgtgaaactgcattgcagtcatactcatgcactatgttctataaaccatgtgtagtagcttccaaccaaatgggacagatgacactggtgagatgcagggagtggagaaaggagagaagtctgatagggcaggacatgaaattcatgctcagtatctaagttttcaagaacaacatagctcaagtagtggtcacactgtcattctagtccatcccttccctccagtcatcctctactactagtgggtgtataaataaaccgtgttttagacctctaagcctttgcaaatactatttcacctgaaatgcccttctccttctccagcccacccgtcctcacttccttcccctgtctcaccactgcctgtccctgagggctcatttcccacatgctctctgccttcttgctatttccttccttcacacattaatgcttcctcttgtcagagcattcggtttactacatcaagtttgcctgtttacttgcctgtctcatcagactgtgaattcccagagcagaggaactgtgtcttatctatagctttatcccttataactgttaaagtgcttgacatataggtgtttgaaaaagattcattaaagtaatgaatgaatgaaaaaagcaccttgatgacatataccactgacagtaaatctaacagcccagccactgtgaaaattatttggtgggtggtcatagagtttttaaaaaatgcttccttgaataacttatagagaatattggtatttgacataggggaaccatcatacgtcagcactttaagcatagccattgaaagttatgagagctttagacaatcattgtgaggggaaaaaatgtgaagatgacattgaacgcaacttgataaacattcccaacgtaactatgaatagaagagtttcctaaagcaacactgtttcctggaggagcgtggatggtggacagttaaaaataacaattcactacaagtgtttatacccttggttacagtgaatactaaattaatgtgaattaacagctcagcacaaagcctaaatgtagccagtgtttattaagtggtaaatgttattagtaggcatgagtctagatagtctagatatccatttctttgcaggcatactaactgctctttcttctaagtaattaaaagtaattacagacaatggttgtgattataggaaaatacacagacatgcagcctaaggctaccacattttattaaaaggcagagatccaccaatttgttctacttatagcaattctattctgagtctgagtctatctgcaacatgaaacctgttttacaagccatggaaagcaatcaaagaagtgtgccttttctttcaaggttcaacatcagatcctgcatttgcttacatctgaaaaagaacacagactgaaaaagccaaaacaacaacaacaacaaaaaactgctaaaagaaagccctgggttttctgaaagtatctttgaatccaattgccattaatttaggatatgatcttaagccgctcatatcatccaaaagccttggtttgtaatgtttggattttctagatgttagggacaaaagtagtttcaaaaaagtctaagtgtagcattcctaattctaagcctttttgcaaattaaggcctctggcagaggaagtctttccatactacacagtgttctgtggcaggtgtggccaatgttgcatgccaggttcttgaggaaaacattggttaccaaaacaggcaaagagggactgagatgtttgtaactgctttgggagtttcagttggctgtacctctaagtggtaacgatgaggtctgaaagacacaaaggaaggaactgaattcatataagacccacacagattgtctagattcacagccactgagaacagatcacctttgaatgattgtttaagctctttatgagtacatttttctttatcactcctcatggcaggtgcaaccagaaatagtatgtgtaccataaaatggaagtaatgaattgtcagcaacaaagaacacttctaatgtggggtaaatcgtaacaaatagagcacataggcagataccaaatttatttaaattaggagtggctatcaggcttggaattactttgattgagaggctgatgttgattaattgtgaagttaaactatgatgttgattaatagtgaagtaactaagtgacgtgtgtgcacgcacacacacacatcccaggtcactttctgaatctacgtagaggagttgggattcacagttgtgctatgtctagggccaggcccattcttacgacacactgctggatcatttccccttcaaactcctttgagtctgggcaccattgctaggagctactggtaaaatgtggttctgttgcctgggaagaacactgtattcacatgtactcatatagaagatcaacagaaaacaaatctttgggcaaagtggagcgcagagagggttaaaggtggaaaaagggggtcagaaggtgaaagatgatgtgtggggtctgcaatggggattaggggcccattcatgggatggaattggaggtagagaaggggtgggagagtggggctggggatggtgtcacctaaaccacaggggagagaaacttagtagtatgagaggaagccaaggaagctgagaggaagacagtatcttttcaacctcagagtctactcctttttctgaaaaaaaaaaaaaaaattacatttcttcttttggcccatgcaaatgaagaagtctcctctgagttaaagattcaactaatattatgttaatgtatgttttggtttctactgaagttatgcattgttttttaaacatttgttcaatggcctttaaactttattgccaggctttcagttcttgaaaggagctcattagattttcattaactcaccagctttcactcaatactagggaccaaagtcctaccgggccattctgcaaggcccttacagtcaaatcattaataatttccagttgaacacacttcagcagtgtattctcagcctctttattaccaccatcctaaggagttttttcagataagttttccccctaattgcccttttcccacaacatttcaattccaaagatatactacatattcatttatgtaactgtggccttttggagggtcacaaaccattgtaatatttaagattgtccctcagcccaaaccaaactttcctgcctttggtgggagacattgcccctataaagaatgcatgcttaaaaactactaaacaatgattgtggtccttccaaaatagtgttttcctcttataattgccgtatttatttcaacagttaactcttttcccacttaccagctcctttccctaagtaactagaagtagagctattatagggccccctctcagcaggaaacaccaagggaatatgcttaccatgtctctaacacaaataacagccccccaggatgtaactaccagtttcagttgctggaactgaaatgaacaattcagtagtgtgtgttttttttaagtatgtttaaaaattcttttttcggtgtggagaaggagagcatcaggataaacagctgatacacgcggggcttaatacctaggtgatgggctgataggcgcagcaaaccaccatcgcacccatttacctatgtaacaaacctgcacgttttgcacatgtatcctggaactttaataaaattaaaaaaataaaaattctttttttctgctagccttgaggagcaaggtttgaattatacccctttcagatgtagaataaagatcaatattgttgtgtagggcacttctctgccattgttaattaaatcaatgaattatctaatgtggtttttccagttctttgctgtgtccagtaattccatacctaggatgtctatttaaaaaaaggatgttttctggaactcctaagtagaaaggctgtcatatatattcatttattagggttgtcataacaaaatatcccagaccaggtggcttagacaatagaaatttatttcctcgaaattctggaggctagaagcctgaaatcaaggtgtcagcagaattagtgtcttctgagaactctccccttggcttgcagatgactatctgccagcgtctttatatggccttcctcccactgggtatgtctgcgtcctactgtcctctttttagagggacacaagtcatattggattagggctcatcctaatgcttcattttaacttcattacctctttaaggctttgtatcaaatacagtcacattctgaggggctggggagtaggacttcaacatatgaattttgaggggacataattctgtccataatgtaagaccaggtataaagaagcctattgcaagccacaaacacagaatttgactaagatgtatttattcaaattcccactatgtgttttactagctgtatgtctttcagcagctcacttaacctaactgcaattctaattagtcatgtaatagtcatccctgtcccaaaagacggttgtgagaatcacgtctaattaataactgtaactaaaaagtgtgtgtgtatatatatatatgtatatatatatatgtgtgtgtatatatatatgtatatatatatacatatatatgtatgtatgtatgtgtatatatatatgtatgtatgtatgtatatgtatgtctaggacagcatctggcttgtagtaattgctcaatagaaggggagtggtttattacctcttcctcttgaatttggatccagactttagtacatttgggaattggaagatcaacaagtcagtaaatattggtcacatgaagaaggggaaataaatgagcattattgaactataatatattgagtcttcttatgcacatagtaggccaaaagttttgttttttgcataagatctgtagattcattcattcaatatttattgtgcatgcaatatgtaccaaatacagaaagcagtcatctcacctactgtatggagggctcttctcacagctgatactcagtctcctatatttcttgtaatagattccctgggactggggagtttctgcgagactcagaatttaaaaggtgcctcaagtcgaactactattattgcagtcagaactgtttttgctctcttcaggaacagccttacctgtgttcagggactattgtgtggtatcatgctactggtctacattaccaattcagctattgcagcaattacatgaaggaattcttgctaatgataaaagccattatgcagttcctaaagagaatgcattccacagcattcattaattatgccagcctgtagatgcacaactaccacggcatacacttgagaccacacaccataaggattgaaactctctcaaagccacaatgtatgtctgtgttgctttgcactcttacattgcccatcctttacaacagcccttctcctgtccttctgattcctaaaactcaaaaccagaatgaagtaaggctacaaaatgtcatttatggggatgggtgaggcttaagtctcctggaaccatcttgggtcactcagctctacggaagacccccctaagacggtctagacccagagtcattctcagtcacacagtagttaagaattcttcatcctacggtatgccctctctagaaaaataatcgtaatgatgggagatgggacacagtgataaatctttgatgtctttgttcattagtttccttatctctctctcttctctctcttcccctaccccattattttctctttgacataaacagccaacatcagatgatcttgtttcatctgctgaatgttcaagtgatgatgaagactttgttgaatgtgagccgagtacaggtaggtcaggtcagtcttattttgcttgctttcttttttcttttgcaaaaaacaatacatacatatatgtgattatacatgtgttttatatatagattatagtgtgttaatgtgtgtatatttttatatctatatatgtataagtatacatatataaatattatatcaatgaaagcatcaaatcccatggaaagagcaataagatcctacaaaaattaagtcagtctcttgatagctaacaaaaaatcatggtatatgacttaacattgggcaagcagatgcccagacttaccactggagcagcaaatgtgtaggagccagtggcagctatgaaattcacagagggtgggaacatgaggaaatatatgttggaatgacatcaagaaaggatgaacccatggaggagcttaaagattggtaagtggagccataaagattggtaaatgacttaaaactcatgaattattctgagctaagagaaccaaaaatatatgtatatatatattttccatgggatttcaacagcagttaacatggtattatctttgtactaattttgttaactgtgtgtctagaaaacttgtgcaacaatatagtaaacacaaaattagtgctgtaccatgccgtgtcaacagctgtgatgcttcaaaatgtatctactgtgctgaagttgagaagactttagcaatcagaagcttcaatgtgttccccatttggacccagatacattttgatgttttatggtctttctttatagtgagctacatatgacctaatgtccagcaggcaattgcagtccctgattatttcctatcaacttttcccagttgtctgttttgagacttactataagttaaacgtttatatgtatataatagagaacagatatcatcgaatttctgtgtatgtttaatagaattaatagctggagttgggccaggatcttatttctgtgaagactaaaataaatagaattttctagttattttttgcattgctttcagatttttttccttttaagaaaaggaaagccattaaaaattctcttttgctaattctagaaaatttaagcttcatgaaaaaataatctaataaaaataaaaaccttccatttctgacccctaaatgatttacaagatttcaaatctgttgaagcctgactgctttggtttcttgcaagtggaattggatccaggaagttctgtgggttcatacccttagtatgacacagggacacatcattaatatgatagggcttccattctggagtgtaatctgttccattgggagctcagctgtgtggagggaaagtaaatgtgatctggtcagggctttctttttcatatttttaggtaataatctgtatgtgctatgtgaggttttaaccctaaaagggcagatacatccgaactataccagaacttgggtgccatgttttcattaatttattcattcattcattcaataaatatttttgagcactcaggcaggatacaatatatctctagatttgagtccttcctattctgttttttttttttaagaaattagctgtcagagaatagaatagttttgctatctaactcctcgcgtaattcaattcaacagatatttttgagagtcaactgtatatgttaagcatgtgctagatattaagggttcatatattaataggtcacaatcctcaatacgtacattaaattagcttgttttgtggcaaaccctttaagaaatctaggctttaattttatatatatatatatatatatatatttttttttttttttttttttttttttttttttgagatagggtctcactctgtcacctaggctggagtgcagtggcgtgtttatagctcgctgcagccttaaactcccgggctcaagtggtcctcctgcctgagcttcccaagtagctagaactacatgcaccactatgccagctaatttgttttattttgtgtacaaatgcggttctcaccatgttgctcaggctggtctcgagttccaggcctcaagaaatcctctcgctttgacctcccaaatgtttttcttcctttcttagcagtgatatctctatatgcagcaatgtttatcaaatctgtagattttaaggcttatcaaaattgaggcttggtcattctgaaatattatcaccatctttcctcaactactcaccctgcctcagaaagtcatctccacagcaacattcataataaggcagtgggcttttccagatctcagcttcagattctctagctctgtagctccccagtttatgggtatatattgctatttgttatgagacttgaatagcgtaaacctgaatggccccaaactaaatccatttgttttctagaggccacgcaggtattttctctgattcagaagcagaggacagaaattcaacaccaacatttcttgaataacatggggtgggtggggagatacagtttttagaacaatctgttgtgttctgtaagggagcatgagaggagataaagtgagtgacagaacccctacctttaaagagtgaacatgtagctctaggaggctgatattgatttcctccacctgtgattattcaactcatcacatttgaagaatgagcattgcatttttctaattttatttactccataaagtattcctggtgagtgatttggatatacagggaaatacgtcagtggtatatttaatacaagaagtaggtagatattcctagtaatgcagagagagaagaggtttgcccagaggacctgatttccactaatggggattacctgcttagagctatcaagccctctttttcattacataagaaatatctcctcagaagttcaagaccagcctggccaagagggtgaaaccccgtctctactaataatacaaaaaattagccaggcgtggtggcaggcgcctgtagtcccagctactcgggaggctgaggtagagaagtgcttgaacccgggaggcagaggttgcagggagccaagatcatgccactgctctccagcttgggcaacagagtgagactctctctcaattaaaaaaaaaaaaaaaatatatatatatatatatatgtatgtatgtatgtatgtatctcaggcttcacattttccaaaaacaatacagattaaaatcagaaatcagtttcttgggcaagatttgcactgcctaaagagaagggacctactgcccatgcagcaacagataatggtgacatttacacatctttgacataaattgccaatcttgcaattctacattaccactaagattaaaattctggttttgaacaccctaattcactgcctccatttctaaaacatttttccaggccttttgcttgatggaaatacactaaatttggctaacttccttggccttgttctatcatacttactactttatcttctttcactttgccagcgagtttattattttctagctgtctccgtttatgaggcatttaacttctacaggttatttcctgattaatttacatccatttgaagctctcacttttcataaatttgggtagtttagtgtgtgctataattcaatttttattttcatatgagcatcaaattttaaatgaaataatttattttttcttcaaatcacattggatttttaaactgctggttttgagttagttataagcaatcgcctttcactctcagaacttacttttgtgcttaagggtcaccacggtttggtatagcttaatcttattatatttaggaacaaggtaaatatttttggagtttggtcaataggagtctagaaaccttgcaaatccaatggaagtcaagttttcacggtatatttttgctggtaaatatgtagagaaatttaaagaaatcccaaatcatgagagcaaggcataaagtaaaagctcaattaggatttgtcgactaaattagtttgaaacagaactttatatctctaacttcatttcccctttaacagctaaaattaaacctattgactcatttaaaatttatgatttcatataatagggctgccctgacaaaatctatatttttaacaaatttgttttagaatttttatttctttattttgagactgggtaacaagactggctaacttttgtatttttggtagagacagggtttcgccatgttggccaggctggtctcaaactcctgggctcaagtgatccatccacttcagtctcccaaagtgctgggattacaagcataagccactgtgcctggccaaaacctacatttttttttaacaaagttattctctgctttttcctatccctacctttttctgggaactagattattttataagtcacagatacaatcacattttctgaatatttgcttcaagaacccagaattgaacctttaaacaataaagttataataaaaccatctgcatcaaatgaagatattcagaagtgtatctgaatagctatctagaggcgagggtctggattttaactcgatttgtaaatgttaattgtgttcttcacaaaacaaatcagtatctaatactttagattcgttctttgcatataaactgtttcattcccaactgcacttctattaatcttaaattgtgcagtaaattcatatttcattgtcctttttctctttgaatccaagaagaaaaacggatgagctggagagcattcaaataacccctaggaaaaggataccctcatgagattatggaagccaaatagcaattaagatcattagtaaattcacatttgtaatctaaaatgtgggaatgaattctgaaattcagagaaaataatacaattcacttcccatttcttctctttcccttacccctgctgctatccctagaattcccatctttggaaatagagtaatagtgaaaacaaatgtattcttggatgagcttttgtataattagatatgatcaacttcctggattttacatttttatagtttcaagattctaaaagtcttgggggcaggaggccacagagcagagcgaaaaaaaaaagtaatacttttatacctaataagtgggcatggcaatacttaaccacattgattcatccagtcgttatccaggggtatatttttcagtttgtcaagtagctagtttttctgccttcacttttcttaaatgtcctttgatcaaatctcaagggacagcacttccaccagagggcagacagtaaaaggaagtgaagatgaaacacatccatccatcaataagactgtgctaagcagctttcataatggttgggaaggagatgtttaaactaatggcagtaatatgagatgacaaaataattgctattcccagagtggttctcaggtatatttttactcctcaaatctacaatattcacatttgcatttcggtgttactgctacttagttcctctttgttagccctactataatatacaacccaagctgagtgaaatttaaatttggcataacaccaagatcacatctagtattttccaggtggaactggattcttaatctttatcagtctgagatgcctcgggaaagtatcatctgaaaatctggcactgagttactaaaagctcaccaaatcattttactttttatttgctggaacatggtagaaaatgcagctgaaatgttaatagataataataattttccagtgaaggatcaagagaagtttataccagaatttatagataacaagtaaatgtgctgattgttggccttaaatatgatgtttgaaatcttatagagatacgttttgtcatttgtgtctttgtcaagtttgaagttagcaacctgtatgtttttattacaaataagtcaattttatttaactatttattcactttagatttttctatatgaaaactcattagcaaatagaatcatgttaaaatttcattagtcaatggctattcagaatatagtacaaaaataaatgtccaagtaaaatctcataggaatgttggagtatgacagatctataaattcaatggtctgtaaatgctataaattctgataaaaggctcagatccacttaaacactttgaccaaagagataatggaaataatctaagataagcattttagctttggaaagagaactgtatatcgatagaaaattacttaatttaattcattattattggctgtggacatcagtcattttaaaatttgagttacaatacatgtctaatgctcacaaaagcaaatagttgttcacatacttaggtctaggctaaatcatatccatttttcaaccgccttcattgatctataaatgaatatagtatgttcatgggagtataatgttccagattaatgatacagtttttgtctttgttaacccaccaagttatttcactttcttttcttttttcttttttcttttttttttttttttttgagatggagtgtcactctgtcgcccaggctggagtgcaatggcatgatctcggctcactgcaagctccgcctcgtgggttcacgccattgtcctgcctcagtctcctgagtagctgggactacagacgcccgccaccacgcccggctaatttttttctatttttagtagagacgggttttcaccatgttagccaggatggtctcaatctcctgacctcgtgatccacccacctcagcctcccacagtgctgggattacagccgtgagccaccgcgcccggccagttatgtcacttttttataacagccccaacccaacccaagttattttttaaaccattgcagtaactatgtgcttttaaaatccttaatggtgaaatgctttgaaaattagggtaagaacagaaatataagaataggaaagatctactaattagctcttgcactttaggctgaggaatagtgtgcataatatatgtggcccatagatcgactattgtggatttcataacaaatatatttaataataaaaaaatgaaaaaaattctatccaactccattacccaagattttttagtaggttggagagcgaggcaggggaatccataaaatcaatgtatgagtgtatatacttctatctgaaagtttgataaatctcttctatatgtaacacttttgagtaactattacatgtaggcactagaataggtgctgggaaaacaaaagtattttgcttcagaaatatcgcttccagaagttcagtttattaggaaaggcagatataataagaggaataaaaggaagggaagaaacaatgaggacaatgaatggaaatgcccacgatattatcagcaccctaaggatgttggagcactccaattcagtgaacagcataccttatcagggatatgcaagaaaaaaaaaatcacacaagatgatgccaagcagtgacagattcaactaaccccaaggagcattcttctgtattttagtttggtgacacagaattctcatttattacgattgaagaattagtacagttcagtaaagtaaaaaagcaacactcttttggaattagtacagctcagtaaagaaaaaaagcaacactcttttggggacttcacatatacagtatggtcaaaggccacaccgtttttaggtaatagggtaaaggatggacatgttgaagggagaatttcaatctgaactcatgagaacttcctgattccaaatgccaatgcaagtggtacataaggagtgagcttaatgacatcattaagcaagtcccccaaaaataaataaagagggattgggttttaaaagagaagtttttatgggatttattctttttattctacatttttcttccataagccccaagtatatgtactgtgtgtatatatatatatatgatatgcacatatgcaaataatatactgcctgtcactccatatatatgtagacacagtataagtgatattagactaatgtaaccagagattaacagcccctaccatcagtcatgtgtttacacagaaattcacaccatcattcttaaccagcatcagccaacatagacatgcatgatactgttttaacttggcaaacaaagcatgttgatttttctttaagatttctttatcataattataatgctgactccataattcagttatccttgggaggggtggaaagaaaaaattatacagatatatctatccgtatatgcacattcctgtgtatatatataaatagatatataccttgtatatatttgaagaacattttgttgtttcacctcatcttgtgccgcatgaatttttggtggttcaatttattttgttttcatatttactattttgatcattatggctatttttaactcattgctatacttttatgagtaactataatcattattttcaaatactgagagatatatagatatacaaatcaaacaaggcaaaaaaatcttttcttgccatcctaatctcaaattcctcccctttcagcatatccctccagtatttatctcaaaacaaaacaaaccccaacgaaatccaagaaagttgtgtacaaaagaatgaatactgtgttttcctcttcctccttctatgcatatttttccttttaatttccgtttctttccttttgatttacccccatatctgcatggaccacttgcctttactttcccctttatgacaatgtaattaattgaaaagataagagtcagaaaaaaataaaagaaaaacacatagaaatgacagagaaacacacccctctccacaaatttcagatggcataaaaagaattttattgcagatatagaatatttgttgtatcttttatttctgtctggacaagcccaggatcattgtgtggcatgccgtgacaagttttgtagcgcatcaactaaccatggcctccatcacaagtgcatgacaccatcttgtgtttcatccaagtgacacatctaggctaacccagcaagtccagtgtatgagttgtgggaattacattcttttgtagttataatttcatgggtccttgtttttattattatttccattggatcatgacagccctaagagctgctctcgcagcatctctgtatggttttgttcttgtgttttcttttcttggcacagcagtcaagcatgtgtctcttgtttggcacatctgtcttgccatcttgtcttgtccactgtcgtggtgttgttctgtgattctgttctctgtaagatgtgatttgaaatcctctgcctttatttctcactctcctattgtctctacttttaaccttacccctagggaacttcacaaagaagcaaaacaaactttcagtcacattataaggctgatcactggtttgcatctggaagtcataagttgtactttttacctgacttaaggaggaaaaacttacagtgggaaactactgataattatactcaaacagcaaactgatcaacgacaataagaaacccttgttgattatttttggtatgattaaatgggcttactgttaaagggacttcatgtaagatcttatttccaaagagtttttttcataaattatcagtcttctagtcagaaacttttcttcaggagcagatcaacggaagatgtttttcgggaattgttagtgagggagcatcatttctgctgtgtagaacagtgcctgttcctgaattggggaggaactttatggaaatctgcaaatgttttattacaaaatgcatttatgtttatgtattaaaatataaatgtgttcagcaaggcatctgaggatgggaaaaaaaaactttttaactcactggttccacctcatgcatattttgaggtaagattatcttttgatctttctgagtcaactgatatacattttacttttttattttttaattcatggaagcattagagagccaacacttcaactttgacctaaattcattcttttcccattccagagaacacgacatacataatagctttagttctgagaatagagtctgaatttgagacaaacgtagaaggaagtgcccagttaattatccaaatgttggactctacctgtgattatccaggcgatttgatgctttacttggaaggatttgattagttggatacgaacagcatgaaaatgacactttgtaacaactttccctctttaagggttgagcacgagaatatcaaataggtataaaaatgagtaataggtgatatattaatagattaaagattattcaataggcctaaagatttcagatgaaaaatctgtatttgtaatctgaaaaagagaaagcatatccagacctgtggttttctgatgagatctttcagtcaggccagggtagctattggtttttcttaagggtaaggggaaaaaggccaaggatgaggaactggatggctctgtggactaagaacaactttctgatgaaagaaggaagggaaacaagaaaggcgaagaaagaggaggagggaaatgtaaaagaaaggaaggaggaaaggaagagatattgattatgagccaggtaaagctgcttgctgataaatattttaaaaccagcacacacacagagctctaatttgcagttttccagtttctgtatggtgtaaaatattcccaccatggctgatttctagctaccaatatgacagccctaaactcagaattgggaagtgtccttgctcgtacacaattatatggctttttcatcatacgtacactatagacgtcaagaacctcatagataatagtaaaatttagtaaaataattaggaagtaccgagttttaagtttttaattacctgtttttaatatacttgtaactttatatatatattaacttttgaaaatggccatgttttaacaaccagcttacaaatttcctagaaattttgcaatcagttgtcataaactggctcaagcacaccactagcccaggtactatactgggtacatgaaaacatagtattttatttaaatctcattttaagttattgtgagataaaaactagcttggtcatcttacagttgagaaaattgggattttaagtttgcttgttcaaggtcacatacctgcacataaatggtagaggtaatattcaagtccaaatctgtttgaaaatagacattttctttatattacagtgtgccagtcattctttcaacacttctcaaagtactaagttatcgaattttgacacgctcctttgtggagcttagcatgactcgggtttccctattgcctcaaggaggtccttggctttaactgtcttagataaaatggagtttaaatgtattatggttgtgtcaatggcaaaatgaagacagtgaagcaaaattagaactcctgattactctgtttgtaaatgccaccaaagttatgaccatgtcttcatgagaatgtccactttgactaattttgtttcctccaaatattcctcttttactaacattgacaatgaacaggatatttcttaggttttcatattctgtcccttgagctttggaaagactatcccagatacattttctgagcacatagaatctatagcatgatcccattacatagttaggttttataacttttaaactctaatgaattttatttagttacagtatgtaatgcatgttaattaaccaactgcacagtgaaatatgtcaatgtcctttgcttccacattttctaatagagtaagctagtatattaacatttaaaacagcatgagaaccatagtactgcagaaagcaactgcagtttttaaaaagatgattttattgtaagatacttaatcattgctctgtaaaagagtttgagaggcctgggaattaaaaaggaaagtgttgcagctttttagtccttctaatttgacaagatagataatttgattgggtttctgatagtgcagtattttgctttaatttggtgtgaagtttagttgcccccataattattattatttttttttggtcactctgtcacccatgctggaatttagtggcatgatctcagctcactacaacctccacctcccggattcaagcaattctcctgcctcagcctcctgagtatctgggactacaggcgtgtgccaccatacccagctaatttttgtatttttagtagagacggggttttaccatgttggccaggctggtcttgaactcctggcctcaagtgatctgcctgccttggcctcccgaagttctgggattacaggtatgagccaccgttccgggcctccctatatagtaaactttcgatggcagcatacacaacattgaataaagtcctttgaagtgacttctaggctttctcctataggtttgccactgctacaactttgtttcatcattcagtgaatattagcacttcctttagtgaaatatagtcttaagtacttcacattgttaactactttaatcctcacagcaatcatgtgagagtctattcttattatctccattttaaagataagtaaatggaggcacagaggagctaagcaaattatcaaggtcacacagcaaggaagtagaagaaatgggatctgaacccaagccaactgcccccagcgtggacacccatcactatgctatcctgtctcttacgtagcgcttattttccattaacctaaatatacgaaatagctgccggcctccttgataataaaagaaagtctgtgtattgaatgtattacatggttgggaagtagttgataaatgggttagttattatgtatcaaaaaggctttaacaatcttggttgatgggggttataaaattgttccattatgatttattcaaataaccgtggttaaaacaagttaccctggtttcccataaggaggaatgactccaatattggagagaaataccaacacttatgtgaggtgagtctcccttgatgtcacctatgcaataatatgtgcacttgggtttttttttttttttttttttttttttgagacggagtctcgctgtcacccaggctggagtgcagtggcgcgatctcggctcactgcaagctccgcctcccgggttcacgccattctcctgcctcagcctcccgagtagctgggactacaggtgcccgccaccacgcctggctaattttttgtgtttttagtagagacggggtttcaccgtggtagccaggatggtcatgatctcctgacctcgtgatccgcccgcctcggcctcccaaagtgctgggattacaggcgtgagccaccgcgcccggccgcacttggggtttctagctcattattcatgatcaattctgttcaaaacatatgcccagacaacagccacctttaactgatgttaggaatctaaggatagaggctcttagcgagagcttgggttaagatactgcattttctttatttcagaaataaatatgttccttagaacacagtgatttaggtgttacagctaaaagaaagcaaaaaacaacaacaacaacaaaacgaacttgtatttcttatcttagaccctttctgacacccacatgctcttgacatctcttaaagttgtaactatttgtttatcctccctttttcctcacttccttgcattatgcatccaaaactattttaaaagccaaaacacacacacactttttgtgggtctttgagtttcctatgcaagaaaagaatcttaaaatgagttataaagaactaaaaatcacaattaaaaaggaaacataattttaaaactgtgtttgcttgtattataatccttattccaaggcaagtatggcctgcacaaacatctgaggattccattacaaattatatcagtctcaacccatcccgaatccagatcataaactcataaactggaaaatgtgtatagttgaaaatgtttgcataccctctgtcctagagcagtgcttccatcttagctttgaagcacagagacctcctcttactaaaagatcatgaaaactggcaatactgtattgcccagtgttaaaatttgtcagattaattacccagagccaaagttagcaaactttttttctgtaagggctggggtgtaagtattttacactttgagcgtcttacagtccctgccctatctcctcaatcagctcttataatgacacatagcagccatggaaacaaataaatgagcagggctgtgttttcatgaaagttgatttccaaaagcagagatggagctggatttggctcagaggtcatagtttaccccaatctagagaagtcccataggttaaaaatgtgtagtctttttttttgtttttaatagataagaccttcttgcccattttatagtcgttcccaacatttgttgagttctccactaagtacatgagaccacataggatacaacaggacattaaaagcttttttttttttttttttttgagacggagtctttttctgtcacccaagctggagggcagtggcacaatctcggctcactacaacctccgcctcccaggttcaggcaattctcctgcctcaaccgcctgagtagctgggactaaaggcgtgagccaccacgcccagctaatttttgtgtttttagtagagacggggtttcaccatgttggccagactggtctcgaactcctgacctcgtgatttgcccccctcggcctcccaaagtgctgggattacaggcatcagccaccgcacccggccctaaaagttcatctttaaggacatttcccacctttgttttagatatgccactatctcagacatgaaacacaataacaaactaaaccagggtcatctccacccagcttgtacactacatatttgggtaggagcttaacgtcttgcccttcgctttgccagtgtgtcttctgagctccccacctctgctaggtgtgggctgcattcacccccaattttagacctctttggcagtagcttccttgatctcccgcccacatactgtgtcatatcccagtaattcttccccaaaccttggctatgggttattgagctgacaaatgtctaaatgactgagatacgatttcacaacctgctgagagcctcttctttccctgtactctttgatttgtagctttgtaagttttgtgaggaaagtgggaaaaacattcttggtgacacaggcagtgaatgaggaggacacaatggagtgggcaccatatctaggactcctgcctgcattgcgagcaaaagcatgtatttatatcttagccctctgaatgttagaggtagcagattatacagtatggtgcaggaaggagcatcctatgtcctgaggtgaataacgtgttctaccacctggcagcagattagaccagatcaggctatgagaatacaggttcacagccagatttagtactaccagccagatttagtactactgcaaaaatggcttttccttaagaagtttttgtttctaacttttattttaggtttatgggtacatgtgaaggtttgttacctatgtaaacatatcatgcggttttgttgtacatatcatttgatcatctaggtattaagcccagtatcaaaaaattatcttttctgctccctccatcctctcaccctccctgctcaagtagactccattgtctgtcgtttccttgtgttcctaagtcatcatttagctccaacttgttgagaacatgcagtataagttaatgcttactctctttaacatctttcacattagaaatctatggagaagaaatatgaaagactcatatataaacatggggcaaaccatgaagctaaatcttaatgtatcccaaaccccagagggagcataaggttaactttgggtggccagggtgcttagtgataacattatgagctttctacattagcagggccccctggtgtggttttgtgcctggagatgtaaggttctgaactacaaaggaagcaaacaaaatgaagagatgatgcaaggaggcaaaaaagatggaggcattaggaaaggctttgagggcaggaggcacggggtcatcttctaaaataacctattggaatgcatgttttaataagctttgaagatcaaagagattaacaagaacaagaggaaaacaagggtaaattaggcactattgatggcctgacaaggacttttttctccctttctgcttacaataacctctcattttaccatgtggctagttggtttgtttacttgtttgtttacacttactcattactagctttccctataaagcaagggaaaacactctgtccccaggggccagctgcataacatgaatagatgaaatagaccagaccagatgcaatctgcagtcatgggaactctgaactgaagagaacatgccctcatttaaaggcatccaaatgaaacattttaaaaacactaaaataaagagaccccatgaaggtcaaacaaggcataatgagacacacagtgttttttattcttttgtttcttaaattcctttaaatatagccctttcataaatttggcaggatgtgctctcagtaaaatttctggtttagtaaactcttggtgacattatcaaattaaacagcaatcccttccaaattcccctaaagctaagacctttttttttttttttttgcatgtctttttttctctgataatcccagagtttatataacctcaaactataagcttgatgaattttagagttcattgtaatgcttttggtttaggtgacaaaactgatgcctacaaagataaactgatttgctgaaggtcatggacctagtctttattggagttgtaattcaatcccaggtgtcctaaatctttaatccatgccattttattgatattatatattaagattttttttattgtatatccaaagatttctattttaaactgagataacatccaacagagaattcagaagtagtatgaaattgattatcttccctctactggacattgttgccatacaagacgatatcattgacccacttagggctcaaatatacaactctgtattattttagtcacaaagggaactaagagattatagacaagttgtgaagcagttagtggggactggaagtctcctgtggcacagactcaaatatatgctctagtgatgtgttctcagtcatgttatctgcccacacagaggacagattaagcaacctagagtactggttcccaagctcgaatttaaaactagtaccagtctatgccaaagctttcagtgacccatagtgaaatgagaaaagcaaggacaatatggtgagtctgcacaaagtcaaacttacagaactgccctatatttggatactgtatcatgtttttttggatggctaaaatcaatgtcttttacaaaagcagcattttgttactatgtatagcattcttaatcagcaaaataaaggttggcaatggtatgtcagtccttccctacagtttttctttgaagtttttttctcaggcattgaaaacaaacatccgaaaaagcaaaaaaacaagagttttaaagttttaaagtgttctctatgttgccacattagattgagtagatttcaaagactgaaggcctttttacatgtaaagttttattgtgaactaataatgatgatgttaagacccatctattttattgaggtcccaggaagttactagtttaagcatccgtcacttagataacaagcattaaggtaatttttaatttcagttaaaaaaatagattaaaggcacaaaatagatttccaaacaaacaaacaaacaaacaaacaaaaaaaccaaaaaagccaccctaggataaatataactagaaggccaagatcagtttagaagtctacttaaagaaagacagaaacttctaaggactgtgtggaaagataattcatgcctataaaaaagtctctgtgctaactctagatttttttcactgtaagccttgtaacaaaggagagagagctattttggaaagctgaattagcctacatttgagctaacatgatccatctttgtgtcaagagaaagtcaaatattatagtccccagccaaaataaggcatgtgatctacatcaaaggcaattcctgaatgtgtatctacgtcctcatcccctctcctcttttttgtctcttgggtaatctataccaataacctcctgattcatgaaatttattatctaaatattgaaaatattacactaaatttagcctaataaaaattcatgccaaatttactgagtatttattggaaatcagagacttaaggtcctgaatcaggtgtaagaattgtattatcaataacagacttaacagtgattatctctaggtggtgaccgatattttgataatcatactccaaaacatctatgtagaaattgggcatggtggcgcatgcctatagttccagctacttgggatgctgaggtgggaggattgcttgagcctgggaggtcaagggtgcagtgagccatgatcacaccactgcactccagcctgggcaacagagcaagaccctgtctcaaaaaatgaaacagaacaacaacaaaaatcgatgcagagcatgtattacatttgtaatcagagagaagggatatctgttatttcttaaaatatagaagagtatactaggagaccagcaagggaaatgttttaatatttagatacggaagcttcgccagacccgtaattttttaaaaatagtgaatcctttttcctgggttgaattatgatgtatggccctgcaaggaaagctgctggaggaattcaaagatgatgatgatgatgatatgcagggctctatatagcttaacacattagttccataaggtcagttctgttcatcaagtgacaaattgtccatggatacaccaggtggtaatgcagcagcagtgggcacaagctatcctgtaaatgacccattaccagaaagtttaaaatttctgcttggaacccaggaacacagatggaacacgaagtggctttcaccagagtcttgggaatatgcttgatcctttaaccccagcttcaggtgttgtgtacatacttaatgcctgaacagttctcatctgtacatctgctggttagatgaaaagatgcagttgcagacaagtaatttaaaactttacattcatgtctctctacctccctcttcctcttctgtctctccctcgataggatgtccagaaaattaaatcagctgcagattaattgagactctcttccatgtagggaacatctgtcactgcagctacaaagattatattaatgaattaaaacatttgattacctttaatccaagagaatgcagcagtctctttagtcatttagtttatcagggttttttgatggtttttttttccacgtgcatcttacgactatagtccacccctgaagctgtgagatctttcagcagatgttgttttccatatctttaccctttccgttgtggaagggggaaaaagccctcagaaaagcaattttggaggaggcagaaaaggtttccatcatgaacatacttttagaaacagctggtaaaacaaatggtccaagtgcaatgcctggagcatatctattcaaacaaggttgtttaaagataaaagcacccacttctaaatatcagcattagtagtgatttcctcacgtatatttaagagatggaagagcttgtgaagactttttgatttctattttgttttctgagacttctttaactcttttggttttgttagtatttgaatttatcagaagctgctcaaattgttaaaactgtatcatcatatgtaaaatatataaatttacatataacggatgcataaagatttgctttcttattctaagaatgttcttatttgataacatctatgcatagtccagaagattgacatgaaaaactgataatgtacttaggtattaccaatcctataacccaatttgtgaaaaggtcaggcactcctactaaagaacaaacgtttgtatttgtagcatttaaaaatctgattttattttgtatttgctacatttggagtcaaccttatcccttcccttctaatgacttcatttgtttaccaggctgttttgttctgcatcctctgccaaatgccattacgtaacttcctttgtcagaccaattggtgaaataattctttgtgtgcttttttttttttttttttttacggccgtccaattttcaaattatatgtggattttctgagtcaggcattgcacaaatgctgatttgttagcttgaactcgataaatgtgtgttcaccctatcagttgtcattcatgctgacttcttcctctactctcttcactctgattctgttttcatttaagaaaatttcagaagtagtgaagctaggagagttaatgagtagccacgttgaccctagtaggatcttacccattggagaaaagccctgttttaaaacgatgcacaaagaataagcttcaatgtcttcctctcctcaaccccagcatggagcacaatgcttatgtgatacacggaagtgagaaatttaagaagtgcttcactttaacttttctcaataagtaaataaaactgtcttttctagagtccaacacatcccaaagtgtgtgactttgctattttaccttaaactgactactctctgaatagattttcatgttatatagtctgagacttttctttccatcctgctggtgctggaagacatgatcataactactcacaacccagatcttaaaatatatatattgttacacttttatatacttgtattaaagcatcagttagtaagtttcatggttgtttcttctgatgtaaaagtaactgtagttatagatcctccagcacatgtcacactgaaaacctaatcacaaagtcaaaatatgtgcataaatattagcttgattatgtgtcacatgtaccccaaattacacatatatataccttcctcaaagattttttttttgtggggggacagtctcactctgtaatccaggctagagtgcagtggtgcgatctcggctcactgcaacctctgcctcctgggttcaagcaattttcctgcctcaggctcctgagtagctgagattacaggcacctgctaccatgcccagctagtttttatatttttagtagaggggtttcgccatagtggccaggctggtctcaaactcctggcctcaggtgatctgcctgccttgacctcccaaagtgctgagattacaggcatgagccgctgtgcccaacctgagattttttttttaaaccttggattttcaaataactttatagttggagaaaagttgcaagaatagtatatggaattcgttatgtccttactcaggttcaccagttgttaacatttgccacatttgctttaccattctctatatgtgtgagtgtacatgcacacatgagccatttgagagtatgcatacaaaacatatttatgtagatatgtatttcccctgaaccatttgaaactcagttgtagtcatcattccttttttaaataattcagtgtgtatttcctaacaaggactttctcttacaaaatcagagtacagtgatcaaaatcagtaaatgtaatcttgacacaaaatctcacctagagtacatattcacattgcaccagcgtctgcataatgggctttgggattatttttttcccagtctgtgatccaatccaagatcacacattgcatttagttgtcaagctcaccaacttttgaagcatcttcctgatacgttattttatttccccatttgtttactggtcacagaccagtaagagcaagtaaacttcttaaagtcctgccaggtgtgttggtgtagaagcgggaagatagagcctgtgcttcagcacaggaggaagatttcaatttttagaattaaaattatggcaaggaaggacctgtgtttcatctagtattcattccttagagagcacggatataatagtctgacaatgctttttattagtgttttcacttagctgcagattgagcatttactgtgtgctaagcactgaggatgcaagagtaagcaagaacagagatggcccttgtgggcctagtgggggacactgtcatgtaattaagtgacctccaaataaatgtgtgatgacaaacgttgatgaaggctatgaagcaaaggcacttggtgccatgagcataccatggtaggacaggtaacaaggcaggggtgggtgctaggaatgtagagaaggatgaggaaaccttctctgaaaaaaatgatatttgagcagaagagtgtgaaataagtgacagctaagaggaagaaaaaatgcattagagcttgcaaaaaattctgaacattagaaaaagtcagccatttctgggagagagttatctgggagcagcaactgtctcacaggattttgtccaaagtataaaataaggaagtgtgttaggctattcttgcattgctataaagaaatacccgagactgggtaatttataaagaaaagacgtttaattcgctcagagttctgcaggctatataagaagcatggtgctagcatctggggagcctcggggaaactacaatcatggcaaaaggtgaagggggaacaggtatgtcatatggccagagcaggaacaagcaggggtggagatgccacaaacttttttttttttttttttttgagatggattctcactcttgtcgcccaggctggagtgcaaagtcgtgatctcggctcactgcaacttccacctcctgggttccagcaattctcctgcctcagcctccccagtagctgggattacaggctcatgccaccacacccaggctaatttttctatttttagtagagacgaggtttcaccatgttggacaggctggtctcaaactcctgacctcaagtgatttgcccgccttggtcaattaaagtgttgggattacaggcgtgagccacagcacctggccgccacaaacttttatatgaccggatctcactgtcatgaggacagcaccaagccacaagagatccaccttcatgacccaaacacctcccaccaggccccacctccagctttggggattacagttcaacaagagattcaggcagagacaaatattccaaactatatcaggaattaagtaggctttgctgtccttttgcagctttgagtcaacccatatgagagtgaattctccgatcctgtactgctcctgggaggaaagggagtgggctttgtgaaaaatggagatttagtgagtaaagtgatgagttcactggaggaaggttggctagaaaaaaagtgacatggctgggcatggtggctcacgcctgtaatcccagcactttgggaggctgaggtgggcggatcacctgaggtcagaagttcaagactagcctggcaaacatggtgaaaccccatctctgctaaaaattcaaaaattagccaggcatggtggcaggcacctgtaatcccagctactcgggaggctgagccaggagaattgcttgaacccgggaggtggaggttacagtgagccgagatcacgctctgcactccagcctgggcaacagaggaagactccatctcaaaaaaaaaaaaaaaaaaaaaagtaaaattgtctttttttttttttttgcgtaccaaatcctatcaatgaaagagacaggaatagatttgactggaatagtcatgggagccatttccaggctctcatagtcttagagatgacacttggtagttcagtgtcttattgtgcttcttcaagcacatacagcctgattgagagagactcaagacagcatacaaattctaggcatttttacatctgcctagctgtagtgaattagtcatacaataattatttaaagaaagaaatgtttcctccatgttgtgctggagatacaatggtggagaggaagtggagatcaactattgatcgatttataatttacacaattccacactttggagaaaacacattccttcttcctcaccatcaccctcaccattataattattatcaattaacttgttcaatatgtaattttgaagttgccaatcatttaccagtgtgattcatcatgttaaaaggaaatggcttttacattattaatattctgcaataaaagtttgggtttgtgtgcttacagttagaataaaagaaaaatgctttgtactaagactatgttaataataatgataataataaagaaataacactttctccagaaaggaaatttcaggaaatctgtttcagaatacctgtctctaccacaagagctttctaagtcatgttttgattgctaacagcattccagtactgggttggaacatatgtattccttctatcaactgaggaacagcaggttttctgttattgcccatgcatggtcactctctgcttataaaaattcatcacttctgctgattgcattgtgtaggattcctactgattaccatttagatttgttaagtgacatagcacattttatggagtcaggagccagtaaccatcaaggtcaatagcagcaacctgaatcagttataaatgaattgtttaattacccacgcatgatcaatgtgtgcactgccataaaagattagttctagtccctgaatgtgtgtgtgtgcctgtgtgtagttctaagggattacagacttctctgaagtcttcttcattgaaagagattgcaagtgagtatcttttcagtggaatagaactgagttatggtaacaacatcatctatacatccagtctaccgtggccactgaatccaatgacttttttttttattaatatgaaggtgcctgcctatccaaagcactgcttactgtatttcattacaatgtattgcttcactcaacacactctgaatagagaagatatgctctacagcttcaaattcaggcacttcctccaagcagagcttgtttatctgtctgcaacacacttggagcatttgaaagactagtgatgaaatccattcatgctgtgaaaatgtgttgagcatcatggccgcttcctttacaatggcctggcatggaaggttggagaaggccattgttaccatataaatgactgtctatttgcctctggcatgacttgtccagacaagttgcatcattttaaaatgaatgaagttctagggagcatttttaactatagtaccttagttgtaactttgagagtttttaataagcttgcaaggaataaatttggaatctagagtagtttgttctatttctggaaaaaaaggaatgctttgtacatatgtaggatcctttacctggccacagagtttggtttgagaagtggacttgactctggatagtgaacaaaatgctttttcaatttttaaaatggaggcacctttttttctgagagcatagtcagtaactccccaaatgtgtgtctcttgtgtgatagaggaaccaagtaagagaatagcttggtgtgtgcctggttttcttccacaagtacccaattagtaaagggggcttttgctttttacaaagcatgaaaattaggggttgcctataggcctgagagccctgccagacagttgcctaatgccaccagccaggattatggaaaagaagccttggcatactattcaatggcaccgattcacccaaattgcaactgaggaaaacgtgttcatttttcaaatagagtttgagtaaccatagacacaggcaaagtaatctctccatttggtcacaatggactaaactaccttgttctattgtctaccttctctctcactgactccatcaaggcagacttgttcggtaaactattcaggtgactttgtgaacttttatttggtgcaaggctctgttaatagctgtaagtcagctgtttttggtcctccctctcattctcttcacactgattgatgaaatgggaaacaggttgaagaagctcacttttttagatgacaagtattaagttgacagataaacctttaggaggttccagttcatttcaggaacgtgttgacatgaggtctttaaagatcgacagtcctattagagatagagaccaccaggaaatcataaggaaaagaaaaatgaaggaaatatctagattcagtaggaaattgggggtgatgagagaattttaagaaaaacgcttgctttatcaccagctgtgtcattttgttcaaagggacaggaaacataatactctctctgaagcttaacagaactgcagacctattgccacagttttctcttttgcataatcttgtttagtcacttaagagctagtgagtgacagatttcacatgagaattggtcacgtacaagaatgttaatgcagaactaggtcagattatggcatttcacacatgcaagatgggaacacgcttcctctggttagacaaaggcttgacgattgcccatgcatctggtcctgctttaaaggaagctcatgtaatcatgagaactcacaatgtatccatagatttcttagatatcaagtttctatgagccttggcattgtgtatggttttattgttattttgccaaacgagggttttctagcttcacttagtatgcctggagaaagctattttggttcggcccagctccatcactctaagaaatgatgaggatgagcgctctcagtttgtaccgactactcatgagagactaagaactgatcatctggctgctggcaacattccactgcaacagctaatacagtgttttggaaagatgccgacaacaaccagattgcattaagcactttaccgtttaagatcagttttgcagttcagaacttgaagtcagcagcagatctaccttttagtttgcagtttactttgctccgagtttttcatgtcttctgtgagccccccacgtttatctcagggtggattctaacacacatatgcttatgtgaaaatttcataatactttagtatttaacaggcacttttatataagtcaattgatttcaggacaccccctcgccgccctgataccaaaatctgcagacgctcaaatctcttacataaaatggtgcagtgtgtacatataacttacacacatacttctatataatttaaataatttctagagtacttataatacccaatccaacatagttgttatactgtattgtttttgtgtttttaattgtaatattttcatttacctgcagttgttgaatgagtcgagggcaggtagatatggaaagctgactgttactacttcccttttacttatattacaatattatctatgttagtgatgttcatagttcaagagacacactaaaggaattacagtatggagtgtctcctaagttgcattgtggaactaaacactagagacaagagtcgagccctggctcaatagagccagtaataactcagtgtctttatgaccctgagccggtgccttaaattctctgcagcgtagtttctttaaacggtggttctaaactaaggggacttttgtccccaggggacatattgtcaattgtctggagatgtttttgattgccacaactgggaagatgctaacggcatctagtgggtagaggtcaggggtgttgccaaatagcctacagtgctcagacagcccccaccacagagaattatcccacccaaaatggcaatagtgtagaggttgaaaaatgtcactttaaaatgtaaataatgtctatcccattatcacaggattcctatggggctcaaccccacattttgtttaaaaaaagtaaaaaaaacataaattgcccttctatgtctgatgttactactatggggcattgcacatatggacaccaaacttttcccttaaaaaggaaaatggatttattcttttagattaaaagttataaataaagctatcagattaaaatatattaaatatatccactgaatcttggtttgtaattttatggttttaaatgaatgctctaaatataaagagaaacaatgaaaagttattaagtaggagaaacctactattcagtgactaatatagataaaggaaattggaatccatgcaactaatagacttttctattagggtacagccacagcacgtctttcctaatagaagcaagcctgaaatgataagttgtttggatcacattaattaacattcagctctattagatttgtacctgaggttgggttcattttactggtgctgatgaatatcaaactacacaatatctacgcacattatattagaataaaacatgttttacattgaaggcaaattttagattcgactcttaataatggtcttttatattaactcagataactagagatagtaaaagaatgaattaaaattccagtgagccaaactacaacattgataatagtaatgagaattaattctgtgttgattttatggtgcctttgcctcgtaggtatatataactctggagtttatgaggcatgtttatagatcttaacttcttaattttgtaatgctgtcctcttaaaatttttgcttgagacggacaaaacctcctgaatttcttcaatttacatgggcatttttactaggaaagagcatgcagccttcatcagattctcaatagggtttattaacaaaaaatgttgagaaatcaccttaaaaggcaggcagctcttaaatgcttgttctcactgaagtccttctaaaatgatattgcatggactctatcagtctcttagcagctcatctgtagaggtaccaactgatcaaaaattcaaagttcttaattgacatactcaggttttttaaaatttaaagatccagattggtagctcagccatatagctaaattgaataattatgcaaatgctgcacaatatttaattggaccttttggaatgaaaataacccaggtgtgcacaattctttgcaatctggagcaaccattctaatatatatctgcaagtgacaacatcttgtatgtaaacaggcagaggaaaagagttctggctgccctcccaggaaaatatacatgaaagaacgtttgtgttacagcatttgtgttacagcacatacatatttctgagttgtttgttattaaagtcccattgtatgaaaacaactatatagacagactggcaatccagagagttggtagttacataaacaggtcccacggctaccaataatattaacacggtattcttagcccttaagaaacaaaacacagaaatttctaatactgggagtttaaagtgccacaatggaaaagcaaactcaattacaaatgctggattccacctggagcctattcttttcattttcttacttctgtttctgccaccttcccttcttccgataacagattttcaagtactgctcttagaattgctaaatgtgttcagagaatgtgtgataagatctgattctcctggaaggccaggttattttaatctttccatttctcacaccaaccatttaactaggtattatttgtttctggacgtcacagctaaagacacaacattttacatgaaaatgtcagtgttgaaaatattatttatctatctatcaaaatgtagccacgcatctgttcttgtttgattctagtaaaccataaccctaaacatgacacaaaaggggctagtgaaatatttgccgagagcggtactctaagttaacagtaaataattgaaaataagtaagtcaaaaccaaaaccaggaaagtttgcattcattcccaatcatactttaacagaacttgcagctgccacagattcagacatcttcatcttcctgtggagcatttgtcttttcatagcagaggacaatctctgtgactttcttatatcactgagaccatcttgtacagtttatttcaaaagcaagagtgttctttttcgtttcatgccaccagtgacaatacgaaaccagatctaactgaaacttcactcaacacattcccgacccgccaccccaaccctaatagcctctcataaccaccgttctactctacttctgtgagttcaacttttgcagtctccaaaaagaagtcaggtcatgtgatatttgtctgtgcatggtccatttcacttagcataatagggggactaagttcaagagatctattgcacaacatggtgaccatagcaaataataacatcttgtattttgaaaatcactaagggagtagattttaagtgttcttagcagaaaagaaaatacaatgaggtaatgccggtataatttagcttgattcagccatttcacaacttgtatacatttcaaaacattatgttgcacatgataaatatgtacaatttttatttgccaatttgaaaaacagagaagtccctcttcagatcctgtcctatgcagctgtcactcacttggctttgtaagcctgcagacagtgtcatttaaaatattttcctctgtaccataacgcttttccttttaatgatatataagaataatatttctctctaaatagttatttctttaactttgaaataattcagcatctcatgattttgatttccatttctccatatatacattttttggggctctgttctgggatttagggctaacctttgtcatggagacatctgtttttggcagtctttgtttccagggagtgaaaatgtgtgtagaaagaattgaatagctacatcttaggtgacacaattgaggaactggatgaaagatatttgtggaaagcaacataattattcaaactggaatatggccattgccctgggtttcatatttatcttcataagcaaagtggtttgggattctgtgcaagtataaggatttaggatttaaacactaaaccacatccctgcacggagcacatgggctttgttgttgataatcatgatagtcgcacaggaaacttgacagtgacagcaggggaacagcacagtatcctacttggccactggtaggaggatgcaatttaaatcctggcatgcgtagaatagcctcacttatctgtggattgttattgtaatctacatagtaagtttcaatcagaactcagttttgtgcagttgatttccaattcccgactctgcatcattagggtacaatgttttctgtaagatttctttgtaatattatagagagaagagcagaacaaatgcagttattcctctcaaagttcagctgaatgctactaatagttcaagaatgtggattgtaatggttctgtgcattgaaagaacacaatggcaaatgacaaagatgacactaagtgtgagccacagctattgttttgatagcccactctgcttttctagttaactttcttacaaccatcagttccatatttaagactagaggatcagttctgatgatgctcattcaaactcttgccaactgacatttaatgcactttaaagttgttaaaaccaagagcaggaaatgttacacttgtagtatcaagcctggctcatgagaaagttccatccactattctggaaaaaaaatagaactagcctgcaggacacaaagctacctgtggtgatccgaactatgcttctcaaaaatctttcttttgtttggccacctttataataggagttctccaacagagaaagagctgcttacagcttcagagtacagatggataattgttgctgtgccatctctgaacatcttagattgagggtcccagagaacctcatgtatgtgaatgttagcacagtacaaaagatgggacagagctttccagagcagtaacagacagctgtgcccagcactttcttctaaaagttggagatgctggatggaaaatttgtcattgtttacatagcacccacacacacacaaaaaatcctgactcactagcttctgtgttgtcatttttttgtccatggttctattgctgcctaattttcatacgggaccctcacagtggttagtctgcacagtaaggagtcaactgtgacatcctcatccttgaatgctagactccccactttctcagctcaatattccatgtgtccaaagtaatactgttagtatcctacattattccaggatcttgtcatgccacttcaagaaacaaattatcaccgctttctaagacttaccaagctaggggtgttgtaaagtatgtatgcaattgacttttgacttttgattcttatgttgaaaggcaacatagaaaataagcttccattaatgtaatgatatagtgttaggaagacagtatctacagtccattcaaaatattctgaaaattatagtattgattttggaacagttttgattccattggccatagcgcttaccttaagtcatttttttttaaaaaaaccgtcttatccatttcatatgttttacaggcactaaaatggggcacagagactaagtcacttagttgagttaaccaataagtaaaattgccttcatattctgcttcctaatgttgtatcttctctagcaagttcaagagagcttactttctggaagctttgcttgttagtaggatgtataacctgtgggaaaagacccagcagcatccacttttacttatctccttgccttctctgaaaacacactgaacagaaatatccccatctctttctccatcgtgggtttttcctttgggccacaaatagtgaacgccactgctttacaaagttattcttttcaccactaatagttctttgatgtcattttttgtacaagtgtcaaagtttttctctagaggcttccacacagttaagttcttgcttttggattctttctaaaccaaataaataaatcttcgagactgcaggttaatcaaatgccttcaaacatgaaggctgtttaggagctaagctgcacagacattttccaacatttaaactcttcatgcagcatcttcctatctcaatttgtacccgttagccagttccacagggcatattgggaaataccttttattttcaatatttatatttgtcttatagatatttgtcctttcaagtaggacaaagtggtaatgacctgcctctatcaaaaaattctacctagtaatccaagataagcagtgtgttcctagtgagttgcttacataaaagccaatatattttgtactgaatagtatacagtgttaaaaactcagctttttgagggacccaagcaagcctaacctacatgattttacaaagacaatacttaaaagtcataaagtactaagtctcaactttcagacttaagactcataaacgttttaattttttatcccttaaaaatgttattttttggctaacagcattgaaataagcgttactatagattaatactatgaaacaggaacaaaactgttgagcagacattctcccagggaaggactgtgtgtgaacacattaaacttacgcataaaagtggagactgtaagtgggttccagggtttccccacgctgactttttaaattaaatgtggcagtattgctaaaaataaaatttagtgtttctcaaattttttttagatagatacctcatatggtactcacaagtagtgtgaaaacttaagtagtatatccatctaaagcagcacaagcaatatgtcagcaccttttcactattaccacagagaaatagtgttggagaccatattgaaaatgactgtagtctggctgaggagatattaagtgaccagatggcctctggcacttctgttttcaaagctgccttatagtgcctttctcactttgtgataccaagctgctgccatgctagtgtccaccctcgaacaccatgccactcagacatggtgggattcgtgtttctgaaggggcacagtaggaagctcattcttgggccttctggcctgcctgagactgtgctagcaatacagtctcattgtgcacaaaagaagccatttttcttaacacctttgagccattaatgaaacctaccagttagaggtggtcaaaagacaaaattacaacaaatttagcttaaagatgtattggttttacttgcaattgtagaattgggcaacaccttgttctataaaatagtatgttctgatgagctgggcaaggtgttgtctgactttatggacagaaaaggactgaagaaagcagaaacaaaatgagaagtagacaggttgtttcaacatttccttctttctaggctttaagcagagggtactttcttatgctggatcaggtaaagggccccttctgcttggttgctatgaatctcctgtttaaaaagaaaacaaaaacaccacacaaaaaaacctgacccattatggtttggtctggttggctgaggcctagggccggagtctagtctaaaacaatggcctcccctaaacttgaacagggttacattgtagaataacataacaggaaatgaaaagagaaatgtgatgctcttcaacaattggtttatggggccttttaaaaagtgtgtatagagtcaatgatgaattaagatgcagtgtgaaagaaaatgacacaggacagatattcagagatcatttgttcagttttaaaatcagattattagtattgctgttgagtcatttcagttccttgtgtattctggttattaatcccttgttaaatgaatagtagaaaatattttctcccactttttggttgtctcttcactttgtagattgtttcctttagtgtgcagaaggtttttaacttgatgtaatcatgtgtctatttttgcttttgttgcttatgcctttaaggtcttatccccccaaaaatctttgcccataccaatgtcttatagcatttccccaatgttctcttctagtagttgcagaaagcacttgtaatttaacagctcaggaagggaatcaaatcattcagaccaactgaagctttcaaaatgttactgcttgaatgggcagaatatccaaaaacatttattgtgtgatcctaacatctacatattagaaactgatagaaaacttctgatgtatcagtaagatgataattacccttgtaacatttctggaagcatgtatgtatgtatgtatgtatgtatttaaacgaatgcttgtatatctagcatctctttcaattgactcaatacccaaggaattttatctccattttacaaataagagagattatgacttatttcaggtcacagaagttggatcacagctggaactttagtccagttgggtctagaaattcaattttctttttactttcatgactaaggaccactctataactctgaggtaaaaagagcaaacataatgaagttatttagagtagtgtttctaaatctaattttgcatgagtcccttggggaacttttaaaacatgtagataaccaggcacttcctgttatcctttttccactgcccctagcagacagacttagtatgtctagcttaggtaacctgggattgtgcaaaaaagtaaatcttcagagtccctctgaatatcaattctcattatgcaattatgactcctaaggcttaaaagtatgaaataaatctgtagagatcttaggatctcctgtggaagttgtttttgtgcctaaagattagcttgtttgtaagttcccatactcagtgagaactgaatattttaaaaaactggtgaagggtggcactgtattttaacgtaaaacatgcaggactagatacagtcacggccattcaattttttaagttgtatatctttgggtgagttacttagcttatttcagcccagatttactgctatgtaaggtgtaattataattattgagtaaaataaactaaagcatttaacacgatgtctggcagagactaagtttttaatactcttaaaaacatcttctggaggtaggcttctagttaattagtgttttaattatgtaattataatttttgtttcctttctctgtcctcatatttgctagaaaaacactatgtcaaccatttgatcatactcatttgtttctaagcatatatcttaactaatctagagacccatattcattgagcttttggaatgactggaaaatttctcaaagcttcctcccttatctacggtttagtttacaaaaattaaataagcttatgatgtgtgtctcatccacccaagtacatctgcagggctcctctattgtaaatcagctgcctaaggctcaagttagacacagtcaaagccgtgtatatttagggtacataatcttgatgtcaagtgctggagtcttgggcaaacttttcatctttttatgtaaaactgatttccattaagtatgaaaacaccttggtggtattgattttatgaaccctgtacattccctgcaatgaagacagattttagggtaaaagaggatgtttgcaagaaatggtgagttttattgtaagagaacttaccggccctatagagaggagaaaacaggttggaatgtccagctgctaccacccaacgggatcccagcacaaagaaaacagtcaaaattatgttcatcatgacagagcaaatgagcttttggggaaaacagaagcaaaataaacctttttgaataatttattattctataaacacaatcataaagcgtaatggtatcagttcaggagaaaggtcccactgctcctgtgttctacgtcagtggctgcagggccacagcaggcagagataaccaagcatgctttcactgccctgatcaccattcccccattaataatttgcttggccctttccttcctactgcctgaagaaaatcaatgtttggcagctctaggttgaattactgtttattttatctttagcctacacaactgcaaaaggaaagcctgagttttccagtgcatattccaatacctgtttatggaagtgagaacgagtcagatagtgatgtattttttcagagagtttcttaagccagctgtggataagaaggtccaatttgcattggaactgctaactaggactcagggaaatcccatctggtttagagaagagtaaatgaaaataaaacagaattgtgaatgcaatgcttcaataattagtttgcaaaacatgtatccactgccttgtgtgggcaaagcaccatattaggaactatagaggactgcaagaaaaacagaaaaacagagtgggctccttttgcaaggtattcgtggctattccaggcatcctttcttctttcagcagtgatctcctgagttattactatgtgcctggcgctgttctgtggactgcggacaaagacaaagtctctgctctcttggagcttatattccagtgaagtgggggaggactaaatgtaaatacatgggcaaaagtcagctaataaatactgtgcagagaatcatgaggagttgatgttcagttagtgagcaggctggttcgttactagggaagatgtgaagggcctctgagaagtaaaattgtagcagagacctaaataacgagaaagacctagccaagcactgagcaaggcaagggatgttcctggaagggaagccagagagtatggccagagcccgagatatcctgggtctggtgagtcatagatgagactggagtactggagtaggcagctggcaggtcacagtggactttcccagtgagtcagggattttgatttggggaaacctttggggattttaaagaggaaagtgacttgatctgatttttattggatactttaagaaataaattttgttttgtatacttaaggaatacaacatgattctatgagatatatatatatagtaaaatagtcaccatagagaaacaaattaacatatctatcatctcacatagttatacattttccccttatgtcaagagtagccataatctgatttagcaaaaatcatgaatacaatacactattactaactacagtcctctgcacattagatctttagacttgttcatcctaaacacctgttacttggtattctctcacctacatgtcatttcctctcccacctctagtaaccactgttttattctctatctctgtgggtattagacattgtttttttagattccacatataaatgagatcatgtaatatctttctttctatgcctggcttatttctcttagcataaaaccctgcaagttatgtatattgtagcaaatggcaggatctccttatttaaggctgaataatattccacttaatattttataatgtgtccatcccttgacagatacttcgattgctttctatcttggctaatgtgaatataggtcgggtttggttccaaaccatttcaacaaagtgaatattacaacaaagcaagtcacatgaatttcttggtttcccagtgcatataaaagtatgtttataccatactgtgctttgttatatgtgaaacagcactatatcttttaaaaaaatactttgataaaaaatactttactgctaacaaaaatgctagtgatcaacagtattcagcgaatgtttttgctggtagagggtcccgtcttgatgttgatggctgctgacagatcaggatgtgggtgctgaaggttgggatggctgtggtaacttcctaagacaaaaatgatgtttgctgcactgactgatttttcttatcacaaaagatttctctgtagcatgcaatgctgtttcatagcattttaatcagagtacaacctctttcaaaattggagtcagtcctctcaaactgtgcctctatcaattaagtttatgtgatattaatatttaaatattttgtcatttcagcagtgttcacagcatcttcaccaggagattacttcttatgaagtcattttactaatccataagaagcaactccttaaccattaaagttttttaagaaaaattaattttaatagttttggggttataggtggtttttggttgcatggataagttctgtagtggtgattctgagattttagtgcacccatcacctgagcagtgtacattgtacccaatatatagtcttttatcccttgccccctcccaaccttcaagtccccaaagaccattatatcattcttgtacctttgtgtcctcatagcttatctcccacctataagagagagcatacaatatttacttttccattcctgagttacttcacttagtataaatggcctcgcactccatccaagttgctgcaaaagacattattttgttcccttttatggctgaatagtattccatggtggatatatataccactattaaagttttatcataacattacagcaattcagtcacatcttcaggtcttacttctaattatcttgctatttccaccatatcttcagttacttcctccactggtcttaaacccctcaaaactctccatgaggttttgcattaaacttcctcccacctcctgctaatgttgatattttgacttttctcatgaatcacaaatgttcttaatggtatctagaatggcggatccttctaacaattttttcaatttatttttcccagatccattagaagaatcactatctatggcagctattgccttacaaaacgtgtttcttaagtaagatgttaaagtcaaaattgctttttgatccatgcacagcagaatggatgttgtgttagcaggcacgaaaacaatgttagtctccttgtatatctccatcagagctcttggatgaccaggtgcactgtcaatgaacagtactattttgaaaggaatcttttattccaagcactaggtctcaacaatggacttaaaatatttagtaaaccatgctgtaaacaactgtcatctaggctttgctagtccacttaaagactacaggcatagtacatttagcataattcttaagaaccctaggaattttgaagtggcaaataagtattgactttaagtcaccagctacattagcccttaactagagaatctgcctgttctttgaagctttgaagccaagcactgactcctcttctctagctgtggaagtcctagatggcatctttttccaatataagaccattttgtctacattaaaaacctgttgtttagtgtagccactttgatcagttatcttagctagattttctggataacctgctgcagcttctacattagaactcgctgcttcactttgtgcttttatattatgaagatggcttttttttttcttaaacctcatgaaccaacccctggtagcttccaactttacttctgtagcttcctcacctgcctcagccttcatagaattgaagagttagggcctttctctgcattagggtttggttaacaggaatgttgtggctagtttgatctatctagaccactaaaatattttccatatcagcaataaggctgttttactttcttatcattcgggtatttactggaacaacaattttaatctctttcaagaacttttcctttgcattcacaactcagccaactgtttggcccaaaaggcctagtttttggcctatttcagctttcaacatgccttcctcactaagctcaatcatttctagctttaaagtgagaggtgggtgactctttctttcacttgaacacttagaggccactgcagtgttattaatttgtctaatttctatattgctgtgtctcaggaaatagggagatgggggtggggggctggagagagacaaggatagacagagagagagagagaccgacccagagagacagagagagagagagacagagagagagacggagacggggagagagacggagacggggagagagacggagacggggagagagacggagacggggagagagacggagacggggagagagacggagacggggagagagagggagacggggagagagagggagacggggagagagagggagacggggagagagagggagacggggagagagagggagacggggagagagagggagacggggagagagagggagacggggagagagagggagacggggagagagagagatggagagagagagagatggagagaaagacagagagagagacggagacagagagagatggagacagacagagacagacagggagagagatggaggaagggcaggttggtgaagaagaacacagacaatattaagttcactatcttatgagtgtggttcatggcaccccaaaatagttataatagtaacatcaaagatcacagatcaccataacagatacagtaagaaaaaaagtagaaatgtgagaattaccaaaatgtaacacagagttgcaaagtgagcacaggcaggtagaaaaatggtgccaacagagttcctggatgccgagttgccagaaacgttcaatttattaaaaatgtatctgtgaagcacagtaaagcaaagcacaataaaacaagatatacctgtatttgtttttaaatataaaaataatttgctttaatgctgaacaaaaatgtcccatgtaaaaaattcatgtgctatctgttcccaaactcagtttccacacctaattacagtaaatagaaaggagagaaaaaccaaactttcaagatggaaaggagaacccaggacagcctcaaacccaacacttagaatggtatttctgcatgcccaatctacagcaaactttcagacttaagaaggaagagagaatggataaaacgttacagaagacagtattacattttaaaaattggtaagatagtagaatgtttagatctggaaggactttaaattaatcttttttccttacattcagataagctttaatgtgtactaaattctatcccaaaatctctattctttgtgaccctactgtaccctacgcagatttttgttgactcaatactccactgcacttaatttgttttttagtctcagctagacctgaaacaactttaggaaagggatagtgtcttcttgcttacttttatttttcctaccaactagaatactaataatcattcaaatgtttattgaatgaattaatggataagcaaatgaattaatataattagttgcttatattttaccccccacactagcctatagctttaaagttgtggtgactacaatgtctagtcacttaacctcacagggcagatttgctcaactaataagattttgaatgagaaagtgcttaaaaattctaaaagtgcttctctaatatttgttactattgtgttcaaagactgttagctaccaaatgaaggtttcatagtcaacagaggaggctgaatcccagacaattacaactgaggcccgggctactccaagtgtgatctttggagtatctgactcagcaaacaaacaagaatcacctcaacccaaaaccctaacccaaatagccatcattactacttccttccaatctccatctccacaccctccaataatgatgaattcttaaagcttgaatacatgttttaattgtaaatttgggttatttctgcatgtaattttacagttattttatttcacccttgtgagttggagttaagctctgaaaaggtcttattttgatgtctttccataagattgtattccttttttggcaagagaacagatctggagttgagctcctgccctctaccaaactgtgaaatttgagacaagtcacttgtcccccatgccaacccctggggcctcacttttcttattcaaaaagatcaaagattttgtcctaactcatgaaatcatgagcattacatgtaaaattaccttagaaactataaaatattcatttcaaatgcatcaagatgttattagctatattttatgagctcagcactccttgatggtcctgaagagaccaaaggggctgaggccaaagggagaattctccttaaatctcttggaaacaatctgacagaccttagaattgtgtagtaagatgaggacataaaggaacagagggtcaaggtagtatcttagctcctttctcccaacgtgttgatactggttaagatacacaaaagggaaaacccacctaagaaactgccaggaattcttttttttttttttcattttgttttaatgctaacttaataatcatgtcttagtgtaactaagcttttcttcatcaagaacattataagctcattgatgcacaggctaaatctttatgcttatttggtgctttttaatctgtctagcacagaatagggcacaacacaggtcttcagtgtgcctttgctgaattgaaatacaaaaaaatagcacatctttcaatacttgaagctcatttttataaagtatatgtgtgtagtagggaattctaaaaactattttttgctggtactagtttatttaatcaagaggaaatatcttcataaagtcaaacaaccagaaaggacagtgcaaatggccctcaaagcttgagcttagcaactgctcccctgttcttagtcttgccactgtgtggaatttaggacttctatatgcagatagtttgttacttgcaaaccattagaccaagcttgtcctacccacagcacacagggcgcatgcagcccaggacagctttgagtgtggcccaacacaaatttgtaaactttcttaaaacattgagtttttgcaatgttttttggtctcataagctattgttagtgttagtgtttttttatgtgtggcccaagacaattcttcttccactgtggcccagggaagccaaaagattgaacacctctgcattagacccttttaatactattataggtaatatattttacaacataaaaaaatcatctgtgtaccagtcagaaatgaaggttttgtatgaaacattttcattcttcagtatcaacagcccaagattctcctgactttatttctccagccctggcccctcacctcaccatctcttagctggccccagatatggcccaggtgttttaatcttctgggtgatctgatccagcctcttgactttaaatggcatctatatgatgataattttcagtttaagcctcccttcagaattccagtttctcaaatccatctggctattcaacctttccactttgatatttaagagacactttgggttcagaagagctaaaacagaactttggattccccaaacttgcatgtcctccaaattttctcatctcttaaatttgattcaggtgtacaaactccacatttgtcatcattcttgggcccctgtcccaactctcttccccacacccagtcaagaagtcctgttgactctgcctcgataacaaattgctcacacatttcctttgctccagctacccatgctgtagtgtaagtcaccatcatttcttgcttgaattctgcaacggcttcccaattgatctccccaattctacttttgcttcccaaaagtccattctccataccgaagccaaagtaatctttaagaagtatacatctaaacaaaacacttcttcacagcaaagaaatcaatacaatgaaaaggtagcccacaggttgaggaaaacatatttgcaaaccatatatctagtaaggggctaacttccaaaatttataaacaactcatacagctcaataacaagaaaacttataacccgattttaaaaatagacaaagtaacccgaatagacattcctctaaaggagacaaaagtggccaacatgtatgtgaaaagatgcttagcataactaatcaccagggacatgccaataaaaatcaccatgagatatcacctcatacatggtagggtaggtattatcaaaaagacaagggacaacatgtgtcgatgagagtgtggagaaaagggaaccgttgtacactgtgggtgggaatttggattggtccagccattacagaaaacagtatggaagttcctaaattaaaaatggaattgccatataacccagcaatgccttttctgagtatatacccaagggaaaggaaattaccatcttgtagaggtatctgcactccatgttcattgcagcattactgtaccgcattatgaaatgggttccttcaccccttttctgagcaccctccatgtctacagaagaagttatgaggaacaaaggtatatgcagggctcgttttgtaatgctgacaacagcaatcctcacatccagacttccatgtccatgtacagggttctctactttcgttctaagtcaaactgtgattcagaaatgagccatccattctcccagaattcctccattcaccccacagacacaaaaatcaaatctatgaaaatgtttttgtatatttcataggagaaacagatgtggaggcttaactcatgtatccaatgccaaaagtcttcaaaatcttcattaggtatttgttatgccaacttctttctcagccctcccggtttgtaactttttaaatctttacccagtgttgcacgaagactgttgagatggttccctctgccttcctctctctagtattctccctgggaagtttaaaatatataatgttatgtaaagtaactcactggggccttcctcttgggcctcacctctatacactgaagacaatgctttctagcaaggaggacccatgcttccagagaggagggtttgcaactggagtaacttgagtatgtctttgggattcttgagctcaacccaaagcagttcagaaacatttctttgaaacaagttcccaagatgaattctaacaactgtaatatcgcatttggcattttaaaaattttgattttacatttagacagagctattaggacatggtgggataaaaatggtagtatcgaaatatactgtttcaaatcaaattattgtattatttgttctcaatgacagacataacccaaacacattcttagtacccagaataaaggcacagccatgaaatcaggcagttattaataaaaacctagtgtagatagctaatgaaagatgaaaatgaagctgtgacatgattatgaactgctattagcaagcaatgtcattttgtatcttagagaccaaacaaggtttgtgtatgtgaactaatggttgacttatatggtaaagatatacatgcattatattcaggctatgttggcttcatttgaaactacagcttccatgggtttaaaaaatacacatatgatttgcaaagtgacaaccctaaattttcgtatattcaattgttcaaaccagtgatttctagaatgtaagtggtgtcctacttgtaagagttttaaaacaggcaattttggaataggtaaattactcagtagaagccttagagaacccaaattgctgatgtatctttttcgaaatgcctctcattatccaggagaatgtgtgtattggaagtatcttattctttaagtctcacacttagaccggttatgtttcctacttttaaaaattgtagaactttattctacagatgtcatttgatgccttttgagaccgaccatatatgcatttatacaatcttaattcaatgttaaaagtataattagtccaaaaaaatcaactaaatggcaacaagggtttttctttttctatattattaatttttttttcctccatctaaaactttccagctgctctttgtgaagttcccagaataatgattaacattattaaaccagagactaaaaatcttggtacggactgacccatggggacacattgctataattattttaaagtaaaataataaaaggggcgtcccatagcgggcaaaagttggactcatcctcaaaatttactctatttgtcaaagtcccctaaaagagttcttaggagtggttggaattggttgtcagaaccaggtgctctcaagtgtcttgcctttgtggttcgcctacctgggtttcccagtccttggttgaacattaatgttctcaacgagatataatactgaatataactcttgtgatctcttccagtggaggctgaggccatttctaaaaattccttccctctgtttcttctacagtatcttcctctccgtgtgcatacatgtgagaggcatagttttccccaacgtacttcagataaaccttattggcatagttttcctcaaagcacttccaataaactttattcctttcatgattgtcctgtagtttacagacactgatattgtactctttggagtggagaggggttttgccattcttacaaaaaaaaaattggctattcctccatttatcaggctcattttattaacattctactgtcatcattgtgctctgtcactttgactaagcccaagaaccctcccacagagcaatgttaattataacccctctatgcccgtaaaatatgccatctaaaggctttgaataaatttgggataaatttcctgaagcagaactcatgaacccatatgtattttgattccaattcctgtcaatacaggttctagttcaactcccaacacacacacacacacacacacacacacacacacacacacacacacctctcacatgctttccttctaattggcaagaagccttcagatgtccttcacccctactggaaaggcatgaaacaaaacccagtaccttcctcctacccctaaactggttttgtcttgctgcccctaatcctagcttgctgttctgtttttctattttcccctaaatgcaacttactttaagcatgtgttaactggattaacattcctacaattgaaggatagtatatgataacccatttgtcagtctagctactttcttctcttttaaatgtctacttacgacgtacatccagactgcacgccctttttattttttcaaagcaaagccaaaaaataaagaaaacgtaaaattagtttttaaagaaaatgcacaatctgtttttaattttggctatcacgaaaaggggaattaaccagccaaaaaagcaaagcaaaaaaaacgtgtcccctgactgctctgtctgtgcctttcaagcctgtgcgtctggttgttcatctctgaaagtgtgtgaaatacttttttctttaaactttttgtttttttctcccttcttgtttgggaattaagtgctttttatattatatatatctatatatatatatcaatgtgtttcttttaattgctagatctttatcttagatttgattttatctaaaattatgagaaaaaaagttatgaattgttttctgcagtttttccccactccctctttaaatgtggaacaacttcagctgcagaatcctcacatccacatctttcaaattagcctggtctcattgccaattgcgtgcaacatgggtggcataaggaagatggatgatgtcgtttggaaaatgccatttctctatagagaagtaattagcaacccagtgcgtgggccccctgcttagtagtgcgtctcaatcacctctgtagatttctgaacctcccccactctagatggggctgtgtggctgccgatgaagttgttcaacttgaatgcataaatctagtcttcttgtttttgctttaaactttttgatcatgactactagtattttatgtattttggctatttttagtaggaaaaagtttaactgtttttattatttgaaaatctttaatgaaactgtaataatttttggagtaattgcatgttgaagaagttgcagcttagggtgtgtgagattgtcagtgttagagttctgttctttatttccatagatgggcatgtgtaggctcatttgtttttgtatattgcccatcccttccttacagccagaagctctaatgcagctagatcactccgtgccgcccttacatggacatggcgactcacttacacatttactcctatcatcttcatctcctgtgtagttcactcatagatatgaccctccccttcctgcatctttccttcccattctccccctttctttagcattgttaaaatttatgtgctgtcatccatctccctaaattaaagaaagcctaaaatttgtcaaaaagacaaaaaaatatatatatctgaaaacttataaatgcagaaattcattcaaaacccgttagagtcatagaattttttgaaaggcaaattataaaagtaaacaggtttttttgtttggtttttcaatcatagcaatcggaattattttaaattcaaaaattgatgccctcccaaaccccccaaagtaaaaatttgttaaagtgcagattttttttttctttttatgttatgtggtgtggatgtatgtgttgttgcctccctgtatcatcctctgttgtaaattattatatttgaaaaattagacattttgctcaaaagtttttaagaaatgacaacaaaaaaagcaagttacaagaatgtggcaattctatttgtccaagagcattcttacacaactttcttttgtaaatttttctttcatgccaaaaaacatgcgggcaatttgttgatgtaagttgactataaattaatatggtatgcttttttagtttaaattattttgcctatatggaaatgatttctttttttcccagaacagcttctatttttaatttgcttttactttttctttccattcttattatattgtgaatgcctcaatgttatttgctctccttctcccagcttactttggctacgaagttgattttattttctactatataattttgaagactatattttttatttcatttgtgtcgatttgctgaattttcactgttatgttttgtgctgaattgcttctaataatcaatgtgaattctactctcagtagaagggggttaatacattgttcttaccacccaaagaaagcctggcctctttgcctgaactttttcaccaccgtgtttaaagccttgaaagtattggtaggctctatttggtatcttaaaattgtttccagccagtgggaggcctgtaccctagaagaaaatgagttgagttagctccaagtagtaccagtggtatttgcatctttttaaaattccttaaaaagcatttaggaaattagttcttttccttcagcaaaggggaaataaggtactctcaagtgactatggtagagtttggttatccaggatcatactctcacttttgcttcaggctacaaaatcaattatactgaaaatgcagatatcaagaatcccaggtgtttcgagtattgttctatgatactgacgccttccagtgtatggaactaacaactggcaaaaacacagacacacacagaaggcacacacacattctctctctccctctttcctttgtctcttctccttttccctttttcatttctctcaaggatttaatcaggtaagctttcagggatcttaagattctaccaagaaaacatgatgattttcatatctaaagttatacttagaaaatatttcaggtgggtaccatcatcgtgtaactacagggtaagactattccttcaccttaagattatttgaaccaatgctgccttatgtacttcaacatacataagattggtaagaagcactatataattttttcatcaagaagttacttgttttgctttacagatatttgtgttatttgaactgttatagaaatatcaaactgaatggtggataagagtgtttccaagccagcagcttaatatttgggctctctctacctcagtttatgcgattttgtgttgtttgacatgctggataatattttaggtctaaaacttagaacttcctaaatgggatgttgttttatcttgatgcattaaaatattttctttctatgaaaaagatatccaaaggtaaatttaataaaatgttatttttaaaaaatacaagctatttgaattataaattatttcttatattctattatttaaaatagcctcaatatataattatacttctactttagcatgaagccactaaataaaaaagggttagaagaaagtgattatgtaagtgtttatagctcagatacattagtagaaataataacattagtaactagcatttctgaatagtagtaggtactgtgttaaccatctaacatataaaaaatacttgatatgcattattttaatatttgcattgatggtttgaggtagggtattttattattctcattttccagagtttaagaaatttgaccaaattcctagcactagtaggaactcctagagagttccgatgttaagagtctgagttacttcagaagcaaagctcttaataagcaaatgaaacactccacttgacatttcctgttttgtaatacataatgatatcaaggggctgtggctcatcttattgttgaaaaatataatctgtagcctttccaaatcaaacctatttcagacaaaccctttgctggggtggaagggtggtggggaagcgagggagaatgccctacctagaaattctcatcctgttaaaatacaagttaagcctctttgagacacttgagtttttctactgtcttctccccaggtacttgccctgtttgtccatgactattttttcccgaaggttgatagagagcaatttcatggttacaagctttatgatatttatgtgttacaaatacacacttctatgtcaccaaagagctaaatatctttgaaaaattaattcttggggggaaaagaattatttccccttatcatgtgaattttcaggaagaaatttggaataatgcaaataagagatgaagtaaaatacccaaatatataaaaagaattcaaggaattcaagcatggtgtcctgtcccagagtctcactgttcagcatcactgttttggtattttcgtgaactctcaaaacccaaatatctccagagaggcaagtgttgaaacttcatgcttgtttttttgttctttttttttttttttccaaagataacccactgcattcactatcacccacaacattctcacagttcagaagaattctattaaattttttatacactgtcttttttgatggcagtgagccccttttgctggatatcagccctagaggcatgaattatatatctacaaatacactcataaagcaaaaaagccgggaagccttcagggctaaaatagaccttttatatctctaatgatctctctagtttaaagaaaagcacaatcctgccaaaaaggggtatgtatgcctgattttaaaatgctaactttaaagaatatagatagcttttatcccaaactaaagaaaaattctggggatagcataggaaattaggattttgatggattacaggttttgtattactctgctcataaccctttatgactttgggttatttgcttccatgaatacttttgtaggcatgggacacatagttgatcactgacttcatgatctctgggaagtgaagaaaatattatcagctacttgaacatttctcagggtagtcacttttgattaaaataaacaagaagctttgaatagcttcccaccaaactacttttttgtttgtttgtttgctttttgagacagagtctcgctctgtcgcccaggctggagtgcagtggcgtgatctcggctcactgcaagctctgcctcccaggttcacgccattctcctgcctcagcctccccagtagctgggactacaggtgccagccactatgcctggctaatttttttgtatttttagtagagatggggtttcaccgtgttagccaggatggtttcgatctcctgacctcatgatccgcctgcctcggcctcccaaagtgctgggattacaggcgtgagccaccgtgcctggccaaactaagttatttctattaatgatcttatagtaggagaaatacatcactttctcctctcaaatgatgtgtgcctttgatcccccaggacactattatcatctgcaatcttaaacatggaatttaatattaaaattaattacaccaacatatacacttgtcccaggcatttttcatgtttacagttatctaaaatgttctacctattttcattagaattgctatttgtcataaggacccccgtgtactgcagttgacttcattttaaactaaaggcaatcttcccacttcttgagaagccaggaaagaggggttaggaaagcttctaccactttgttgtctaaaaatcagcataatttgggctcagattttcccaacagagggtatcatttatcatttttatcgctgctaccgagattaataacaaaatggcaaagaaaactagagatcagtagttctgaaagattttgttttctaaactctgagatggcatacccatcattttagttttaaaataagctcttatcatttcactttgggactcaccaggcttttagaagctctttataaattaacaagcttcagaaccctcttactgtagagttataaaaaatgtggttactcttttttttttttttttaaatctaagatacttgcattagtgtgttaaatgagagggagatagcaaagtaaagtaattcaactgcagagtgaacagtttgtagattttgaaacaacaagtacactgtggaaactttagctggtattgaaaggagaaaaaacaaaccgaaaaaacaaaaaggcaaatttaagactccggttgggtgtcacagatggtacactaaaattgcaaatgaatgccactctgtaatcatgaagatggtgatcttaatcccacttaaagggacactagcctcttacccaacagtttgcctttatattcaaactatttgtaccagggctttgcctcctaagatatcagttattccttgtcctttaacctagtttcctctttgcttactctacatggggtagatttgtcattgccataaggaacaaatgactcggtgtttgtgccagaaaagaacacacatgttaaacctgtgttacagataagttaaaaaaaaaaatcctgccttgtcctctgaaggtaagtaaaactgtgcctgagaaatccttacggaagctttagacagagtccatgggccttcacttcctctctctcatcactgctctcctattactcaaaccttgccctctttcatatatcaccttaaatctaccacttgggaccccctagcagaagaataataaaaaagtttgctcagagttagttttaggactggcttacctttagggaactgcactccaaatcccatttgtaaaaactagcaaaagtgtgtaaattatgcattaaataagttgtaaggcatatgaattatatatgttcacaatgtaaaaaaaagaaaaaaaaaaaaaacaggtgtctgctggtctagtacagtaagtgtgaatctttggcaaatctgcacagatcattttgctcaatagtttcaaactctgagcaccagaatagaggcttaggtttagagcacatactacaagatcatcttgagaatctcaaaaaggtatttttttaaatttcatagtaaaattatcacataggccagagatgacactgcaacattctgttgtcccttcccttctaaatggtacacattatatgctttctcggttccctcagaaactcagtttctttctgcagaacacaattgttattggctaaacagggagagaataaaggcttctgacatgggcaccaacagtttctcagtgcttgaaggtaggtattagctttcttctcaggaagcccttctcttagcacacctgaaacctggacaatttggatgcatgggaaaggtttcaggatgcaaggtgtggaaaggttgcatcttgaagcatttcctatgcattcaaaaggagagttttaatttgtgaatcaatcttcataggaaaaaccctggaagactgtgtaggctccaaggcttattcacttggagtcccctagaactctggtactgaatcacctccttgtctggctttgttactgatgaggtgggtacctcagctacagtcttatctgttaacagctactcaaacactgattatactatcacagcaaagttattaccaagtgtaagagacacacgtacgtggtaccagttgacagctcaatgggtcagctcagaaagaggccttcaacaataacgtcacattagtacctcaaccttctaaataactggggcagggaaacattcgcagcatccctgcgagtggattttttttaagtgatagtgggaatacatttttctggaatatattcaataaagagacatggactatgacttcttaagattcttcctttgcttggaaaacaacattataaagacactgaagagagatcagttatcctgctgacatagatgcatagcaatcttggccttacagtagggtaagcaaccactactgcagaatatttgtggtacccatgatctgcaaggccctgttatttaatgaactattctgagctttctttcccaacttagtctgtatgattctaagtgcaataacgagggtctatgggtaaacagatatgtttttgccacactagttagcaatcaccaatttaaaaaactcactttgctaagtcaacatttctgagtctaacagtttcaagtcatggatatctaggctgagtattttgaaaatctagcttccagctcagcatatattgcatacagcatgaaagcaatgcatacaaatattagactaatgcaaggcaagctgtcatttaatagtcagggggatttctggaaaagcatggtcaaaatggatttgttagatgaatatttttaactttttaaaaatccctattgctcagcttatagtaaacaaggactgtgattaataagtgtgaaataaaaggaagtaacttaagaaaacacaaaagacacaatcttttatgtttcttgatcttggtctcaataagatggtgaatcggtcattctcatcctcctgggagcaaatgagcagaatcccaagaaggcaataaagaaatcttaaacgcatgttaataaattcttaagttaagcacacaatgtgtgcgtgtacccacacatgccaattttgatagccagccagtatttataacagtatcattgactgaatgtcatcagcccataagcagatcctggaaagaacatatatagttgaattttatctaaataattacttgagagtatctttaaaaaatctaagcccctgatctagggatttcaggtttgggtggcaagaggcatacagaaggctccaaatctgcctagaatgattagactccatccagaaaagatccagatctttttattataatttctgaggcataatctgtgaatgacgttggttgagtgagagttgtttacaaatatactaattgtttttctttttcttttccatcccaggaggtgaattagttatccctcttcttgtagaagaccctttagctacccctcctattgctactcgtgcaccttccattacactcccccctacctttcgccccctcctcaccattattgagaccaccaaagattccctgtccatgacctctgaggcggggttaccttgcttgtcggaccaaggcagcgatggttgtgatgatgatggcttggtgatatctgggtatggctcaggggaaacctttgactctaacctgccccctactgatgatgaagatttttacaccaccttctccttggtaacagataagagtctttccacttcaatcttcgaaggtggctacaaagcacatgcgcccaagtgggaatccaaggactttagacctaacaaagtctccgaaactagtaggactactaccacatctttatcccctgagctgatccgcttcacagcttcctcctcgtctgggatggtgcccaaattgccagctggcaaaatgaataaccgtgatctcaaaccccagcctgatatagtcttgcttccgttgcccactgcctatgagctagacagcaccaaactgaagagcccactaattacttcccccatgttccgtaatgtgcccacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagttaaaaaagaaaaaaacaccaaaaaacaaaaacaaacaaaaaaaaaaacccacaacccttatctggttctgaccagtgtgcgtgtaactttatgatctgaggggaaaaatggcttttgggtttttgtttatttttttgataatgactggacatcagaagaggaaaaaaactcaaaacaaaagcgagagagactattgccatatgaactcaaaagctatcatggtgttcactctacatatcaggttatggtgtctctagaatctgttgtttgtttcctataagatgctttgctgaacacatagcaaaattcatgtgacggatgataaattgattcgaaaagctggtcccccaggatctaatttcagaatttaccacccaaacccggaacagatgggtttagggctggtgttatcagagctattggctttacgtaacaatattgttcctgtccattcacccagccaaattgtgttaaagaggaaagccccacaaactaaaacagcctttcctagggaagaggaaggggaggtgggctggatctgtgactgattgaaatgcatgcaaataaaaaagacaatattaaagtctgttatcaaaccagacagtaggggagttcaactcgtgatggaaccacaaaaggtcacacaagccaaccatgtcatgccagagtacaaaacacatagttctttccccgccccgaatgtgacaatggttttcatagtggtttaattttgtagcctgacatttatggataactctgtccttccatttgctcacttctctcttcacccatcttttttaaaaacaaataaatgaataaagctgctgtgacacacacacaaaaggaatttaatagtataatatatatataaataaatatatatacagatatatttatcatggtatgtttgatgggatgactgacacaggaaatctgttaaagtcttaaaatggaatgagaatgttgttttaaaagaaaatagcaaaacaacaaaaaagcaaaccttaaaatgtgaagaaagtgtgaattttagttttgtcacagttaactgtgtcaaagagaattaaaaaaaaaaacttcagattttgtttacatattttactacatttttgctggtataattccttagccacctatgtacatactgctttaagaaatgtttttttcctgtttatttctgtttggtttatattctggttgtctttttctttttgtaaagaggaaacaatgtacagaaaaacaataaactggttgtatggccatagctatccgaaaagcaagagacaaagcaagacaaatattcacacaaaaatgaagtgtgtcctctggagggtcagatatacaatttcttttgtacagatgaaaatcaatcagctgcttagatttagaaatctactcttgctggtctttgtaagttgcatgaatatttgactttgaaaaaatatcttaacgacatggggcaaaaagtgcaatctaaatggtagcctttactaatgtgtgtggaaagaggtgttcctcattatctaatatttcaatgtgttaagagtttaatttttttgttatcattaaaaaagacaggattataaagagatatcaaagcacgattttagataacctaaacggcccagcctatacgaagttgattatatctcgatgtctgtaaaagattgctgttcttggagtcttgaggtcttgtgaattgatttcctgctttctttcatttttttcaatttaagtaataatacatttgttatattcctttcagtgtaagtttctatttggacaattttatgggaacatgtgcattctctatgtgagcttctatcatattcctgttttattagcagaacctaaaggaatttatttaatgatgttgtgacattactgctttttcttttttcttttcttagttcatatttgcattttcgttcaaggatatgcttagcaataaaatgttcttcccaa

SEQ ID NO: 83 - DNA, 1162912 bp, Homo sapiens
gaacgtttgtttcatattttattgaatttcatttatattaaattaaaaatatatttctgacagattcatgtaacaaaaaggcagaacagttttcaaattgttcagctgggatgatcagtatggaatgaggcaaagcagttcgcattctataattgccttgtacaggtacaattctttcccaagagccaaaagaggatccttgagaactaacggaaaagcctaattacataaatgtaaaatactgtttctccctcattctcaaataacaacaggaatgagggaaaggaaggaggatgggtaaaaggttggaggagaagaaagaataagagaaagtatactaaaaatatgcctaacattaaaaaagttagtatgtgttaggtgcatgatccttcatcaataacatggaaaaaaatcaaaataacattacaccacacacaattggcatatcctattgtgtaagcgagtgcagaggttgaacacatcacaatagtgctgaacacagaatcacaagtaatgtcaaaatgataacttccaaccaaaaaagaaacaatcacaggccaattacttatatacaaatcaaccctaaagacaattatgttccaaataaagatgtccacaaaagaaaatcaaagcaacattatacttatttacaaatgcaactagccatgtctttaacaagctataaaaatactattcacattttcaaacatacagtagtattttttgtttgtttatttcaaaaaggcagctaactttgaatgcagggatttaaataaaacattgatggcttaccagcaaggtatttttgcaccccaatcctttgaagatacttcacaagagagagggcttgttttctgcttacaagttaagaaaataaggaagtgagtacaaatgtatacaccttaagcctctgccttttcagtaaagtgactccctctctcacccaaactgatgtcagtaaattactttgatgcatgtataagatgaatgtttgagagtagatttaagatgactttttttgtgctatgaattgtcttccacattgatctcattttcatttgatcttcttgtaatggtgctcaagaaagagatgaactagtcatacaccatgggaaaatgcggtttcagcatgcagccacgcaatccctggtgctctcaacatgagaaggagacacaccagccagggagacaggcattcaaagttagctgccctcacacagctgctccgtttaataatcgacccatttaacagcagtaccagtttatgctacatatttcaaagtaccttactttaaaagaacaccttacatatctacatttagaaaataactttcgtagttgattactggagtaatcccaaaagggttcttggagtgctatggttgtagtcccctcactcccccctcccagcccctgagagatccagaaatatacaggaaaatgactctcacattaagggaaaaggacaacccccaattaactaaaaaatctggaaatgacatttgaaaaccagattcgtgtcaatatacaggaggtatgatttgctttccttcacaaaggctataggcctgggggaaatatctacgcattggggataaaaatagcagtaaaggcaaagtggtttggacaagttagactattgcctacaggtatgaatctttgttttcctatatttgtatatttgcacaaatataaccacttctcatgatatagggaaagctcactagagcatgaaaagaaaaacgtccataaagagcaaaagtaggtaaaggatggcattctattaaacaacatggattttcattaacatgaactgtcctcattatgtatttgttagatggatgaatgatccaaaaaagaattgcaggtggttatcaaagctgaatagcctttacctttatgataataagactcctcatttgggagaaaaaaatttacagcagctacaaaatatttacgattaggaaccaaataagatgaataaagcaaataagttaatttactggcaaaaataacttcttggttatatgtacagcttttatgtaaagattaaatcgaagttctaccaagtgtatgtggacatatgtgagtttcaagattcatcacagggctaactcgtctcaaattcctatagggaaggacacagagaattgatcttcatgggaaaccataattttaatagcttaaatattctctatgcggtagtttgatagttcacttaaacagtgtccaaattgctagaatctcttatgaaaaaatcaggcattcgagggcaaagatgaagtcagtgtttcacaaagtggggtgtaggatctcagagatccactatggcttaagaaaggaacaggacagcatcgggggactactttgaaccagggtggtagaaagggaagagagcagtgccagttgtgtcaatgggcaaaaaagggaaggattctattttcctctaaaggtcagagagaaatacatttttctttgattcctaacaaggtaatcacttacttgcaaagctgactgtcaaagagtattttccagaggaagcatgtgaataccccccgtgaaattggggcttagagtcattttagcttgtgactatagaagcatttacttctgcccaaaatgtcacctggccaggaattaggtgaggcaggggcctgcaaaagtgacagatcctacatttttggacctctacaaaatcagtgagacttgaaccgagtatctgaaatttctattattttagagagacttttaatgaaaagaaaaaagcagctcacactgctaaaagatatttgcccacacaaacacaagggcccctggcccgacacaatgcccacaacagcttcttgtttccaactgcagagagaactcagatctctgggatcagaaaaattttattaattctacccagaagtataaaaactggccccattgtaatatcagtaataatgaggtctccactgataatgatcttttaaaattatgcctgatctcatctgtataatatttgttcttaagcaaatagcaaccaggcgataccaatctgcatttatatgtttacatggggcaaggctgtccttcaaactgatacacaccgaagtccatgtacacaaacagaggcacagtaagatcctctgcccacagtatatacagtagaagttaatttatctgtttctttttttttttttaacaactagaagctgatgttgtaggatcagctctaggatcctctgcccacagtatacagtagaagttaatttatctggtttttttaacaactagaagctgatgcacatggatttctcatttgccctataacaatcatcattctaataactaaagtccaaaagaatggcaatgcaatagtttgaaacgcttggtttagcatttatttatcagaaaaattgtgattctttgttgtcatttttggaggcaagagggcatagtgagaaaagaaaggacatatcaccaattaactgtattttgtttgtttgctagctaaatgacaccactcctttttttttttgtctctgcataaggtaatagaacatttacattttctttacttcatcttgaagacccttacttagtcatatgtaacatgtttgcctattaaattctgcaaggtggtgtttatttaaaaaaataaataaatacaattttctttacatttaaaaagtgataaaggaataagagaatgagaaaaaattgttcattgtaatgctttaaagcaagttttcccaagtggaaccatatatgcctactttcagctaaacccaacaaacaacaattttaaatggcaaacttatctttttactatgcaaaatccatcctacatttttatatcctgcatttaactttgttacattatacttgtggttagttttctagtttgatttatttaataatattaaaatcatttaacatctgataacctaactaaatctacatcttatagcattatcgtggttctgtccagttatatacatgctttcatgatcaccttttctattaccttatgaactacatatactagttaaattatcaacaattacagatggatgaataattccagttttgaaataaaggttagagagctctagaaaaacttgtatttacatccttccctgtcaggcttaaacaattttaattttcttttcatttttgatacttcaagaagcacattaatagtccttccaacttcatctagtagcagagcctcacacagtccttttcttgatttttccttagcattgtaagtatgcacaatcttcatgccatgtctttcctttagaaggtattagctcacacactataacacttaaacactattccttctcttaaattagatattcagtccttctccctaatctacaaaaaagaatcacttgattttagtttgtgtgttttaatagaaatttgagttttgcgttgtttttcatgctattttaagaatgttactggagaaaggattctcatcctaagctgtgctactaatactatgcagaaaaccaggagctgcttggtagtctaacaccttttgtggtgcagatgctttgtggttctggatctatcctagatcagaggccatctttcctcacctgtttaccactttctttaggcaatcatttaactgcaaaatttttccatacctgcccaaaataggtataatctacaaagttgggtgatttaaaaaatatactccgtgtaattttaatactaatttgtctcagatttacataattgattctgcaaatttcaattgctacaattggcctctggaatctgatatccccccaagcactttgaagactttaactgacattttaaaattctaccctactggactaaataagttattctctggaaggaatgaaactttttttctccctcttatacatgctgaaatatgttttcccaggggggacaaaaataaaacaaaaaacactcaaacaactgaagtcaattatatactacagaaatcattcaaaagaattataaagtggtgctattataaagcatttgggtcattttggattattcctacatgcatctctaggtattacccaacatgtagaagtcttgtgttcttaggaggaaagagacattcactaaatacatttctgttaccttaacagttaaaagtttgttttaactattcattttttccttctccaaaatgagtgattctgctttctatagcccagtagaaaccatatgcatattgtaaatcagaaaaaaaaaatcaaggtatagtatccaaaaagagggctgtgatgactcgatgcagatttatttagaaagggaggcttatattcaatttttcataagtactgatatgagatcccttttcctagagacttctctgaatggataggagagccctgagctattagattgtggcccctgaatcactctgtgtctttacccctgaaaagtttgagggtgaacttcactagaaggaatctcacaaacccttctcctgctctaccatactttttcagctcgcctcacttcttatagcttagaaaaaaaccaactccaatgtctccaatattcttggccaaggaccaccatctgcttttggtttaatggtgaagttagactctagataggctaattagtcagtgatgcaatattctcctagaccagtttatgtttgaataatattattgaaattatcctgtttgtcaacatcaacaatttgaaggatgtttaacttatatcccaaatgagtttaaaggagatatcttacagtacaactgattatatgacagctattcacaaaagagactatgcaatctgattgttggaacgcatagaaaaattaaaatgtcattttaattaaatctcctagatcatagaattttgaagttgaggatgatattccatttatctgagtgttccccacaaaacatggtgcttttagtagacacagttagataaaggaggtttggatggatggatggatggatttacttgttcagaataggaagaaacacaaatttctttggatttttttctctaaactttctctgccttaatagatatttttactctaattaattaatcttatactattgattctaatttggtcccaatattttaacattagaaatattttttaaaaatctaaatgacttggggtagaattttcagaaaagggcgacttatatctaagtttcctaattattgatgtgaggccccctttacttggagactcatctctgtcatttgttctcatccttcatctcatcaggtattctttcaaaatgatacataataatgatggttctagtactggatgcagtatatgaagaaagggaattatataaagtatcaaaagattagtgtgttggataataaaataattgcatgagaagatgtttcacatttatttacaacttttgacccaaggacctatccctaagctttgaatgtttgtgtttttctttttattataccaatttatgtgcaaagagttaccttctacttcatataaatagtctcatactagaaattccatggaattcaagccaatccttactcgcattccttcttacgaagtatacgaactgaacaaatttccttgcgtagcaaaggtgacatatgaagataatgtgctggcctctcatcatagtccctggataccgttgcaaggttcctaatttgcttggtttggcatttccacagtctttatcttagctctttttttaaaaatgtacttaaattagttaatttgctggttgcttccatattgcttgattcaaaatccaaaatggagttcagaaaaagaacaaataaaattacagcttaagtgcaaactacatttctgagtatctgccaggtagacatacccaatccagtgtgtttcttccagttcaatggattccctcattgggccacccctgaaagtatcagtagttttcctgaaccacagagaactgtctcttagtttcccttctactcttcagacaaccaacggcctatcaagtagtgtcatttatggagaaaaaaaaatgttgaaaaatgtaaaggatgagggtgaagataatttgatagcatgaaaaatattagcctccctttcttattttaaagattgtatacttaaagtagtggccatttcactatattaaaatatttcttgcttaaattctgtgaagaagctttgatgtaaacatctttgcaattagaaattaaagccaaaaataggggagcaaatataaaggaatcggtcagagcaaaacaaaatgaaaaaaaccaaaaagtgttgaaaacataattactagttataactttaatggagatttttaaattatgaaagttgagttggccattcttacttgctaggacagaaactgctggggaaagaaactggattctcaatttcagacaccatcatatgttatagaaaatgttattcttttgttctaatggaaactttattatgatttccagggatgctaaatatgcacacatcagttcctgcagataggaacagatagcatgggtgtttcaaccatctgctttaaaaaaaaaaaaaaaaaagaagaggaagaaagaaacaaagaaagaaaaagaaaaagaaaaaaagtgacagctagtttgatagtaggcagcattgccttacattttctggtccttctctagctgtttcattctcctgaccaacccatgcagagaaatgaagaaacattgtggttcctcctatctttctctttcagtctttccctctaatgttcaagttaggtaagcacataactatcattgcatctctgtatcttccactgggaagtgtcaaaactactggccttggggtagaaggaagaccaccagagaaagagaggggggtggggaaattggagcaggtgtgtctctccacctaaaaaaccacaactgagcttacaccacagtattccggtgtctgtaaggtggaggcggcagcacagtgcctggcttcagggagaactcagagaggtattcaggattctctgccacaataggccggatccgcccattctgtttataaaaatattttgtgctgtactcctgcaggtagtctgggtgctgaagggtgctccgaggtggcaggctgtggttccagtagtcagggttgtcaaacgctttcttggccttctctggcattgacagtatgttgttcttcaggtactcagcttttcccaaggtgttggcaaaggtgttgaggtacagtggctcattcacatactcatcctcggccttgggtggaccattggatgcattgtgatattcgggattatccaatgcttgaaggtctccattttttctccgagaaacaaaagggttctcctccactggattcaggtattctaaaggaataaaaaaatatcagctaacctctagtttctggaaaatattaatcagaccaaggttatacataatggttagcttctttgtctagaacaaaaaaacccacagatttgttttcatgatttctcacaacaagtatttgtggatcaccattgtcttatgaaaaaaagagtaagtgggtcaaaaatgtttataataaaacaagaagccaacgaggccagaatcagaatttctatctcctaaatttttctttctttctaattgcatttgtctcttctgcatatggggctggttgtttcaatgtttttgttttctaaaagttatttatattaggaaataagactacctattaggattaaatagtctttaaatatacagacaacttaacttctataaaggatattgaaaaaacaagaatctatagctgagttccatgccaagatgaatagatggagtgaagaaatcatgttttttagtctctatggtttgctatgattgcctatactggtaacaaggatttaattggagatgcttctgaaaaaggttttacacatggaaaagaaagcatcaaaggaaaaaaattcaactaaaaaagcaaatctaacagatagctaacatgcctctagttgacctgcttgacattacatatacttctacttaatagtaaagtataattataatatttccattgaccaatcataatcacaaagtagcaaactatcagcttgaattatataaaataaaataaattttgtatattgaaaccagtcaattagtgcctattttgtacggatcaatctaataaatccatctagtataggtattggcctaaaaggtgctaataattatcaccattctcctgaagcttaattccacatctatgtctataatatagactgcacatagacataaacacgcatgtattgtaagtcctctgacagtcctctcttttactatatacacaaagccctaagctattcctattttgaattcaaggcatgaagagggcacaattctttgttgagaggccattctgaaacaaactttctgtcttttatccttagcccaataagtagagagaaaaatcctattaagtgaggattatttttctccaaatatatatatacagaataggtaagtatttagcatcatttattcaacttaaagggcagtaatgaatatcccactatcatatataggcctttacaagacactatcatttcatcctcccaattctgtgaaaaagaagtacaagacttatttttccagctttgtagacagaaaaatgagattaaatgatgtgtgcaggatacaattagtgttgggatagaattcaggtcttctaactcctcttgcataatcttcttattctactgcactgttttttattattgcccctgcaggagttgggtgaactttatgcttagtaacaagttttaatttgacaagtgtatgaaaacatttataaggaatgcagaatttggtctctcttaccagattccttaaacttcttaattgaaagaataggaatgtctacactaaaattctgtactctctgagtacgaggttagactatagcaaccttttatagaaacggagcttagtgttcagagataaaatctgagaatacagtgtgactctatagggtgacttgcttttctcttcaccttacctttcctcaatgcaatctacttatatattgtcctcatgcaaacttatatagctgtccaataactttacggttggagtgaaaatctccccagaaaagattcttctttggggtgaatctgccaagtcttcacaacgtctacatttgtgtcattactaggctactatgagcatccaaactcttcattacatttttatatgtatagaagttttagatatgtaaaaattttatctagacagatatattttaaaaggttatttacaattagagatctctaaattttactttaaaggagagaacataaccatataccaggcccttctcagagtcttaaaatgtagtttactgttgacactaaagactgcgagagacatgatcatcattttttaataacaatcatctatcttctctgttgtgatactgttagcatagaagaagaaaggctgttttgttgcaaaattgaagcattatttgatttgggtgcttaacatttctactactaactttacaaaattattgttatgctttgtaaaaccacagattattattttcaaatcttggtggtatgcttgtaagtatatacagggtcaaacctttaatttttgaaaaacgtcatataagaacataatattttcctataataaactaggttgtttaaatgtcatcatttaaatgagtcaaacaaatcttttattagtgccatcaaaagcatcaggcacttttgccaacaataccagtctttctgatctccgcaattaagtccaataaagctatggtcctgacactttgtagtatgctacttcattcaaatatttcaacaaaatatgtttagaatagtgcttctcaagactgattgctgtatgcagatagcctggggatcttgttaaaatccagattcctattcagacggggcctgcctgagattctgatttatataaataataataaataatgtggatgctgctgattcagggaccatactacaagtagcagtagcctaggcctttactggatcacaaatgttgtgctggtcagctatctggcaatttctattctgtactttgtttatcttgatggaagtgaacttcgaatggcgatcgtttctgaataatcagttcataccttgtttgggtttgtctcgcataggagtcatgtaaccttcctcatccagctctcctcgtgggctccgttctggggcaaacacggtggggtcagcactgtacctctgggtgctactgtcctcttggacatggggtgccactggcttgcgtagggtgccattacagcaggagtcatcaaaaatctcagcagtagcaccctgtgccacaggagcttctggaattgtgctagttggggctctgtagggcacagacactccttgttcagcagcaaaacctccatctcggtatacaaactggttctgttaataagagaaacatatgtggagagaaggcgttgttagaaatagtttaaaaatgaatgttaatagccacaaggatatcaaagccagtctttcagagaatagtcatagtatttactggttttttttcccctagtggctaatggagttacaaactataaacacctaaaatttccacttttcttaaaagataaatcatcagaaaataattttgaaatacacattctagttttattaaccaactgaaacatattctaataaaatgtatttgatgcccttttcccacaagtgcctatatttaatacaaatttcaaagtgaatttttatgataaatgcaagtgtcattaattatagacagttgtcattaagaatagaagtacatggatatattttgaataatcctatgtctttattcccttcgaaaattctgtggttattatgaatttgaggctctagtacctaactagaggatcatcactataattctgactttttagtacatgaccaataatcagggaagtaaagatcacctccacatccagaagcataatttatgtgcccaggtaaatccttcagataaaaattgaaagctactgttgatgcatgatatctcaatttcggattatcagctgagataaaaacacatctacaaaggcagctacacgatgtacaccaaattcttaactcactgttggcaaaggcaaaatgaggaaattatgcagagacgagagaggaaacatggtaagcaaagaccgaaaatcctaaaagatgaaggttgattgtgaaatacttactcctgacatgggggtgtaggcaggaggagggctgtgtccaatttcactctaataggaaagaaaaatggaatgatggatataataagaggcaatatgaatgaaaaaattaaaaaaagaaacgaaaaagaaaagccacatgggtcgtatgaaccaaaggggaaaaagtgcacaacagtgaagcttcctaagcagcacaattgtatgcattctgaccataagcaagcttatttatatgttttgaggaaaataaatattttaattcaatccctgaaaaggaaaattgtacagaaaaagcaaaatttttcaatggattagaaaagtaaataataaacattcttctgattaaccctagaggaaaggaaaagtagtaaatgaactatagctgtaaatgggaaacagtttccttctttacatgtcaaaagattgaaatggccatattgtctgctgttattttttctcttagaataaatgtttctggaaggagatggcaggagatttcgatttgcctggactaatttttgctatcaagctacatttatttttcaccacttcagcaaaaggtaaactccttagtctctcctgattaaaaggtatatgctattttatcttcagtctcacattttttttgttttttttttttaagttaagaaagagcagaaaatttggaaaatcaattcctttcctgaaaacatgctttagattccccttatggtatttataatgagtcaaaatcagatttcagttaaagaaacaacaacaaaaatacatctgtatttttatagcttaacgctccatcctatgggctaactgaaagaggatataaaaatctaataaaagatgaaggacagtgttccttagggtaaggaaaaggagttgtataatactaattctgtttcttaatacaaaaatacattaaacacattttttgagaacctactgtctatgtgccaggcacttttctaggcacagggataatgcaaaacacagacccaaatcgcttgattttatgaagcttatattctctgcgatccagctttaagtaaacagagatgactaaaataaacctctaagataccttacatcttgtttgtttgtttgtttgtttgtttgagatgaagtctcgctctgtcacccaggctggagtgcagtggtgcaatctcggctcactgcaagctccgcctcccgggttcacgccattccctttcctcagcctcccgagtagctgggactacaggcacctgccaccacgcctggataattttttgtatttttagtagagacggggtttcaccatgttagccaggatagtctcaatctcctgacctggtgatccgcctgcctcggcctctcaaagtgctgggattacagatactttacatcttttaaatgaaacagataaatattattccaggtcaatgttcatatgatttagattcatgaagcattctaagaagaatatggtcccatggagattaagtgtttaaagtaagtcaataacaactggataatataatctcccttaactaacttagtctgctggactaatcaagggacatggtctgaacccctatagtgaggttatatcttaattttccctacaactatggtggtattagaatatttatctattttcttctttagtaacataactaacaacacctcaaagattatggcatggaaagtcagagatatatttaatatgcaatacataggaggtgctactatgcaacagacagatcgtttaatgacctgggctccagttccaatgataagtggtgtgaatttggtgaatcatgaaacctctcagaccctcattttcattcttggcctccctattttattattaataaatatgaagtaagataatgtatataaatgaactttgtaaactctacactattataaaaatgtaaaggatatatcaatcacatttaaatattcatatctactaaattgaatttttaaaataaagcaatcaggatgccaaagctactcatcagaggcattttaaaatgctcacctgttctctaatcaccttaaatataggcatgttttactatattttagaaatacctgaaatccagtacatttgttcataaaatttgaggaaagtattttttatactccagtgatttgtaatatagagtgatagtacaggaaatatggaactgcctggtggaactttaccaaattacaaacactggccttaccctcatcattaaacaccaattatttggcaagtatttaacaaatatttactaaatctctacagtgaaagcacaggcactgtggtagatgccagcaataccaccatatattaagaaagacatggccactgtcctttgagaatttgcactatcaattataatctaagattgttagaagaaaaggcaagaatgaaacaaggcaatttatttcaagtctatggttatatattagaatgccaggtattccaaaatattcataattactagtgctcctttgacctcttaccttgcaaaagttgctgtactgggtaatgtttgactagaattacagctgagaaatgagtattgattgcacattttgcattttacaaaacctgagacgtaaacaatcaaaggaacaacttacaagtcattcttcatcagggaacagtttattatctatattcattatctgggctagaatggcttccattgtaaaggcaacggattaaaacaactgggactcttgcggttagtctgttccaagacataaagcgaggccatgccctattagaatgcatccactgtccctgctttgacaagtctttcagtcagcaacctgccaactctgtatctggacaaactgccaaatagcatcacagtaataggagcatcttcatgaattttcctgttttcagcattaaaatggaaaaaatgctaagcaaaacccctttagcattcattgtttttagggctactggctgctttttttatgtttctgtttccattttttcagtttgcttttttatctgttttccatgataaaaagcacctcattcacttccccgtggaagggcaatgcagctccaagggaacatctgtgaggccaattagctgggctggaaatgtgatataattgttgtttaaatatatttaaattacatgttaatcacgatgtcataatttataagctttgaaaataactttttgtacttgagagccaagccagattttacttgtttttgctgtttttagtttgaaaccagctcttctcatttctctctccctcaattccccacacttgaagagctgaacttttaatattggaaagaatgacagctgcaagtaaattggttgagtaaaaattaagatcctcacagcagtcaaaatgagctggagtgaccttaaagttcgaagcagaacaaagcaatgctctcagttaaaagcttttgtttttccattgtgctactttctgctgtccatcaaagtccagctttgcagatctttaggaagcagcactgggtgcatctgttcaattagctggtgaggcgatttactgtcagcagggcagagatagaaagaggcgggttaggaactggcaggtgatactgagtttgttcctggtgggggggtttgtaagggtgatggatggaatgagtttaattctgtggccatatcgctgggagattgtatgattaacttggacttaaatgccagagattaaagagaaggcaagtatcagtaaatgaatcaaatacggtattaaatgcacttttaaatacatcatgttctaaaatttactttttagttgaatgataaatattagaacctttgtctcatatgcacagtatttcttatatttgtattatttaatattgttcctgagaaattttatttattaaatagatggactgtatcttgtgatatttttaaaaattattatacaaatctactttcggaggaaacaaaaatacaggcctaatgcctagcttctatctaaattaaacaggtgatcaatgagagtcactttctaatctttaaataattattactttcaatagtaattataagattacaatttctaggttcaagaaatactccaaattcctttgactaaaataaaatgtctctgtaagacgttgctaatccatcagcactaatttattatccagacacttccacatagtaactattaaaggttctcaaccttttatcctccctgacatatctgcttaacactctgatgagcatctccacactttcacaggtcacatagcaacatacagaaaatgtttattgcattatgttataattattgcattataaattataattcctgatgcatggttgtaactctgcatctttctcacaactgagttcaacataccagtgttttgagacgtttagatttaggaccttcatttttcacagggcaatcagaaggaaacaaacagaatgtgtccatatgtgccaaacccaataatggctgggaaaagcctactgagatttcagctgctggctgaattttatatatatgacacataatgtcttttgtctatttatgtatacatatatttatttatttagtcatttttctatttggtttgattctgtgggactctacttttttgaaaaaactctcttactccacacacacacacacacacacacacacacacacacacacacaccccaataatgactctatgatccagttgaagaaatattgacttgggctcttattcttttttgttgttgtttgtttgtttgtttttcgagatggagtcttgctctgttgcccaggctggagtgcagtggcgtgatctcggctcactgcagtctctgcctcccgggttcaagcaattctctgcctcagcctcccgagtagctgggattgcaggtgcccaccaccacgcctggctaatttttagagacagggtttcactatcttggccaggctggtcttgaactcctgacctcatgatccacctgcctcggcctcccaaagtgctgggattacagacgtgagccaccgcgcccggctggctctcattctttatccactcattaatcttggaacctttcatctttcatatatgtctcatgtactcatttaattaaaaaattgaacaaatggaaactatgagtggtatctgtaaatatgaacaagagtcaagacagaatttacaaagcatatggaaatgctgtcttttataatgcttaataatcctgcttttcttaagtcagtcctcaaagtctacttttattgtgtttcatagatgaatacatgataactcttagggaaattaagaaatagaaagagaaactaatatatattatgtacctaccctataccatggactattttaggttttatttattcttataaacttgtaaggtaaatagcattattaaaaattataactcccattttatagacaaaaaaattgtggagcagagaaattaaaggatctgccatgtgcacacatccatagttggctatctgaccacatagcccgtcactctatgaccttaacattataccacacatagattttgactttagcatttctattcttactcatctttgccctgtctcttcctttgcgttatgcctcaactattttctcaaacaaattcttacagtttctttctctagttttagtgaaaagaacttaatgacttaaggaggcatctgaaactcattatcttaagtataaaatgctgataatgtgttacattactgctccaccccacttattttcacttaaattagttacaaggacataaactggaaagaaggaaactttgagtattaagagttaatagcgtgtgtgtgtgtgtgtgtgtgtgtgtgtgtgtgtgtgtgtgtgtatttttccattctttcctacaagtcctttttatctaaaatcatgttgtgtatatatacatttacctacctcaccaagagcaaagccagccctgaagcaggaggagacaattttaaataactggagagcacaaagatttttcatgacagcactcttgcttatggatttattgttcctagtacaaggcttagtcaataaattcttcttcctgcttgactgagggtaagtaagctattgtatccccgggcagcaattcctatgccctttccaaatatcagtagaacaagaggatatttccttttaaaatattcatggctaaatgagtcaataaaatgaaactgaaaatctccctcactttacaggttcctgctttaagttgctgctttgagcaatagtatgtgatggaatcaaagaatgttattagcacagtcaaaaaagaaagggcataaagaaatacaattttccactaatgccaacattgcttagcttcattcaagataagcaacaagaattgtgtcacccttcttgagatgagtgatcacacagaattgatctctttaccctggtgcaagttctgcatttttgtattgtttggttggttctagcaactttctcttttttggcatgtttatattcatttccattagcatgttgtcataattgaaccttttcctcatgatcacttagctactagctaatgcatatagccagaaacctaaagaggaaaacttctaggagtttctcaaagacttctcagtaattcttttcagttagagagggtaggctctttttctttctttcttttttaatgtatgcttaagaacatctagttctaatgcaatgtctttaagaacagaaatgaaatcatcaagccttttcgatgtgtaaattctggagtagcctaactgattcttcaaatgaatcgtgaagttgtctctgcttgtgtggtttttatcctaacctcataaagaatatctgatgaagatttttcaggatgcaaacaatgcactggatcgggcaacttttttgaagacaaaaaccccacagacctagaacaaatggtctcatgaaatccttctacctccaggattgtattcttgaataggtctcactaagtcacatgacttttaacaaattccttagtttcttggtcttttagtttatttaatcctaaaaagaagaataggggtataggacaagtaatagaaaagatcacttccaactaccaaaggatttacgtgtaaaataaattttctgcctcaagcccacacgattagttattaaatattgtaaaatgtgattaacattaaagcaaagtatcttataaagttttctctcataaatcttttcaaagtcgactcatcgctttttctttcctttttaaagtggactatcttgttcaaagtatcacttaggctacatgcagtatatgattgtatgttttgatgaggctgaaccacatttggatgatgactcatgaaaatacaattttttgaaataaagttttatgatttaaaatgtttattttacagatagagactctgacactctgagaggttaattttccaaggtaacaaaagtagtgacggtactagcaacaagattccctgagttcccatccaatgtacaatctgttataccttagaacctcaaattaacttttaataaataataataagcatcctttagaggttgcattttttatgtttttcagaaacaaacctatttattttttaaatatagctgaaagcattggccttaaccaaaacatttgttctaagctgaaatacatattaatatacgcaaagtaaatttagtgacactttaattttaagacagatattaacttttgttattgaataggctataagacgtttattagacaaatgggataattaatatggccatacacatattaattaacatattagttaaaagtagtatttattaaaatggtactttgtctacaaaacaggttgcccttcacagagaagagatatgttatctaaacactctacctataaaagccagttattaaaaatcgatatacacatacatgcttattgtcagttgatatacttttaccttcataatatttatatctgctacttgatatacttttaccttcacagcatttatctccagatctgtctatgcaataagatactgtttagggattaaaataattgttaaaaataagtaatctataaggcaggtttgaactaagaataagaaaaaaaaaaagactataaacactttgaatttgaatgccataactttagaatttgaaatgtaatgtctttgcctagatatagttccttttgtactatcagcgaagacttaaatctcaattttaggctctgtgtatgtgtggatacatatgttagatatatatatgtgcatacacatgtatatgtattaatatacatgctaagaaaattaatagcttaaaacaagataacaaaggttatgtaacccatacaatcaaacacatcatattttagaggctgttaactcatttgtggggcagcttttgttttgtttttcttatgtttcacatgcagatattgtttatcaacaaatgagtgatgttcactaaaaaaaaaccatgtataagagttctacttagaaatatttgttactctatttagagtttagagttatttactggcaaataataaggcaacagtgaaatattcaatcttctctttagtaataacccaagctcaggatgctttattatatattcaacatttcaataatagtatttagagcaatctatgtgtgagaatgtaaaaaatatgaagcgcacggtttgtgtattggaggatggagaacaaataatataggaaatagaactgcaaatgttataaaccttattttggcacgtagattttattcagtgttttaagtgataggtgttggcaacaagcaaacaatttaacgtaatacagataaagcccttcagtgttcctataattgcagtgtggaccaggttgaaaatatcttcagttatgctagtttatgcaaactgtttaccagataaaaagtgaatttgtaacaatggtttattcatccaactactgctctttaagctaccaggtggcacagctgttgccgtaagtaaaaagatttctaacagtccacctggaattaggacagctggttcctgtgagctgatctgaataatgtactgtgaatactctggtacagctactgacagaacaaacagcacatgactgtcccatcagcccagagcaaacactagttacatttgacagaaacaggctggtatttacaactgatctaggccaaaaagaatatcagattgaaggcaacaccccaagagaaaatagccctccccgagagctacctgttgaccatagtctaagcagcttttgccattattgaaaagcccccaaatctgattttgctgcatataaaaaggaagaggaaaaacatacaaagcattcctgcatctatttgtgaaccattttggaattttctaaaataaaaaaatggccaatacttcttagttttccatttacacggttgctgccaaagtcaacccagattagccagaatcatggccataataattttcttttaatttctaaaattgtaacactttactaaaaaaatgaagcaaaaaatgaaatggaactaaaactagagaatctcatttaaatctgccattggtaccacagatgacccatagagacggtaaatgactttcttcaggatgatacagctagttactaacaggcctaattagaaaaacatctatcggctgaggatccttagattgtccacctgagccaaggacagccgaggtgaaactctaaagcaggcaaaatctgatctcagtgtttccccactaaggttgattttgcagtttcaggcccgtgattctttattcctaacagaattatttctgggcccatttatttctgccccggctccgtggaaaataggactgtattgtcctcccattccaggtgtacaattcttgatcagcaactcacactccaaaaacatcctcaattatctatacttttattttctgcccagaaacatgcctttagccaggccagagggcatctatttagtctgatgaattcattcgtaaaatcttctcaaattggtcaaattggtgttagtagattatgatggaattacttcagggaacactgaactacagaataccacgtcatacccatataactaacagctgccctgataatctacactgatctgtttcacagcatttcaaacatcacatttcttaaagtgaaatggccatcttcttctctccctggcctgcttgtctttctttgcttggtgaataatatcaataacttatccagctgtgcaagtcaaatatcttagtgttatctttcatgtctcctctaccccactccttatagctaagcatccaaggtctaccctttcaaacctcttaatacccccagaatctaaccattctcttcatcctcatggccactatttcagttgtggttaaggtgccaaaaactttgtcactcccactgggatacttagagagtaaaagaaagtgttattaataattatgcttctgatacagaagtaaactaggatgcactaaggaaaacaggcacttatgaaaatcttaattatggtaccatttcttgactagagtactgtaacaaccttctagctgttctccttgatctcattctttcccttcactccaatctaatactcatacttccttcccctgctttaaaaattgcaagacctctaggcaaggtggctcatgactgtaatcccagcactttgggaggccgaggcgggcagatcacaaggtcaggagttcaagaccagatggtgaaaccccatctctactaaaaatacaaaaataagccagatgtgatggcatatgcctgtaatcccagttacttgggaggctgaagcaggagaattgcttgaacccaagaaggggaggttgcagtaagccgagattgcgccactgcactccagcctgggcgacagagtaagactctggctcagaaacaaaacaaaacaaaactgcaagacctactgttgccctcaggctaaatgaagtccattatttgtggcattggaggctttggtaactatgatccttgccagtttctccagcttcacctctttctttgctctttcctcataagccttcagtcaaataaatctcagatttgcttgatgagccctttcctctctcacctccgacctctgtccaagttctaattacttcctcaatgctctttctggcttctttgccttgattacatcgtgatcttatgaaaaattgtcagtagcttcattatatttaattattgattcaaaaagtatttatgaaagaacccattatatgccccatgtgaataatttaacaactgtattctgtttatttcatcagtgtgtcttttttcttagactatgagtctgtttagaaatggattcactctaatttactattaaatttttcatatctagcacagtgccaggggcacagacatggtgaatgttcagcaaagatatattgaatcaaaggagagattaaaaaatgtcttaaacccaaagagtggctctattgatgaaaaatctcagtgactccatcaagccagttggataagttttaaaagatgtggaattttagcatccctgatattatatatggtacacatcttcttctgcagatggcttgggtggaattgaactcagatgcaattatctgactattatatctcatctagtacactcttcctgtcaatatcagttactatttctgaagccattgttggaaatcttaattctaatggcaaagttttttaaaagtatttttaaaagtattcttacaaatgggtgagtgattctgaatgcgatgaacatttcacattcagctataaaacttcaagattctatcactagtatgacaacattcccctaagacacctaggtatttcctattgctttggagacctagagaaccagggtttagctgtatccctgaaaaatacaacttgttaactaagaacaataagacagaccttgtagataaaccaactgtaggcagatgcaaaatgtatcctttctctacaagtggtacatatcacctaactgcatttccacactgtggtgcacagaacaaacacataaggaaggaccattttaaaattttcaaaaagtattttaaggataatcatggctaaatgctacagaaaatcaaacttataagtcaatgaaattctaaatcaaaattacagagtatgagtctctgagaagggaagtagctgctggagaagagctcttgataagagaaaaggacggtcatccaacagccccgctgccttaaaaaagtgttctctaagcttagggttctcatctgtaaaatggggataataatgcctgtgttgggtgctttataagctttataagctcgtgtttatgatgttaaatatctttgaatagaataacatagtagataaatgtgcaacaggcttttttctccagtgacataaagaaaatacagctgaatactgaattttccaagtatccctcacacaaaatcaactaaatgctgccttccaaataagcatacactttttatataccacaataaaagtatttgcacagtgacatgattatctgtgtgagggtagaggttattttgcaaactttgtatcacaaattttatttgaagtaaaataagccaggcacagaagacaaactttgcatgttctcacatatctgtgggagctaaaaattaacacaattgaaattatggagatagagagtagaaggatggttaccagaggctgggaatggtagtcaaggggagagtaagaggaagtggggatggttaatgggtacaaaaaaaaaatagagtaaataagatctagtatttgataacacaacagagtgactatagtcaatagtaatttagctgtatattttaaaataaataaaaacatataactggattgcttgtaacacaaaggacaaatgtttgagatgatggaaaccctatttaccctgatgtgattattaaacattgtatgcctgtatcaaaatatctcccatacacccaaaatatatacctactatgtacccacaaaaattaaatatttaaaaatttttaaaaagtttaaaccaaatttgaaacaattgtcaaaatgattgctgtcactgacataagtaaaataatgagaaataatgtgcaagtttcatttaaatgtctattaattaacacatcatttaaaatgattttaaagcattcctttgaaaattaaaactgctatgctttttttcagtgcagcagtaattcaaagaaaggctccttagaactctcagagccctcaccacttagccacagaaaggtgtacatgaaatatccagtaataaaatccttaagcaactaaaataaatgaactgaatgatctaacagtagagattatgataactgaaataaaatctttattatttttgctttctttagatgatgagggtgagaaagtcaatggaacgcaaacattagaaattcacattttttacagagtataggttggcattgattttttttttaatcacttctactgaacacttgaaagcatccaggcagagtcctaataagatatatctcagaattcatgatgaggcattgtcaacaggccaaggagaagtcctccgtgctgaatgtatgcttcaattgaatttttccttccctgtgattgctggcctttgtagagaaagttgacacactaagagaggcatgtagtcatgtaggaaatatttgaactctcatgccctgtttggtggagacatcattcctatatatcacctctttaataaattgagatctgaagccttttgtagattttaaaaacaaataaacatgcttaagaaagatgcaccttggaaagaaagcagccaggttacagaaaagtgcttagattggcaatcttaaagtaatttaagtgatctggagttgggaaaaataaaatagattaaactttttcacatatcctttaccctagctcttctaccaataaatagcaaacaaacaaaaaagtactagaaaggtaagaaaaacctcttttatattttctgggccactatgtcacaattataatataataatatattatatattactagcacaattataatttatcatatctaaagaaaattattaagccagggtgcagctatgatccaatgaaaggaaatattaatacatggtcttatgaacatattcacaaagaagagaatgcttatctttctggtcatgagtcttaaatattaggcatcccaagctctcttaggaaccactactgtttttatcatgtataaatatatcccagacttttagaaaccctatctaattcatcagtgttgtcttttagggtaacaagctccttaagtagataaccaaccggttacattagtatcctgcctctcttatttctcctaaatttacttatccaagtagtaaaaagttatgtagtagcttcaattctggtgaagaaaatttagatctagttatccttgcaaaaaacgataaatgagaagagaacattttgatcattcttaggactgatcttttaaattcttactgaaaagtgaccaaaagctcaggtgaaagtaattaaaagtaatactagcaccctggcagcaattctaggatttgtatttggttcattgccaatatgaaggcatattgaaggtaaattatgcaggaggagaatatatttccaagagagtttgacacaagctcagcctgtgaattatttgctttgaaatgccttcatattctcctgcttggaaattctggtcaagagaagagagcaaaaacaagcagcaagctcatcctaagcgtatagacaagtgaacattcaataaaacgtttatcagcctgcaataaagttttaaaatgtgctggaccatcctcccctagaaaagaggaggtacaataaatagttattatattaaactttcagagaccaccccatccatcttgatgttctaaacaccagaagtccccaaagcggctttcactaacatgctatttgaaactagtagttaattcctgacagccgttcctcctacatattttctaacctctttgacccaaaggtggatttaccttgaagcaatgaagtttaagctttagactcttcagttataggcctgatgaagaacccaagtcatagattcacatgatttgggggttttataaaatttgcaaaagtaaaattttcatttttgtgttctctttctcaaagaggctccacctctactctcaattattagtgtctggctccacaaaacctggactgccccttttccaacctcgctgtttctgaaaatgttccctacagtttattatttaccaaaaatctggctttcatgagatgccactctgcacatcctttcttgctttcttggaatatttcatctaatggagaatgtctattccatgattcaactcaggcctcagagccaaggttaatatgctgtaagattccagatactagctcttcaaaattcattcaagcccttcttcttttgaagactcatgctaaacaattataccacaggttcttatctttgtgactataatctacagtctttggaggcattgtccagcactcagagtgttcatgctcattggtatcactgagattgcaattatgcctggcttggtcccaaaacctttcaccatggaccccactaaatacctaagtattataattctggagcctcctccttgcctacagtcttatctccactgcactttaactaccatatagctgctttaactaccatatagctgcgtatacattttgacatcactgtgaaaagctctcaatgccaattctttaagaatccctttctctgaccacaatctcttattctttctgtgcattgatttcctttctctgactcaatcggttcttctgccttttatttttttctgctcctcaattaatcccttggcactttatttttccagcatgggctttgaagtaagccaggtatggttttgaatactttggcacttaccaaagctattttacaagcttctcaacctctctaagtcccagtttcctttgcctaacatgaggaaagaatgctccttccttttccttagtattacattttatgggaatgttatgtcaagaacctagcatactcagttgacagcagatatacaacgttagtatttacgtaattatgtataattaggtacatagataagagaaaaagaaataagttacttataccccattatcctttatccttacatcactgatcctcaatgtaacctttagtgccttcagcttcagcgttatttttgcaactgccctaccggagctcaactcttgatttatctcttttgttccctctcccttgctgccggttccatcagtgctactgaacagtcatgcattcaagcagaatggtgcctcaaaaaagccaagttttctacgcctttggtgatccttagatttactatcccctcatttgtctttgtttgtatgccttactgtggcatttttcttaagccttagccagtctctaagcttcctaacacagccctgctcttctccctctctgtcaacagcctgctctcaatataatagagagaacagaatctaaatgtctataggttggaagtacctcaatgtccctcaatttaacctctaaattataataaaatagaaaatttactacttgttattacaactggactgaattgtctcttgacagacaactaactttgttaaaacacttttttttaactttgttaaaacatttttttttaatcttggttaagtgtttgtttgtgtagttggtgagtcaactgagagttgagtaccaaggcttcagatgagaaggaaaattatacaacaaaatcgagaaaggaaattttggagctccagatcagtctgggaggaaacagctgaaaaaggcagagagagaagaggattaaacagtaggtgactgtactttctatgaagtgaccccttcaacctagtccaccagttctgttttcaatctaatctgccaaattcatgaaatctggatgtgagttatttttgttgttggagaaatgagagaagagactgatttgtggaaatcaaggaagtggtgagaattaataaaatgtggaaattaggaaattggaacttaaaaaagagaagagctaacagttaatgagttgttagtttgaagtgctttacctatattgctgcactacatcctcatatatacctgtggtagatattattcttatcatcattttagagtagaataaaccaagaggttaagtaagtggccaagtttacagaactagttaagtacaggaagtcagacctcagattccgtgatatgctatgttgccatatcactaaattgcctcaatcagcactttatcctcagtgaattaaaagaaaatatgaggaagcaattcgaatgtcttccgttcgtgaatttcaggttcaataaaattgtatctaatgctcaagggacagagaaacttccatctgacacatgggttaaaaatctcattcttaaattttatcatgccaaatgtacttcttcttgcctaagataaacttttctacaaatgtgttggacataccttcccctaactcctcccagagttttctccacctatcccctattatcttccataatctctgtgatttcactggctcactcgtctctaatatttggatgcccattattctagaaaacttcctctgactcatcttcctttctgaattcacattctgcgtcctttcttcctttcacatagatgagtttttcagagaaattcacatttcctgcctttaactcctcaatcaattttattcggctcttcactagttctacattctaccaaaatttctctcaaaaaggatagtaagatgtcatgaatcaagaataataatggtttccaaattatgagttaacttcactcgagctctagacacacattcctatctaatgactatatctacttatgttttaaaatattaattacatctccttaatctactcctctgttttcatgtattaatagtaacgttaacgtcttcctagtcaccctagacttctctccttcccactctgcaacatccaactgatacccaaatcctgttgtttctatctcaaaaccatcacttccatcaaactttccactcatgtcctgtgactcaagaaataatcaaatctctctttgttttaattcacatattaaaaagctaccagaattttcttactagaagccaggtctgactttgccatgcccctgcttaaaaacccttatttgctcaaatgatcccttaacgtattctctttgtccctattataacactttctcattgcattttattggctagttacttattcataaatttcttccacaaataagagggcacaactgcatatggctctagtgggaaaccattagttcagatatatagtagatacctaaataaatgtttgatgaatggatcaattattgaatgaataaatgcttctgctacttgcctgaattaatcattattcaatataggtaagtagaaatttctaagtctgaattaatggatacacagctaatagtaagatgatttagccccttaaagatcaaaattaacatttatgaggaatctgatgataaaaacattcaaaaagtcaaaattcctcactgatatactcatctttaatgtactgagtactgatcttatagcaataataaaagagaaaagaaatgtcagaggcagactgagaggcaatgcatcattttggtaaacagtgcagcctcaagggactctcgagccaggcttccaggttttgtcattgaatagctgtgcctcggtttacccacaaaagtgataaaaatagttagtagtagatagataataaacaaaaaatagtaaatactaaaatagtagaaaaataaaatagaaaaaactaaactcaaggccaggtgcagtgcctcatgcttataatcccagaactttggaaggccaaggtgggtagattgcttgagcccaggaatttgaaaccagcctgggcaacatggcaaaaacccacctcaacaaaaaataaaaaattagctgggtttgatggtgcatgcctgcagttccagctactcaggaggctgaggtaagaggattgcttgatcccagagtggggaggttgcagtgagctgagatcaccccactgtactctggcctgagtgtcagagcaagactctgtctcaaaaaaataaaaataaattttaaaaaactaaactcaaggggttttcatgagatttaataaactaataaatattagacactatggtacttggcaaaagataagtgataacaggtatcacctattattatttactctttgaggaatttaatacacttatatgtaattactagacacaaaagaatgcatttagtcatttcgacccaagaatatcctgtagcctggtctctctaacacataactacaataccggactctaactaagaagagactgtagtaggctccaaatgaatatgaattatgtatacctcaacatctccatacgctaggaattataaacactattttttttttcttcccagggagggaaacaattaagtatgaatgttgctaaacaattgtctatgattattgttggaaaaagcaaactaaattggttgtagattaaacttccaatttctttccctttttgatttactgtacttctttcatcataatgtagcatattttgctgcaagagatatagtcatagtatttggaatttttcccacggtggtctacccatctctcaattcagcttttgctcaagtgtaatgagaggctggtccacagccattcatttacaatgtctgaataaaaacgacagaacacaaattagcctctctttagaacacgctgctatgtcagaattctgaactgaaaagagaacttttcatttgggcaggtgagcgaggaaagggactgaaacacaagatccttgtgattaggatatgttcaactgcagaaagtgcacaaaggaaagctgatgagccggcccaccccctactatccacaaccatcttctccattctgtttcatggagtaatcaaaggatattctgagcctctcaaaatgccatcagtccttattgagaataaaatagagcatctctctctctcaagcctttgcagaagcaatcatcatagcaggctggcctgaacagggagctctggcagacaaagatggatttgtaaaataaataaataaatacatacatacataaattaaataacttccaaaaaatttgaatagaaagttgatgataatgtgccacttctattatataaagggtaaagaaactcacaattgtcctttctaggtcgagtacagtaaagaataggcttcttgatgagattttcccagtaatttacagcagagctgcgaatcttgtagcagtaatactaaaaattaaccatctaaatgatttagataaaacattcattaacattctcaatctaaggatcctctctagttgtccctcccacctctttgtgtccttttccagctctgattttcctctttagcactttttaacaaagagtggatgaagcctatttcaactgttcagaaaggcttctcgtgccagctgatagttgctcaagtgtaaaataatttcataaagatctctgaaacattctttagcgccagactctccttaaacaagcagtgtttctaagacacgcattgtcttagtgttgtagaaacatgtttggcagcagccaagtctagtgctgataagaagctacaaacaataagcacaagttgttctttcaggtgaatcattatttactagataggtcattctctttggagccggaagacctgacactcgtctggtatttgccaagctcttaaccaagttactgagttatttaataggccaagaatttagtgttctgtataattgggattctggtgtaaaaataaaatgccacagatgccaaaatgctttgcaaacttttaagcactgttcagctgtcacttatttttgtgaatgtcacaagaataaaagtgattcactgatttgaattacactgcttgtagcaaactccgaggatgtaaaggggacaggatatttttcaaaatagtacttcgtagtctagagtaaaacgaaaaaggcttcataaaatttgtccccaatatttaaaaaacaaaataaataaagtagaagtctgtaccatctcttccatcttttaatgaactccatttgaatgattattaggcttatattttatttaattgctatttattgaagattattatatatatatttttaaccaaatgacgggtgagagttgaaagcatagacaaatcagtaaaaaaaccttactttttaccatgtaacctggaagtctcagcaaaaatactttgcctctctgcttcatttttgcctttgtaaaatggccataataatgcttttcagttacccttgttatgaaggttaagggtaataaatgtaaaaaagctccaagcagagcctaatacatgaatatgtgatcaataaatggtagctatatttaggtttgtgtttgagaattttgaaacatttgtttaacttgtaaggatcattttatcttcaagtaggtaatgactgagtcccgatacagacattgttctccctgcttttttgctctgattttggctctatcaattccatttgttcctcctaatcattaactcttgattacagggagtctcacagaggcataaatcgagcaggggctctggcttctcactgtgctcccagtaagatccttttaagccaattgatactaaatctcactaaacttaaagtcaaaatcaagattttcatggttttgaccaggggtggggggaaccaatagagcaatagaggtctgaatactagagttagacttgagaaactgaagcttctcacataccccttagaagcacaaggacactgggctacaggttttatattttccagtatcagtatacacatataagatgaaagggtttacactagaatgtctttaaggtcccttgcaactctgacactccgcgagtacatagttacttatgcatccacctcgtactacaacagtgcatctcagtgaagcaagtcacttcactcagagttcatctatatatactaaggccaaggacaaaccacactggttgtatttctattcagagaaaatctagtggaaacatatgttcagagaaggacatacatgctagggaaaaagaaggaaaaccaagtgccaaaggaaggatgttaaattatgttgtccatattgtaaggagagcctggtgtctgcatgtcaatgagagtgtgggactttatacgcaatgaataatgtatttgttttaaatgtatatatatacacacattgccaatctctcctcttttcccgaattggaggtcagttataaatatcaggctgctgcttcagtttgggtgaggagtaaaatcattgtgatttaccacgctatgagaaatatttcacctctttcacatgtgtaaacatgcatttataggtttataataccaatggttggtgttcagtttgacacacataaaggactagactttgtttaaatattaaagagaaaaataataagattaacatttattacaagagaaaatgtcgaaagggatacaggcaattatttaacaatggaaaaagcagattccctgaagaataaagcagtgactatagaggaattcatactgtaccataacaaggaggcattatacaaagttcaaatctactagaagtgatttgtatgatacctggagatacaatttgataaattaaaacttacctctttattactaaagaaattgagaaaatagttcaattttgtttgtaattcctaaagacagggctaaatgaagaatttagaattcagagctggtactatagaaggcttgacattaagtttaataagatattataacccaaccctatgaaaatccttaggaagtcagggataaattaaagaacaataacaatttgtaaaaaaaacctttgttttttaaatttaattttgttttgttttattttgagacagagtctagctctgttgccaggctgaagtacagtggcgtgatctcggctcactgcagcctccacctcccgggttcaagtgatcctcttgcctcagcctcctgagtagctgggattataggcatgcgccgctacacccaggtaatttttgtacttttagtagagatggggtttcaccatgttggccaggatggtctccatctcctgacctcatgatccacccacctcagcctcccaaagtgctgggattacaggcgtgagccaccacgcccagcctaaggtaccgtgttaaatacaagtaaatcttacaaagaatagcataactgaactaatatatccagattttaagaaagtcactggtagaaaagacattgcaaaaaaaggtcccttgatatttttgttatatataaattaagtatttgaaaggtttctcaaattagtggaaaatcagaggggtcagaaccatttttgatatccctgtaatttccaagagcttggaaggacaaatgaatgcaatttgacattatgtccttatttaaaaacaacagtcaaatctataatacataaggagaggagctctttcttaaaatatgcaaattatccagccacacctctaaagtcaaacagaaagcaccaacatgatctatattttgaaagagatcaatgttgggatgatgcttgcagctctgggcagttttgtgtgtgtgagttggagaagagtggaaaataaattgcagtgactggtcaactggaatgaccaaggcatttccttggctaaacgttcaaaaatccttcaactgttagtgacaataggattatatatcatttgaagagagacctactaaaacatgcatcattccagtttcttcccttgatggaaataatagaaagctgtactctaaatagatgaaggccaaaaaataaaaattggtgccaataaatgataaagcatggaaatattaattaatattgtatttcacttggtacaatgtaaacactattatttagaaattgagcctattttccaaaaaataaaaaataaaactaattggatctcgattagagtaatattatagtaacttctgtgaagtgatgagggcctgaaatagattcaagacaacagaaacagaagataggaatttgagagctgtttttcaggaaggctaagagaaaaaaaaaaagtttttaaattgaataatttaatgaggagcaagagatttcaaaatcatgtttcaagccatcctaacattgacagaaaaaaaagaaaattggaagaaagtccatctcacctcctgataaaagttctcaagcatgtgcaatatagaaatattacaaaaagtagaaattaaaaagtaacaaaaacacatttcttcacctttgtttgtggtggggggttttatttgtttgtttgtttttgcctttcttctgatccatttcagatctgctcatctgctccaccaaaatgatttctattccaagctagataatcagcctccacaaagatacatttaaaatgactttttataacctcttaaactgatttagcttcctttgtctttttcctataattcctggcatgtctctctcagaatattatctcctcaactagaatattaactctttgatggcaggacctctgtcttccaactttgtactctcattgcccaacacagtacctagcctatgataaacattcaatatattaattcatttactctttcattataagaaattgaacaatttggccaggcatggtggctcacgtctgtaatcctagcactttgggaggctgagaggggtggatgacgaggtcaggagatccagaccatcctggccaacatggtgaaaccctgtctctactaaaaatacaaaaattagccgagtgtggtggcgtgtgcctgtaatcccagctactcaggaggctgaggcaggagaatcgcttgaacctgggaagtggagattgcaatgagccgagatcgctccactgcactccagcctggcaacagagtgggactgtctcaaaaaaaaaaaaaaagaaagaaagaaagaaaagaaattgaacaatttaaaaaatttctacttaggcccagtgctgtggctcacgcttgtaatcctagtgctttgggaggccaaggagggaggattgcttgaggccaggagtttgagaccatcttggacaacacagtgagaccatgtcttcacacaaaaaaatgtttttttaaattacccgggcatggcagtacacaactatagtcttagctattcaggaggctgaggcagaaggatcacttgagcccaggaggtcaagactgcagtgaaccatgaatgattgtgccactgcactctggcttggggacagagagagaccctgtcttaaaaacacacacacacacacacacacacacacacacacacacattgataaaaaaaaaaataaaaaaaccaaaaacaaacaaaagcccttgtcatagggaggatcttaagaagaagagccccttcttttgtcttaataaaaacaaacaaataaacaaaaaccctcaagcatcatgtcaaagataccaccatgtcaagccaatatcctgagactacaatcatttatcatcaagtagcagccgttgttagaagtgatgttgatccttggtaaattgcaaccacagtaaccttgtcatatcatcacaaaattctcgcactatatcatttagctatgagatacttccttaacttgtgtccatagggttttctcttctatgttcaatcacataaggaaaaaagttatgcatagaggcgatgcaggattttttttgctccttagctcagctaatctgggtttttgtttgacgaccatgaagaattaggcatgcggacacattgaagggtgaggaaggtggaatgtattaagtgaaaaagaaagctctcagcaaagagagggggtcctgcaagcagctttccacctccctcaaattgaatactagcaccaccacacacgagataaagaggccaggctcctcccctggataaggcgcaaattcctggtggttccaccccattcccccagtgcatgtgggcttccagtccactgcgggcacgcccaggcaagcaccccatgcaggcttccttatctgcacaaaatatctggtgtaaacacttgtgggggcgagttggagactctctggggacccttccctatctgcctaggcctttgtctgcctcctacctctatcagaggtaggccaaaatgtttttgatcattttctgatgaaatgtttcttagaagaaaatacagcgtgacctggcgtggtggctcacgcctatatctcaacactttgggaggctgaggcgggcgaatcacttgaggtcagaaattcgagaccagcctggccaacaggtgaaaccctgtctctactaaaaatacaaaaattagccaggcatggtggtgcatgccttagttccagctacttgggaggctaaggcaggaggattgcttgaacctgggaggcagaggttgcggtaagctgagattgcgtcactgcactccagcctgggtgacagagccaagacacagtctcaattaaaaaaaaaaaaaaaaaaaaaaagaaaagaaaagaagaaaagaaagaaaatacaattttaatgcatgagatataatcaggcaatattttaaaacataactaaggttaaagcttcatcgatttggttccagaatgtgagatttctgactttcagtttagtttttttatccagattaccgtaaagtgaatgaaaagttttagggtccttcagtagcaagatgtttaacagcaacttgaaatgagaagtctccctcctccatcccctctgttagcttagaaatatggcctttgtgtgggacaactgaaatccagactcgatttctagctctttttcttatcatttgtaagttacgtaaactgtccatagctcaattatttttttaaactcttaaaattggactggcagtagtagttacctcctagggctttgtgaaataaaagtgagatatttaatttaaatcacttagcatagtacttgggttatagtgagcattcagtaagttttagctgatattattattattattactatttttattatttcataaagggacaggattttgatttattgaaatactaaggcaaatcccattgaaacttacattttctttttttttttttttttttttttttttgagacggagtctcgctctgtcgcccaggctggagtgcagtggcgcgacctcggctcactgcaagctccgcctcccgggttcacgccattctcctgcctcagcctcccgagtagccgggaccacaggcgcccgccaccacgcccggctaattttttgtattttttttagtagaggcggggtttcaccgcgttagccaggatggtctcgatctcctgacctcatgatccgcccgcctctgcctcccaaagtgctgggattacaggcgtgagccaccgcgcccggcctgaatgtcattattgagaatgacatcattgtgtctgcattatcattttgctcaaacttctactggtttatgcatcataaggaaacatagcaaaatataataaatcttacaggagagaccaaagatttgcttgcatttctttctttttatgcaggagttggggctaaatttataaaaatctcatggttaattacagtgtgtgtggtaaccttataaaaataaatatctatattaaagttatgaaatctaatctgagagcaaagtgatatggtgtaaaataaagtagagagaatcatatttttagcagtcaagatactcaacttacattcaatgacttagaaattgatcaaatttttgagataccaaacttctttaattttcttcattcttcttcacttctgcttacattttatttttcagtttatttatatatctattctgggagaaagcgtgtaagaggaagaggaaaatgcaaataaatctatttaataaagttacttcttagcagatagaaaagaagggaaaaagaagttacattgtgatgataaatccattgcgggttactcacttcactaatgtggagtagctacaatttctctgtcttccactggctgagataattaagagttagctgatatgttttgacagaggagcatttaatcttaaaactattgcttacaaatgactggatgggcttgcaattgaaactatgtcttcctctataaaaatacatggaagcttttacattaaattaaattttctaatatcattaaagctaaaatatcttcagccacatcagtttattcactatttttattcattgctatttcatttaatatacaatttattatatcaaaaaaatataattctaggtaactcaaaagaccaaacttagccattgtaacaaaaaagaaagaaaaaaaacctatggagaatttttaaattatgctgaacatgtaatcgaaaatattaggcagcatgtgtttaaatatctagagaaaagaaggccgcaatggaaactaaatccaatagactgaatatacaaagggacaatggcctgaccatatgtaaaaatagaaacaaattgggaagcaaacctccttatctacaataaacagcccagcaaaccagccttttgtaaatcagatttgcaggaagtcagattgctatctctagtaacaacccaggaagctacacaattacttgtataacaatcagctccaaatgaccagaattgattaataactggcagctttcctaatttttgtccttgcttccaacttcagaccaacagaaaaaagtcaaacatgcacctctaaccaatggcttctagttatcctgcctatagcttccccaggccaacagtctctaatgagggcatagatgaagccttccctttttttttttttttttaaccctacacagctttcccactcctctgcgggcctttaagtctctgccaaaatgtaactgatggagctgactttcttgctatagcagtctctgaataaatactctttgcttttttcgtttggttaatattcatttatttccacactattggagcatctattccaggtccattaataggtaacgtgcatgcatacactaaaaaggtaatcttcataatattccgtgagaaaatttttaaatccccattttacagatatagagcacggtttgcagaagttaaatagcttctcattttctcctatttttacatcacgctagagtaaaatagcttttggtgtattattgcttaaaaagatttgaggccaggcatggtggctcacacttgtaatctcagcactttgggaggccacggtgggtggattgcttgagctctggagttcaagagtagccttggcaacataaggaaaccctgtctctacaaaaaaatataaaaaaaaattagctgggcagggtggcatgcacctgtggtgctactctggaggcagagatgggaggatctcctgagcttggcatgtggaggttgcactgagccaagatcgtgctactgcactccagcctgggtgacagagtgagatcctgtctcaaaaaagaaaaaattttaaggtaatattaaaagtatatctaacaatagtaacagcagctgtaaattaggtaagtgttttctagcatgacttaaatttgtattcatcaactttctggacaaatataaacattgtattttgaattgattcattgctttaaagttgtaatttatcaaaatatttgtggaattgaaaaaatcaaaagcactataaaaaattacttctgtctttatttgatattagaacacatcagcagaaataatttgctggccaagcagtaattgcatcaacaagcttttcatagatagtgggtagagcaccttataagaaagtgtgattatttatgatatatgatattgacaaggaaaaaggtaaaaatggaaatggtaaaaatgaaaagtgaaattgatgattctaaaagtagagtaataaaatttgtttacctggcattataaatactctgcaattttttaaagttaattgcctaacactcatataagataggcaatatagcatttagaaaatgaggaaacaaagtcatagagatattcagaacattacctaaagtttcttaattagtgcgcagtggagcctatattttcaaaatgcattattttttttttttttggtttcaaagtctatcacatatgcttaagaaatatttgatcaaaattcacttttaagatgttcccttagcacgttatttagccaccaaacttaaaatggtagtaatttgttttctaatttagccaaacttaaaatggaagtaatttgttttctaattcagccatgtaggaaagaaaggaggaacatggcatttgtacatgttagaaatttccgtaaaagttacgtaaagccagactgaaaactattaggacaatatagatgacaaataaagctttttaaatgcctgaacataaaatgatacaatgatatttaatcaccatttcttttccaaggactgaaaaagtaaaaagaaatctacaggtaacattgttttataatgtggaataagaaatgatggctaaaggtcaaataagtccacgggtgatttagactttgtctcaataattccatctagctagctcaaacctttattaagaatttcttgcactgagaattataaattaaaatgaacaaaaagctgaaatgtaagaattcttataaaaagaaaaagatttatagcattgcaagctaagaaagaaaaactatttttttttaaatttcactgttgtaaccagaagtaatgaatttgtcacttaaaattataaatacaagggtatataatttgatcattttgcaaagtgtacagagagcctcctttatacaccttaaccgctttcttcccctctcacaagcaaaagactgattattcattacctatccattgatctaatttttaaaacttttagttatctattccccattgggcatgtgataaagttttcagtttgtactataatattttttaacagaaaagaaaaaataattgaggtctccatctttgtctctttccatatcagatcttctaaatggaggtagatgagtaaaaggtgtagagcagatttgagatgcattttataagaaaaccacctgggaaatttcccaaacaagacaagtcccagactctaatcacatcatggaaataacatgcttcagtaactttgaagcaaacctacagtgtagtaggcagatatctagattacattattcctctcttccactgactagctgtgtgacaccagtcatatcacctgacttctctgtggcaagtttcttcctttgaaagaaggggatgataataatagaacctcatgaagtttgtttaaggattaaggaggttaacatatatgtgttgaatagtaaacaccaggggaatattacttattacaatcaatatgaaataaagaaaattatgtttgttagataatgagcagcaagttgaaaatattcttatggctatggtcaagagaaatcggatgctgtcggttctactagctatgataatgttcttagattaagagaaaagaattatcttctagaaaaaattaagcatcatgtttatatcttatcaatggaagaaactgattacagacacaaatttactacttcttcatgctccgtactggtcagtgaatactggattacagcacttactatgcagtccctctatctgtatgattctttgattaaggttttcacttcttgaaagcagaagttgtatcaaaattctttgagtcttaaatgtatactaatgcttcacatacagtggtactcaatatatgttgaatgtatgaggaatgaatttataaaaataaatgcatggatttgacagctttcaaagaaagaatggaattcatatagagtaggtttaacatttaaaatgtaaagtgttttcagaaacttccttcaaaacttaaatctacttcttaaaaacaaaaatctacttctcagcagccttttcgatgtgattaggttcaaaggactgcacggttttctgtgtttctacttcaacttgacagaaaatatttaatttttcttaaataagtgaaagagatttatacttgtattacttcttgactaatatatcataatatctttttaagaaagaaaagtagaaagcctacttggtaggaattttcatttatttatatacacataatggttttattagttggaattgttttttaaagttaagatttgttttaaataaattaagatgaggaaaatgttttgcttctgaaatcttgaaggtatttcagagtacatgttgtattgtccatgcttgtcttccaaaattaactacatatagcaagattggcacatcttttgtgggtatggtatatttttaatctaggcatcacattgatttgagctatataattattttgaaatgttagtgcttatgaactattacatgattttatatctcagaaagaatatgatatgtgtatataattatttcttaccctattcgagtcaattcttgctctggaagtatagatgggaggtgggatgttgaaagcctgagggaccaagtactcctcagcatccatcatatcttccaaatcctcttcatccaagagattctgaaagaacttgctgtcatttggactgggaagcttcatacgatcatcaccctaaaagaaagattgcccatcagacacaaatatgattctttcttatcttaaatatgtggtctctgcaataaatttatgtaatatcataacaaatggttgaaaaattcatacacacattttaaaaaaacaagtctttagcacaaccaccggccattaagaaacctataacatgcttagaaatgatagggccaggtaaacaaactttatacaaggagaatatgataaatgccattagagaataataaagcaaaatcaaaagatgtttttagggaggtaaaatcaatttcaggtctgaaaataattgttcattgcccagatagtgtatgggttgcaactttaagaataaacaataaaaggtgatcaatttatcaacgtttatttggttggtttgatgctgtaggattatcaggaccatagggtctatactttattctatagcatactgactgcattatcaaagtaggggcattcaaaactcacagtgcaagtggcaaatagagtaaaggagtatgagaaagacaccaaaacctttgttatgctcttcctcacctcgtctatttcttaagtatttttcctatatttttaaagttacataatttttggaaacaatttcagttcatgaaaactaattttggggaaaaaataaatggaaataagtatcttctaaaacctagcttttatctttatgtcagactgtcgatatgaaaataaaggctaccttgctttactgaggaaacataatacactctagtccaaggcccatttgtttagagtttaggtgaaattaatcctagagaaatatattattattttttaattatccaagtctatctatttttctagtgttaaatataaaatatttctttggttggttgattaaaatgtgcatcaattcatttgaattgagttattgcttagatactgcatatctctccaaataaaacaaaacatattttaaaatatttttggggaaattaaataatatactgaaacttttgattcactgtcttcaagcatgggcaagattaaaacaaaaatctgtcttccttttgttccgaaaaaagaaaattatactaatgaacatgacttacacataatgttaataaaatcaaggtgctaaaataagtgtctgaggattaagacctctttatgtatatgtataatcataattatctgttcagtagcagagccacttgaatactaagggaaggtgctaaaaggtggatctgacgtgaaataaaaagctcttttccataagtcatgtcacatgataattctgcttaattaatcaacatgtttgtggtcctttccacagttccaaagtcctgatactactcattttgcagtgagtttgccattggcctagtcttaaaggcataagtcaaatgtactcacctgaataactaggtatctttgagggtctcgagccatccttgaaaactcagcagccagttccttaaatttaggtctactgtcagcatcaatcatccaacctggaaatttacacagtgaaaatgtcactatattcgtaactagaaaggagttgaaatttaaattttgtgaaaatatgagcaaaagtttgaaaaatgttgttttaatcgtaatgatctgagaaagaaagcaagctagtgaaagaaacgactcaattggtaaggctttatcggtctctttgttgatattcataactaaatgtaatgtactgtaaaacaaaagataaattttttctctgatgtgtatagacgtgactgcaatataagttattattttgtattaggagtgacataggagagaagatttggttacaatgcttacactggcacaaacgggaaaagaggaattaaaagcaactttcttgtgctacatttgtcctggtggacaaaaaaaaaaaaaaaaaaactaatgcaaagtgattggtaatgcctgttcagcaatagacattagcttatcttagtactagcttgtctagtataaaaatactatcagcaattttcaaggtatgtattcttatttagctgggagtctagataaagcagaccttatctctacaggctctgtttagctaatgagatgacaagaataaaagtatcaagctttccttgattttcttgccaaattatcctcttcttaggtattaaaaccccgaaagaaaggtaaaattctccattagggaaagtgttttcttggttttacataattaatttcatcagagctaaattctgatgagtttaaatcatttcctatgctagttacaggattaaattatataagacatgcatgtttttaaactttcttccatagatgtctaccaaacaatatttaatagaataaggctgtaaagcttgttccttccttttccgggagttcagtttttattcctattctgggaattttttgggtgtcattttatgtatcattaatgtcatctgctttttttctccccaaacaaagctcaaatgctctgtattctatatgcattcatttgaaaaaatgcttgctaatgccaagatgctaatgagaaaacaggtgtttctgaaactattgaagccaaaaaaggttaaccacagttgaggtatcggtttctttccaactaaatattgagtaaatagaactatgcttagtgaaaagggcaggctgacctgaactgcaaagaacattttttatttcctccctcactgtcagaatgtatcacacatgtcatgaatataaatctgagtagacctgggtccaaagtctcttattaataagatgcttattcaccttcacaagtttgtttctttgctaaccccgtgtaaatcagaaggggaaagccttagattatacaagagagattgctgcatgttaatctcacttaaattaagccagaaactccagagacttcctcaattctatttaaattaagggcctgtgcttcaaaaacacatttataatacatatgtgtctgggacataggaagaaaaaagaaaagtaagagtttgatgtaaacaaatgatcaaattgaaaaaagtaaacatttataatctttttagctcactatagattcatttcttcccacttcccaccttgtcctgctaatttgctcctgactaaaaccagtagacctatttctattaaattaatttttaaaactgtcagtttcaagcttttttccttcatgtttagatcatttatgtagcctgatattttcccataaaggtcactaatgtttgatattttcccataaaggtcactaatgttattactaacattcatgttagtaatgttagtaataacattattgtgactaattacctctctttacgacaggcaatttgactgtcatggagattataagaataaaagagtcataattttgacttcatagcatggaagagtattactttatattaataatagtcacaacaaagaggcgttcatatgttcctttcataattgtttttgaactgtcgtatttttcaatacagagaaatgttgtacagattgagtaatctctgctattactttactaagaatgatgatggtgataacattattttgcagtcttacatttgaccatgaccatgtaaacgtcaatagtgcagatgggaggctgaggcaaacgttctcctttctctaataaatcagggatttctcgcgttggaattccatcatagggttttcctccaaaggtcatcagttcccatatagtaactcctatattggagaaaaaattcttacttaagcatattaacaacatatgttgaacaaaccagcactataccagtagtaaaagaatactccttacaggtcaatccaaacaccaatcaattaaaaaaaaaaaagctccataaattcctgcatccattatgagaaccccaatgtcaaaatctttgtgggggaattcaattttcttattattgtcttggaatttctaatggatagaagagacaatttacagtggatgtcagcatatagaatctgttccccatttctgcctataggtaacactaatgtttgctgatccaagttataccacgttacagtccataaaacaattcatctactatatatacatatgtattcagtaccaataaatatgcttttgccagtaaaataagatattgactaattttaagatcagcatctttgctataaaaggcttccagaataattaccttatgttacaataaagaattgtgactctctctaacttacacaaagaaaacagttgaataaaacatagacttctttagcacatatgagagcctgagagaggaatgttccatacgtaatatatagtacatgtgaagtagtcaccaacaaaattgtgaaggggatagaaagtagtttattttttaggtaataaaatggctttcttgaatcactgggacattgattttctctgcaaaagcaaataccctaaatggtagcatgcaaacagccagttttggtgataatgatggttctgatttgagcaataatatatacactaaatatcttttttgtaatgtaatgattatataatttaagataatattttcttagggataaagatttttaagttcagacatggctagctgggcacaataatattacaaagtgaattttgattgatgtgtatatacagtcatctttcagtataaaatccattaattagagctatgttttctttcctattgccatctgtaatgaattatttactcaggctgaagtattttttagtttataacagttatcattgactgataacaaaaatacaaagcttaaaatataaaactatgtggaatttaaaattattctttctaatagaatattaactattacctgatttttttggttaatatttacatcttaggattttaggtatattgttaacatgtacctagtgacaatttaattgactgattgttattacatctttaattttgtatattaaggagaagctcctaaaatctatcataaaaattttctatgaggcaggctgcaacaagttaagtggatgactgttcatctctagatagtcatacttacagaatatatatatatgttttatattttagaatattttatatttagaatagtttatattttagaattatctattttgtattttagacagggtctcaatctgtcactcagaatggaatgaagaggcatgatcacagctcactgcaccctcaacttccccaggctcacatgatcttttcacctcagcttcctgagtagctgggactacaggcatgagccaccatgcctggctgattttcgtattttttagtagataaagggtttcagcatgttgcccaggctggtctcaaactcctgggtttgagccatctgcccacatcggcctccctaaatgctaggattacaagcacgagacaccgtgcggggcctagaatatatatttaaggagaacactttattaacttaggtaggtagttataaaagatagagtagatactctcacatttctagcagaactcccaacataagcaagatacaaagcaactgtaaatcaaaataatagaaaatataaaatacaaaaacaaaagccaaaatataaaaaactctacttcttctgataataatccaattatatccttgtaaaggtgatgacaagatagggttagaaaaggatggtttcaagcaaaagaacaatgtcaggaaagctaaaacaaaacatcctcgaattttacttgcaattcctttatcttaagatgtatatcacagccagtgcttattttgtaaaaataaaaatgcacctagtgagaattttccataaaggtgcactgtaaacaaggttatgcaactttatctgcctttaacgccttttgcaatcaactatgatatatcacaacattttttaaatgccttatgaatatgggttgatgacctgggctgtgtttcaaaacagagtactacctatctatttatttatttttgctgaacagttcctgggattttgcaactcaacatgaagaaaaatgttacaccctgagtaacaagattttccccaaaagacaaattttactattaaaaatatgactgttctgcccagtttatatatatcttgagctaatttaaatttgccttcaggagactgcctatatatcttgagctaatttaaatttgccttcaggagactgccatatttgattcagggaactgtaagtagaaagaaaaagaaaaaagtatatacatatataaaatatactatatgatataatatataaatctgacataatatatattctataaacctatctatatcatgtaatgtataaatgctaatctacatgctaatctgtatcatataatatataaagttatcacagaatacatgcaatagatgtttttctatacacttcttacaatagtttagcaagtaagttttgtcaagcatttccactacatttgtctatacctcagacacacgacattttctatttctaagctgagtaaaataaacacatgaaaccttcatgaaaattttaccacctcctatggaatacatatgtggaaggaataacccacttgattgaaatgtcttaaatacttttttaaagatagttaattttttcctagataagaattgtaagttcttcagtgattgaatggtttatatctttttttttccaacaatgcaaaaaaggtaaaacttttttttaagcttaagtttgagtaacataaattgtaccatacatttaaatctcaccaccacccttttatttaagtgggcattatgctttttatttgtaagaaatgctaattttatatgatatatttaaacttagaaacgtattgactccttcttggtattaccggacttacttaaattttaagtagccagacagatgctaaatagctcatcttaacaattaagttaaacacaataaaataaatgttctaattataaatgtcactcttttccagttcatattattcactctgtaatatttctgtaactccacaagtagtttgtaaattaaaattaatgttgtaattagcaatcttctcttttaccatgttcattgctctaacttactgctgtcagtaatttttctttgttatgacaataatctgttttctactatagaacataaattcttacatgcaagaaacccacaaaaaagttggttttgtttttgtttgaatatttattgtattcagagttatgtttttgaaagttgcttaaaattaacaccatgaaattctatgaaattgtccctaaactaaaattggctgattttttttttttctgtcaaaatgatcaggcaagttcctacaaaaccacagcttatggaaaacatcttagcagaaatattagtatattacattgtaataaaccaggaaaaaaaaaaaaacagaaaaaggcagatagcaatgctatttagaatattttgttgctcttcaatgggaacacatggacacagggaggagaacatcacacatcggggcctgtcggtggatggagggcaaggggagggagagcattaggacaaatacctaatgcatgcagggcttaaaacctagatgacgggttgataggtacagcaaaccaccatgccacatgtatacctacgcaacaaacctgcaggttctgcatgtgtatcgcagaacttaaaataaaataaaataaaataaaataaaatatttttttttcattgagaaagcaaagagttaactgctttaggaaattaggcttatcaataggtatttataacacaacaaaataatttagcttaagatatttcacatgaacttaacatatgtatttttgctttacaagctttaattcgcaaagaagatttatttaccatagctccaaacgtcactctgatgggtgaatttcctgtaatgtatacactccagagccatccatttaattggcatctatagagaagtaagaagtaaaagttttaaaattacattaaaaattcatttctatatgtatttcctaaatgtgagtctttgggctggccttaatcatatttttttattatgtgtgtatagatataactataactataaatatatgttaatttatgactataactataaatatatgttaatttataaaatacataaagtgaattaatctaaagatgtactatacttattcattttttattttatttattttttgagacagggtctcactctgtcacccaggctagagtgcaatggcacaatctcagctcactgcaatctctgcctaccaggctcaagtgatcctcccaccttagcctctgagtagccgggaccacaggggtgcgccaccatgcctggctaatttttgcatttttttagagatgatcatcatgttgcccaggctagcctagaactcctgagctcaagtgatctgcctgctttgacctcccaaaatgctgggattacatacgtgagccaccctgcttggtcatacttatttttttaaaaaaaaagctttataaacaattaaaggtaaaaataattaagtggggataactttctatagttcttaattaacattcagtaattaagttgctagtaaatattatgatttataatattaaatctaaacatctaatacacatgcttctaaaaatgtgtttatagttttttctcaaaaaatgagatttgttatactttcagttatcccttttcaccctcagacacattttgggccaccagtacaatggactctttctatacttgccccctcccttctcctctcatataatttggccactaaaacgcctaaaatcatgaattccaaagttagccttgctttgttttccagcttcaaatgacccctctcatcttggttagccagtattgaaaatatgtaccattttcaaaataggaactatataaaagaatgtgaaaggatcagcacaaatctatcatcactacaagaaaaacatctcaacccacatatcctgctgatgatgggtcagcagaatgagtttcaactatgaagggcagcattatatagctgggaatataattagattctatggaataaagataaacacttctactttgcagttgaaagcttaaaactaaataggcctttgaaatcatgaggttggctgctcaccaaggtgacaccaaggtaactctatgacagaatcatggtattcagtgaaagggaagagaagacacattgaaagtaatttccctacgggcaaggagttagcagactttatggactacggacattgtgttaaagaagtaagtttaaatcacaggtagcttgataaagacttaatagttaccaagcatttaaagctataatgaatcttgctttagacaaatcttatgtctcaaatcttatgttctcaagacaagtgaagccatgtgatttatagacttcaacttctgtgcagtcttagagtgaatttcaatgctgtggtctcagactactgcaatttggtagtaaacaaacaggcaaaatagggtagttttaaaattttttgtgttattttgccttgtgataaagttaagcatttggaaacctatcattgcaaaatatttataatatatatttggatggcccatatgataaataaggcatataataaatatatttatatgacatgagaataactgggtttttttttgttgttgttagtgtaagcttataggtcaccatagcctaagattgcatttgcttatttcatttgggctgcctgaccttaggtttcactaggtgaagctagagggacctccatatgaagtctagtcctaatagtttggccaagaaagtcaagctaaagagaaggttaatgaggaaatacaagacatgggactaaggcatggattgaaaccatatagtgggtgaaagagtcaggaactccattgtcaggcagaggctgagactagagggtcagaaaaggtagacgaggcagtggctctgttcagggttctttgtagtacctaaacttttctctaatctatgagagagaatctatgttctctataagagttagtgctacggtctttagatcagtgggacaatttctacagccatgtgttaaagtttaatttctagaagccctaaggatccacccactttccatcactggacctaacatgaaggtcacctgggtacagacatgcatcatcttattttagctacttttgagaaacggaagctggtaatatatggtatatatatatgtgtgtgtatatgatatatatatacacacacatatatatatacccggggcaggagaagaggcaaatggtagaaccaaggcttaataatctcctaagcttcaggcttattggtttcttgtataaaatataaggagataaaaggatattatactatattttcaagcaagattgctctcaaaaagatacccacctttcctccatcagcattgtactctttttcatctccttccaagagtctggctagcccaaaatctgtgattttcacatggtttggagatttcactaagacattacgggctgccaaatcccgatgaacgagtcgtctttcttccaggtacatcattccctgaaaaatatcaagttccttaatgatattcagttaatgcccaggttttcccatttttctaaaacaaagtttcttagccttcagttggaagtgcctaattttttaagtgaagccagaatcctagaatattttcaaaattagagaaaacctgatttgggggacagcaaaccacaaacagcttttggtgttttctccctaaagtcctatgagatgaaagaattactttcacatgagctaaatgttagatcattatttttccaagtgacttgatatccttttgcaaactctttctttagtgaggtgtgcaggtgttgtagtaaataagctaacatatgcttggattgacccacatatttgtaatcattccttctcaataacttctgcttcacgtcatcttccccctacacatccaaacaaatacctttatccataatttttagaaatatttcatttgaagtttaatggtgccaaaatcaccattatagattctatggaggctgaagaattatactattcttattatactattcttattaatcatgcacagaatgaagtatataccctagcagtcttacaaacctgtaatttttaagaagacttctatggtatcagtagtcattatgagaatccatagtgaaattacacagtttgtaatgacactgaaattagcctttaatattttacctttataaaacatagagggaaattaaaaataaaatttgttggtgtttagcagcaagagacatagctggctctcctcacaatacatccatgtataacaatatataacacatgttatgtattaatatctatacaaattcagaaaaaataatctagaggagtaataattactttattaattgtacttcagtactaggtaaactaagggttgctaaacattatgtttaacaaaagaacttatgtaaaactaaggaaataaacctgaggccgagattagagtgaatatatttttgttgaagtgttaggggaaattctatatttgatgatttttgtggtaaaatgatcaccatttaaaaatagattagaattattataaaatgttgaagcatactctcatgccaattgcaaatcaatgctgtgggcagttaacattacaactgcaggactttgaaggattaatggtttctaatatcaaaacaaaagctgtggaaaacagacacataaatcacacaggtcaaaaaattatgaaccgtatacctggtgtagtgtaaagagaagattacttcaaacagcatcatgagccaaaccccatataaatgcacattaaacacaaccagtggggatactgcctgatatggtctaatcagtcaacagttgggtgacgctgtgtgtattagtgttttctgaaatcaacttacaaccgagatttatgggacttttgccctctctcctaaacagtgctttgtgtttgagtacattaaattagaaattcctataataaagtacatctgagaacatatagcccttatatgacttaaaggatcaaaaaaaaaaaaaaacaaataaatgcattgccttggagatagaatattttcatatcttcccaagtaatactatccctttaacaaatgttcatgaaacattcattattctctttcttatcaccttcatatcagaacacggaatatatgttggcaacaggttaacacgtactatatgctggactatatagacagatactgagaagacaaaaaagattcagataaggtctgtatattaaaggagaacagaagctaattaataaagtgggcggatagggaataaaaacttgaatggactgatgtgatacatgcaaggcatttaaagagaactctattctgaggcccttatgtagtatagcctagcaagtatgcgtgagaggagagacttcaaagcagtaccaaggcctaagtaagggttgaatgatgtctcccaattggacagagtgagggtaaaactgcaggcaaacagaacaagcacaggggtagcagtaccatggcgtacttgcaccaagatatgcaattctgtatttttaaagcataatgtatgagggacagtggtgagcagtgaaactgaaaacaaaagaagaggcagggtccaagaagggtcccttatatgtcatggtaaagaacttagacttttgcatttcatgcagtatacaattaggtgatgtggaagttgttttaaaaaggggagtgaggccgggcgcggtggctcacgcctgtaatactggcactttgggaggccgaggtgggtggatcacgaggtcaggagatcgagaccatcctggctaacatggcgaaaccccatctctactaaaaatacaaaaaattagccaggtgtgatggtgggcgcctgtagtcccagctactcgggaggctgaggcaggaggatggcgtgaacctgggaggctgagcttgcagtgagccaagatggcgccactgcactccagcctgggcaacagagtgagactctcaaaaaaaaataaaataaaataaaaaaaggggagtgagagattattgttggattcttgaaaacaccactctggtgtcagtacagagaatggattggacatcaatgtagctgaaggcaggagccactgccacaatacagaagcaaggtgatgtaaaataaaggctgcaatttggcagtccatggactacatccatttttcagatttttttttctttagtccccacactgggcgggggtcagttattctctgtagctgagaccaactgtaccccaataagggcaatccgaccccattttccaagatccctccgctcactatttcttcccaggagttctgcttccatcacttacaacactcgtctgctcctacgtgtaagagtatctgaaccttcaactaaactaggccagaaggaatactataaagaggataatatcaaggaatatttataaaataatcatccttagtatttgtttgaacgatgaagaaagagaatacactgagaacaattttgtttttagacttttgtaatttaggtggataatgatcccttgaaccaaatatcattctaataaaaatatcatttttatatttcttaaacttatgcaggaagagtgatatgtactttgccaatagggaactaaggcacattcaccaaaaaatttaaaactctgctatgatctgaatggttttatgtccttccccaagttcatgtgttgaaattctagcccccaaagtgatggtgttaggaggtggggtctttgaaaagtgattaggtcatgagaatacaacgtcatgaatgatattagcaaacttataaagagaccttcgagagatctgttgcttcttcaggcatgtgaggttataggagctatgaacaactaggaatcaggtcctcaactagacactaaattttcttgcaccattatctgggacttcccagtctccaaaactatgagaaataaatttctgtttatggtattttgttatagcagtctgcacagactgacactctaatgacacactctacaatacaagaaaaatttcaaaaactctgaaagttttttgaaattctatacacaaagcctcagcaagtgatagactatcctgaagctaaatactatttttccagaaaaggtactttcttcaaaataatgagaaatcaatttttaaaaactaggtgacagtctctagacagtttccctcacccacctgaccatcactaaaagcaataagaacgtaagtatctatatcattaccaaaccatcaaaatacatgtttatggttgctttgtaactatgaaacatcattatacagatgcacgctttcaaatcattacttactaaagccaccttagtcctactttcacacactgagagtgttgaatcatctatggattgctcaaaacagttttctctacatcacagtcattaaataggattttcttactggaagctctcatttgagtcacactctgtgctagattccttcaaaatgaaataactcttcaaattagagtgtcatgcaactaaggtggcagaaaattattagaaataacagtgacaaaaacaaactggatgaagtccgtggaagtttcaagatgaacaaataaaggtccttcattatgatgctgtgtttcatgggtaaagaagcctcatactctgtgctctagcagttcccgtatccacgtcaggccagcttgagtaaattaggagaagaataatactgacagcaaccacagttgacattgacccagtacttagaacacagcggtcattaaagtaaatgttgccacattggttggttaacttaatcctatgagatgaacactgttgacgtattttaaatatgagaaaacaaaggctaggcgaggtcaagttacttgctccaagttatctaatcagggatccccaacccctgggccatggagcagcactggtctgtggcctgtttgttaggaactgggctgcacagcaggaggtgagtggcaggcgagccagcataactgccagagctctgcctcctgtcagattagcggcggcagcattagattctcgtaggaggctgaacccagttgtgaactgtgcatgcgagcgatctaggttgtgcactccttatgagaatctaactaatgcctgatggtttgaggtagaactgtttcatcccaaaactatctcccctgccgggcccccacaaaaacagtccctggtgccaaaaaggttggggactgctgatctaactaatgcatggtagaagttggattgaatcccttgctgtggcaattctaaagtctacatttttaagcctatcttctctcttaatgggtcacagggttaggtggacatggagaaattaatgaacatagtggtcatacagttttgttttctttgtttttttttttgagacaaggtctagctctgtcatccaggctggagtgcagtggcatgatcagggctcactgcagcctcaacctcctggcctcaagcaatcctcctgcctcagacttccaaagtgttgggattacaggcatgagccactgcatccagccacttgaagtcatatagctttaaaaggcactagtactttggcagaaaaaaactattatctggtgtttctgtgaatttcaggacataatgcaagtgattgacattttttaatttatattttaaactcagttaaattatagcatctttttgtaagttcacaggaatttgaattgtgcaaactacagactgttcttattttggtcacagagaatgcaagatggtagagtgggtaggagtgtagattctgtggtcaattgcctgtttcaaaccccagccctgccatgttctagccctgtcactctgagaaacttatttactctctctgtcatcaccttcctctcctcgtctctaaatgggcataacagcacctatcctgcaggttgttgtgaggtaaattagcatatgcaaagcacttaaatagcaattggcatatagtaagtgtagaacatgaaaacctttattactgctccatggatagctatcaacaatcctagaatgcacaagaattacttaccctccttaactttaattgcctatttcagaaaatctgtgaacctcagctaatatatcacaatgggtgtttaataagtgtttgcaaatgatgatacatatacttataacctacccatcatgattaatgtgtgaatacaatttcagaattattattattcaaagtattattttaacaataattcacccgaagatgctgtcatataagaagaaagaaaaattaggagacatattaaaagatttggtgccctctataaatacatcaccgactcaagaatttagtgaagataaaggtcacgaataaaatagatctaaaaggttcagtgctgtagaatgctttctgtgggttaataatgctttctatgggttaataaaatagattttctataccaagataactgccacttattacacaccatggaggggagtttttgaaagaagtattttagggttattttgtctacttcatgatccaaatgccacaagtctgattttaccgaaactattcagaatttaccattacctgaactattcataatctgactattttttataccttctctgtaagccctagtaagttttcaaagaatgcatacttagttcatgttttgctcatagctcttaaaatgtgtaatcatagtaaatacaagctaaccagagaaagtcaaattgtatgcttgattttcagaaatgaactttgatataaaatccaaggaaaattgtattagaattgaatttaacattttaatctctggttagaatcaactcatataaactgcttatggaaaagaacagagaatgacttaattttcaaataatggtattgacgaaaacctagccatgaccttcttttcaatcttatgatatgtgagtcacaacaatctggcaaaaagcattatttttgttttaattcaatgtgaaaatgtattttgcccagctgccggaagctaaaggaagtcaagagagactggactatttctgacaataaatatttgcttctcacatattggccatgcgacaatttcatcaaatacgtgtgtggagctaaaaatttcaagctgcagtcagctctcacaggcattaatctccagcattaatctctagagttagcaagagagcattttttttttctgttttcattctaattacctgaagctttcgtaataacaggaagcttcaggaaacctaatttcaaatgaaaatatctcctttttttctacctttccttctaaaagcaattctatccctgggggaaaaagaatccaactataatgcttactatggttagagctaaagatataagcatgtttaaggaaagaaagggatctttttggatgaagtagccgattttatccaaatagtgcataaagggaatataaggaggctcagtaatggaatcaactgagggacctttttaaccagcagaagctggttcatggcagaatagaaagaacacagagctgagtgttgtgaaacagaagttttggacatattgttaactaggtttatgaccacaggtactcatttcacctctgctataaaagtgatggattggccgaaatgatctctgaggttactgctagctttaaatttttattccatgatagatgaaactgtaaaatatgtctatctgaaatattaaattgtgggccaataatagacacagagaacagtaaagaggtagagtagatgtcccccttcaaatatttagtgagagttgtgaatatgttttagtaaaaatcatcttagtgcatcctaattttaaaatccaaaaacactggctacttagtagctatgtgattttggtcaatttatacaacatttgtgtttgtttcactttctttatttgttaaatgggggtaataatagtatctactctgagggttgtcttgaggattcaatggcttaaaattcagaaaacacgtaaacattcactattataagataccatgtatttttaaaataaataagcacaaatttatcttattaaaaatataatttgaccactttaaaggcagccaattgaaacacctgttggttactcagcactgttaggtgcaatagcttctcattctgcttgttcctgaatgttcttcctattattctattcagaggaagaaaagcagattcatacggctgtcctgagccagcagggagttaacactcatggttaattctcacacttccaactgcagtcatgatcttcaagaagcctggttaggttgcagagcttaagaacttagattttggaatattaaggacaaccaaatttctgtccttttaataatatataataaaaattattgtttgctatttatttgaaatttatttttcacagatagtcccaataatatatttgagtgtgtgtgtgtgtgtgtgtgtgtgtaagcatgtgtgtgtgcatacacacttgcatgtaggagatgctgtggtgggctgcccagaaacctctttaggacctggacattcagctggaagttttggctgttgatgattcgtctcagcttcctcactcgtgggatattgacactccaatgctctatctatgctgcaaagaaaaatagctacttcctggacagacttacaaaattctggtcttatggttcatttactccaaccacaaacatgtatagtgtgccagttactgatgccaggcaaatttcaagttgttgaagacacagtgaaattcacaaatagttagttggtttttaaagtgcctccaaaggcaccatcccttggggaatccagcaaaattaaagaggcttgtttaaaagccttcaacgtttattatgtggaaggaagtgttttcactggattcatagagcacccattttcaagattacattcagttttgtgagtttcatatatggcttgtaatctactgagtatatttttatgtatatggtcatatagcataatggttaagatcattgcttttggaatcaagctgcctgcaagacaaatcttagttctgataagttttgtcgtgcactaggtatcacctttggacaagttattttacctctctgtacatcaatttccttgtcttaaaataggagtactagcagtaatacaggtttcactgggttcttgtcagtttccatatacaaaggatttagaacagtcactgacaaattaataaatgcaatttaaaatctgcaatctttatgatggaatgtgggaaagcaaaccctgccacatttaggctaagccccagatgttggtattagtctcccaggggtagagaaggggaagaccatttacagattcctgaggccgacagagataacagaatttttttttcttgctccttacattttcttcagaagtttcatttaccactcatggcaagcttttaaaacatccatttgaagaacagcctccttggggcttgaaagccttcttaagaaaaccaaaaaataaataaatgaaatcaaaaacaaaaaagcaaattaaacagcatgtgcgaaaaacctctgctttctcactacattgtgagtaaaaagctcatctgcctgcatcaagagaatatcaagcatgctacagtttttctcccattgatctcttgccaatatggttacaataggagaagcgaatcatgtagtgtccgaactctcacagggaggtgtacttaaagtgcattacttctactccttaggcagccaatcaataaagatgtgctttccaatgagaatggagatgtctgtgggctgtagcagttatcctctgtgtctctttagaaattaattaaaaatcaatgaagtgtgcaacctattaatacagcaacctctagattaatagaagctgagcctttctctgagcatacatattgtgcaaatgcattcagagactacagagaggtggttgaatgtctgacaccttagtaataattgagcagaaacagatcattcctaatattttgtggtttcacagaattgcatgctactggtggaaaaccatacagcttagggatagggatatgtatatacaattttccttcttaagctgattatatcaaattttatgaggtatccttattacaaagcaaaacttctgccatcatatagacctaaataatttcaataactattttcttaagtgtggtttacttatctatatgtccaggtggttgagtttatttataactgctgaatacttttatgtaagtgtctttgcattaaaaatgtgaaactcctagagcactaaaggctcttatgcaacttgagtatccacataaggggttgaaaagtgtgtcattcaattcagttctgccttgtctcatttggacagcaatgggcttggccccactatgcaaatatctgcccaacgcatgtaaaactcgcaaaagtggcacctacatacttccttctggaagtcacccagccacttccaaacttcctgatctgccccatgccctccttcctcaggcttgctcctctcaaaatcctcagaaggatttgtaccatggcttctgttttcatctaaatcccttactgttgatttggatgcccactttgacacacatccttgtttctacctttgcattcttcctcggaattccagggctttgtttccatctagttcctgcataaagactaagagaaagagactcctgctttgcaccttggctcattttctagcctaatattaccatagaagtaccagatatcatcacattacttaaaatgtgaatcatctatctttaattattaaaactgtcaagaaattgtcctgggagagtctgctgtcactacaggcttcaggacacatgtgatggtatagtaataatacaaatttcactgtttcttggcccaacctgcttggagagcacctgtagctccctgcctctaagaagccttttgcagatatttctagggttagccaggagcctcatagatgctcatggataatctttcttgtttttgtttgtttgtttttcaggactcttcactgatatctgcagttgttgaacccacagttgaagctcctgtggaaatgctgatatcttttctggggctgctatctcttgatgctccagaagctacagcttataatgtttcaaaccattgcaattatgcccttccatcctccttaccatgtcagtgctctgctgtcttccacacagccctagggaggagttctaccctcttctgaactttgtgccttattttgtcctcagctgtatcactagctattcttgagtccctagtaacaaacaaacagtctccttaaaaatcttcagtaaatttagatactcattccataaaggctcagatctagtccaagaggtagccatgggaaattgacatatttctctttgcttaagtcttctctttttaaccatgtgcatttgccatcatttcctcattctcctttacccttcaacagacatgcacatacactgaaccacgttttcactcaggtagccaaaaaagcccacaagcaacttgactctgcttggccctccagcttcttttcttggaattcttcaccttgaactctatggccaagcaaagctgaaaaccctctaatttcttttgcctttacacttactatttcctttatctggaacaccccctcaccatacactgccacactcttcctaccatgctacagacacatgcttggtcaaatttaacgtttcttagatcacaaattagatgtcatttcctccacaagatcttccccaactcctaaatagattgggtcactctacaacatagtgataatgtccaactttatctatagacaggtatctatccatccatccatccatccatccatccaaccatccatctggagctaaaccctgagattatcaagcattattttaaaaaagctttttggatttgcagctaaatcaaagtttttttatgatcagaaaggacataaacttgtatgctcagactttaaaaatgctatataacaaattacccaatgctaacagtttcatgtagagagtagataaagcacaaagccaaaatatatatgtgtgtatacacacacacacacgtatatatgtgtgtgttatatgtatgtatgtatatacctgtatatatgtatacgtgtgtatatatgtattgagatttatatatacatatgtgtatatatatatgaatctcaatagagcactcatctattgacttgattaatttgtcaaactatttttaagagaattaaacactaaaatgagtaatggaagaagtagaaagctatattttttcggcttgttcaagtccgaaaaataaagattttttttatcttctattcttcacttcaaacccttatggactgttgagtgcctggaactgtgaatggcgtgttcctgtggagatgacataactcagtttgaccctcctcacatttaccaatttcatcacgttttgggacagtcaataaataatagtcgattgattgatttcctcctctccctactccttactcatccttactctttctatcctttcatctctttctactctttcatccttactctttctattgcctttggatcaagaggtctggaaagaagaaattcccagcagtaataaatatacttgcaaacataacctcataacaattaaaaataaaggaagaggaaaaggtataataaattttaatattattggcaataattttctattgctaatgatgatttttattacattgtccctttgctttttattttttagtattaaacatctgttaattttcaggcttacttgcatatatgttgcaaattgcttgctgaatatttttaattctggaatactatttgggctttgggctaaatgctatcggttttcccacaattgttaggaaattagggtattgctcatgcacactgacaatgtgaaatttgaaagctgacctcttcttttggtctcctctccagttcacagatttatgtggttaatatctcatatgaaagaaggttaaaagcacatatcataaaaacagttctaaagggtcatttttaacccattcctgtttatcattgacatctgggggagtggaatgcaggaatgaagagtgatttctgggacaagacttcccaaacttcattatcagcgctgccactaactatatgcagccataggcacgttagacatgttagttactcagtctgccaatatcttcatctataaaatggcaataataataatacttatctcataaggttgttgtgagaattaagtgaatgactgtatgtaaaattcttagaacagttaagagtaaaactcaatgttgatagtattatgtcctttgtccagcaccttgcattacagatgattctcattttcaaaagttcagtttttaagtaacttgaaattccctccgattttaagtataaaacacacttttatacttagaatcccaaagatcatctatcaactgccaaccacatctcctgataatgctgtctttcctataatggtttaatttcagcacccttaccatcgttaaagtttgtggggttttttttgtatactttcatttctgtgtataattatctgtataacatttcactttaatgtttaaaagataatagggtagaaaatagagatgataagaaaaacattctcatagtaatataattaggaagaattaaaaaaatcactaaagagactaaaattggcttatctttagcctccactggacactcattgaactttagctggatgactatgtattcattagaacaaaatttaagtacatggagaaaagctgtaaatatataactgtacatgaggtttaaaggtaaaacaaaattaaatattttgtgttactcttaagttatctataattgaatctcacttataacatggaaatctatcattcacatttttaaaattttacttttgcctcttagaaataccttacaaatgaaaatcagggacaccttgtgtcctatatttgtgtataggtatgcatattccattagattatcagctatttaaagttacaggaggaaagacaaattttctcttgatcactttctagcttattgcatacataatatacactgtgtatacaactcactctctatgtagttgaaaagaataaagtttccttgtttctctaaacaatcttttattgaatagaaattatgtgctgaacactctgctaattgttttacatataatgatatgttatttccttcaagctgttcattgtctgctgtgagatacatacatggacacagattacgtaaatgatgtgttcagaaagtacagaaaaagggacatgtagcatattctgtgttgattacaaaaaaactaacaaaagtggaatttgagcttgatattgaatgaaaattaaatatttaaatttttggataaaatacagtaagaacattctagacataataaaaagcacgtaaaaaggatagagttctaaaaggtaatggtatatttagaaaaaatgacaacttctttgaggataggatctaaattaattgtcaatggctaaaagcgccaaaattaagtgtctaacttaattgtgattacctaacatgacgtgcacagcagttactaaaagccttgataaaacaaattgacttgatcagatttggcagttgtgtggaggacaaacaagggtaaagcacattagaaagaatcaaggagatcaattgggatactataatactagttccaatagcaatggtttagtgtttgactaagacagtaacttggagaattaagtttaggttagagcagcagacagatatgggaccttaccaatgaggttaaaccataagagagcatgagataactcagatactttcttccagggaaaacaccgttgttaaataagtgagtgccagaaaagaataccagaaaaagtgaccaaaagtaatgaccagatttataggagaagaacaaagacagagtgttatttcttgtggagttgttggagaggaaatgagagaatcttaagaaggtaaaactagcgacagtatcaaatacaatagggacgtacaaaaagataacagaagggggacctttgaatttggaaacgggaatattagcaacctggtgagtcactagattgcagtggactcaagagtgaacaaggatttgaagaacggtggtccgcaaaacaacacaaaattaggctcttaaaactaaatgaatacataggctgtcacttgaaagaggaagtcacaagtttgggattgtttattcctccacccccagagaattgaaatatttatatgatgcatgagaggagccagtgagtcaggagattgatgatacaggttgagaagaaatgaaggagaaatgttccagcagcagagatgggatcaaatgttcatgtaaggaggcaggtttgtaaaggaagagacatttcctctgagatagcaacaaaggaaatgttggaatctggaagagaacaagatggggggagctaatgttttcataccagtatttttcttggtaaattgcgaagcactaacataagttgaggatgagaggaaagatggggtagagtgaatagttttgaagtggccaaaggaggaccattggtctgatttcactctgtgcaccagcacagcaggtgtccatgtagagtgggtaagaaagctcacataagatcagggtaaagattgccaaagaatactgaggcacaatataagataaaaaccataactttgtaattgcatcacctggctggagtattctattgtcctcagaagcagagaaacagagaaattggatatttggggtcacccagagaagatactagcaggtaagtgagacaggaggacagagataaggaaaaatgaacaaaaataacttcgtagaaatacaagaatgctatttcaaagtgtcatgtatatgagttttatttttaagagttttctatatgtaaagtctttttaaaaactcagaatggatttggacattagtatgaagtttgaagttagtttcttcttcaaagactttcttactatcaccaacaaatgcatgggatctgaaaaatttatctcatctaaacatttaaaaaataaagtcagttactccagaaccagatttttaaaacttaattttaagcttaatatcaaaatctaaaagtatcagataactttatagaatcagataaaaaagtgtattctaaaacaatgtgaatgaattaggttttttttaaagcaaactaaaaaggtagtctttactatttgatttatttattttaacaatttggcttccagtaattccttctacgcttttagttataaatgatccatgtctcctactggatttaatttttatctatcatatatttttgaaagaggtgaagattttttccacatcacaatatattaacatttaacataagaaaactataaaccctctataaaacactgaaagcgtaaaacaacaaagcaacattcacaagtcatggtaccgaataaatggatttaatgaaaccagtgaccttgtgttacaaaaatcagtgggtttcttttgctgtcaaagtgagtttatttgaatcataacttctatattcctttacaattatgatcatgtttggcaaagttggactacctttatatgactttacagtattcaatttcattttaaaaacatctaatgcaaatttaatactttatcttttatgacaagacttagctcagcctgaaataatcactgtattaacattttttacccattcaaatagttcaatccattattagaaaaacagcaagcatccccagcctgtcattaagtcctactgttttaattacaagaaaaaaaaaatactctatggaaggcttttgtgaataatggcactgtaaacacaatcttacgcaaagatatgaaaataaaatggggtggagtttcttttctacatcaatattctagtagaaatgccatattttctggcaaaataatgtaaagtctgttaaaatataatggttctttctttgaatttagtcacaaagagacactgcttagaaatacatgttactttctactatttggaaacacatgaaatctgcattcaaggccaatattttgattaaaaagttctacatccactaggatttagcagacttatttttgacttctgaccaaatttagttcctctttctgcatattgtggttgcatgtaaatgtttgccagtgtcaggagattcaagctattcaaacattaaaattaagtgctacctaagatttatttaaaaataaaacccaacttttgaccttaggaattagaatatttaaatcaaagtctgtacaaaactgaacacttcattaagaacgcctgttaagagaaacatggctggggtttggtgagtaaggaagaacttcattgtatattttgtctagacttattattatattattattttttgagacagagtctcgctctgtcacccaggatggagtgcagtggcaccatctccacttactgcaacctctgcctcctaggttcaagtgattctcctgcttcagcctccccagtagctgcgattacacatgcgtgccaccacacctggctaatttttatattttttgtagagacagggtttctccacgttggccagactagtctcaaactcctgacctcaagtgatccacccgcctcagcctcccaaagtactgggatcacaggtgtgagccattgcacccagcctattattatttttaatataaataagaacatatcacaaaggtagactctgctggattttccagcttgaagaaggtgaatctaaatccaaacagtattggagaataactaactttgagcaaggtgtttgaacagccatttatgattttttaaagatgacaaggaaaattgtatgtatatacatctacccaaacagatacacacacacacacacacacacacaattacacacagagataatgcaatacagattataagaaatgataatgaaggtgcaaaggcatataaacacatggggtgaaatatgaattctgaatggaggaattagcaatgtttgttgagaatggaaattgaattacattttgaaggaccaataaaggttagaattcttagtacagctacaaatgcattacaaccccatcaatttacacttttaagattaagcccaagaataggtaaaatattttctgtaaaaggaattactttaataaaatatttatgtagagctaccatagatgtctgttaacactgaggtcatgcatcttctttctattgagacagttcactaaaagatatgcagtattgtaagagattttaaaaaattaaatgcacattttttgttctaagatatttaaaatctctttgggtaaactatgatattgaagtatacatgctcaatatatttcagtgttctctattaagacaaattaataaatttgttaattactattctatgtatacctctaacatcaactttaatcatctttacaaattaaaattatttatgtctagatattaatactgattagtacccaatagtgtacctcctacaagaagcttgataactagtatttaagatattgctgataatgtttctgaattcctatcagaaccttttggctgaactagataaaatttacttaaagataaggtgcattttcatgttatcacagtattgttctgaaatgttttagaccgtgtaatattagtagcagaatactgaaactggtatgaaaataagatgtttcctcaatagtttaactgttttgtaaaatttaatattttgtatttcacaaccagtgaaaagttcagctactatttttatctattaacatttgcagttaaggcatagggtttcattaaattaggaaatggttattcattataatataaccataaattgagctctagctcatgaatgtgctaattgttcttttctgctgaggatagtagcttatattcacttttaaaactcaatagacatagttcatatgcaatttagattaaatctgagtatgaaatggaaagcacacataccatctgtgaagaaatgcccttatccctaattaatatgtatcatgtattatagcccattttattactgaagacaagttataaaacataaagttgagtttaataaaaagaaagctaatttaatgggaatgagaaattgcctacaagaatattgtagttaatggatacaatagtctttgcctagggaaggataacttgatttccatgtaagttacaggcctggatataagtgtacttagaagaagagcagaacaagcctctagaggctaactagggaattaacattcaagtgtttattgagaatctactatatctaggtactatgatataatagcaataacttatataatgaacactcatctagcgcttgctaaatgataaacactgtcctaagcagtttacacaaccccatgaagtacatactattattatttccattttacaaataatgaaactgaggcacagagatgttaagtgactttcccaaaaacacacagcaaataatagagttggaattttaactgaggcagcctggtttcaggtctaaggaatacatgtgcagaactgggattagagaaattatgaaacttggtgagcctatgagagagctaatggaggtgggcagaaataacaagacagagaacttgatgtggggtaaggctggaggagtgtgcaagggcaaacctgcaggatcttggaggccaggctcaggatgttgacttttatcttaagagtgataaaagtccttgggatgtataaaccaagagcctgggaataacatgattggattacattttgagaaaaatctcattggctacagtgtgaatgattgattacagaaggaagataaaagtgaaaatgagagttaaggggttatttcatactctaagtgagagatgatggcagcccggaccagggtggtgctagcaatggtggtggagatggagagaagtaatcgatttgaaagaaatttaaaagctactatcaacattacttaatgtcaaataaaataggagcatgagagagaggaagaaacaaggataacttcagttagtgctactgattggatggtgatatatgcaggactaatgtttatattattcaggtttcagtttaaatattatgtcctcggagaggccttctccaactgtttgaattaaagtatcatccacccctccataagtctctaaacccttaccctgctttatttttcatcagagcacttatgactacctgacaacatataggcatgctgttacttacctgttgtctgtttcactgactacagtgaaggcaccacgaggagaaagaatttatcactcatattcatgctgtattctctaccctttagaacagtgccttgcatatcgtaagtggataatcaatatttactaaaggaataagtgcatgaacatgaaggctgtcagaatatgtacgatagttaagatcgtggatctgggtgaaatctttcacagagatgaaagtgaagaaacacacgtaagcaataaacaaaagaaaaactcacagggacaaaactgagatgacaaagttaggggcatggaagaaggcccagcaaagagcagtgcagcagaaatccagagtttcaaatatggaatgactgtcaatgtcaaatgcaaaatgctagaatggcattgtaagaagaggactgaaaaaatgccattaggattggcatttaggaggtcattagtgatgttgttgataaaagtttcacttaagcattcaggacggaagtctgaatagtagtttggacaggaaattggagatgaaaaaggaaaacagtatttgtagactattctttcaagaggtatgtctgtgaaaaaatgaagggagacagggaactagcgaggaattaagggaggcaggatgtagaaagaaatattatataaggattgatacagaatccagaaatatttctcaatggtggtcatgagaatttggtcaagaacctaacaaaaaacaaaaagaaagcccaactattcctagctagggaagtggtggggagggaacagcaaggggaggaaaggggaaatagaaagccctagcatatgagctaagctacagtgaactggtataaacaacaaggtcaaggtaaatgcaacctctggcagaccttccaataagaagggtcagtaaaattgtttattcctgtaggctaacataaagaacaagttttagactacttaaggctgtataaaaggatcctgtctcaaaaccagactttgaaatagttttcttaatagttccaagtaatttgtcatgcctagctcaagtgctgggcaaatagcaggtactcgaaagtattagatactggaaatatcaagttatcaggagtaaacttctattaaacttggcttgttttgtcttatcatcaccatcacatttcactgcgagtagaaattttagaaaaatctctttttcatttgtaattattttgaagtgacattccttccaagaaatagctttcctcctatatatccagcactcatacactgcacctgatttgaagatgaacaaatatatttctgcttaagaatttttgatttctgtctcagataatacatttgtaataaaaataaacactatttttttttgagatggagtctcgctctgttgcccaggctggagtgcaatggcgcgatctcggctcactgcaacctctgcctcccgggttcaagcgattctcctgcctcagcctcctgagtagctgggattacaggcacgtgctatcacgcccggctaatttttgtatttttagtagagacagggtttcaccatgttggacaggctggtctcgaactcctgaccttgtgatccacccacctcggcctctcaaagtgctgggattacaggcgtgagccaccgcccccagccaataaactctatttctaaatgcaccctatttcttaccattttcttcaaaatcactatgtatactctttcagttattaccccatatgtcctttaatggatgaattaaatattgatacactaaaaaaaattaaaatagctctgttaccaactatctcaacctctatcaaattatctatattgatattggccaaaataatattgatatataaatattaccagataatttctttgaaaatcttcttcaggtctatacatttcatagtatagaaccttaattacatttcaaagacaccacactagttaggcacttcactgggttttacctgaaatatcagtgtcatgttaaataattgattctaataatagtttattattgaatatcaaacaattgaaatcaacataaaatttgtgcagtaaagtatgtgtgattccatctcaacaaaacgataaataattagtctctcagagtgttttaatatagttagaaagaagccattgaaaactgaattataggactttttccttcctttttagtatattgaactcacacaagtcacctttaatttcttttctctactaccagattgcaaggagaaaattcgaagcctagcttctcaaggatttgctgtttctttattaattgttatatgtgcgtttcattcaaagtactaggtaatgctttcagcaatgaaatggtaacacctcaagaaaagggtaaattaacatctgattaaataaaattcatatgctctcatttagtaagagtgcaattaaattcatgtctttaaagtttaagttatctcaagtcttaagctcattttaaaagtataataaaaatactaaaatagtagatattactcagggtcactacgtaacacaactccacagagcattatttacacaaaaattttggtttatttaatttcatcatgcttaaaaccccgctttaaatttttttgatgttcctctttttatactgtagtactatttaatatcttcactaatgaattatcattttaaaaagaggaagagagaaaggaaaatgaaacagcacataacatgtacaatgtgcttttgactacatgcactagacatattttcaaatgaaaatctctaatgttttcttaaatccatttcatagcattagagtgctttggatcgtaactccatagacatgtgttataaatcaatactattatctcattcacaagtctgtagcagacaggcagacgtggatcccaggataatagacgtatttggtgttagatcaggctgacattaaaaaacgtgtctatggaatctaaacaatagattcacttgctgttttgtagaaagttgtttgttttaacatacttatacctctcatttcacaaaatgcactagcactgcttcagaaacctgtctaggaaaaaatactaagctactaaaatttaatagtagttttaggaatagtaaaaatacagaaactgtatatattgtcataaatggagaaagtccaatgttcaatcaactacataaatctaattttcatgagagtacaaaggtatccaaatgtctctggaaaaaaattgcaaataaatccccagatacgtagctataattgtactgtatagattccctatgctccacaactagtaagatacattctatcagttttttcttatgaagctaacgttgtgattaacattagaataagtcaagcccttttcttttgcaccaatctaatatttgtattaaaattatgtattgactaaatatgtggaatatcttccattaagaatatttgtaacctgagaacactttggtagagaatataaattataacctattaatccttaagagcttataaataaaagcttagaggcatcaatcagtaggatgttgttgttatatttaagacatcacaaaattgaaaataaattcagtttagtctaaatccatgtattctctgactctatgctttacacttcttagataacattttgaatgcagcattaagaaaatcaggcacccaattgcactgatgctagagaccctcaaacattaagactgctagagcaaatgcatttctctctctctctctctttaaagtaatttaggggtttttaaggtgatgtgagttaatgaaggaaaccagaattttaaagagtacaagtgacaagaaaaagtaacagaagatgtcagtcagggggttattggtttaatttttaactttacatctcctattccctgttttaattgggatgattgtaattgatgttatttagtgtctggaaagagagaaccatgagagctccattagccttcttgggataacaagcaaaggtaataacttttcctattaagcaaacaaagactgtggccaactctcatttggcttgtcagtgcctccccgccaggacggttctgcctcctcacttgtgtaaggagccggctggctggccggcacacaggatgtgctgtcaatattgcctggcgagttttaaaatcattttccaaatgaaaccctttaaaaattctatgaaccattcttttgctgaatgtatcagtcttttgctacttacaacaaagaatgtgctttatcttcaacggtgcttctctgtctttagtgtccgttttatttctgtccccaataaaattcattagcacagtagaacagaaattactctgttttaatatgatcatctatttcaatagaaaatgctcttacacacagatggcttacattttttgagtgtgtgaaacacaaaatttagcattgcataatctactaactgcaagtctctgatggacttataattatgatttcctactagctgatttgagaagttatttctgtagggagttcagtggacttcttatttggatgtcataaatacttaaatattcattttccatgagttgccagggacaatgggttcccagcagtgctaaacagctctctgaacagtaggtggcagcactgttcagctgccttttgtttggttttattttgccaattgaaatcagttccttcaccattagaacaaggggaaaaaagggaaaagcttcaaatgtctatatgcttacatataaaacccacataaatctctcataatttgggagtgcaaattaaaatgattacttaagaatcaaaatgacaaaacagttcatattatgttttctcccttagcttgttctatgtgattgcttacttttaattttgcctgtttttcactatttgaaggaaaaaattacaaacataaaatatgtccacaagtgaagtactctgcacttaagtacttctacatccatagttgctgccagtttcaagagagagcttcttcgtgtcctctcaaatgctccacaatttatacctaattttatcagttccaggagtaataaattgatacctaattttatcagtcccaggagtaataaattttcctctttctaaagagtagccagaagtctcagccagttcacagcgtaaagtttccacttcttgaagattcaggcattaagtatgtgataatttggtcattttacttagtatcacatactgacatacatatacagggttttgcatgtgcacccgaacatacaaacttattgtgtattgactgatgaggagcctgagtgtgtgaagccacctatgataatgaggaatttgaagtctgttttattcaagtctactgttttttcatttgttaactaagtgatcccgataactacctcacagatttgaagtgagaaatgaatggggcacagtatataaggcattctgtaaaagcaataatcccgttgttttattattctatgtctgtgtttttgctagacagtacaatgtaaggacaaacaatgtaaggatataatatacaatcttatatccccagcacttggcacagtatcatgcaaactttaggcactcagatatacttctgaatcaatgaataattgcaaattttcgaaacataatgagtttataatataaatcaagctggttaatttattgaagtaaatccaaatacccactcatttattcaacattcaaagaggtcctcattactctgagctcaaattctagcagatgaggtggatgtattaaatatatatacatatatacgtatgcaaaatttatataaatatatgccagtgctttagtccagtggttcccaacattttaggatccagggactggttcgtggaagacaatttttccatggatgtgggaggaggggagagggatagttttgggaaaaaactgtcccaactcaggtcatcagatattagattctcacaagcagtgcacaacttagatccctcgcatgcacagttcacaatagggatcccactcctatgagaatctaatgctgctgctgatctgacaggaggtggagcgcaggcagtaatgctcacttgcagcccccttcaccttctgctctgcggcctgtatggctctgtggtcctggggttggggacccctgctttagtctatatgtgaaacattgacataaactcataaaagtgacaatttatatatgatactttgttatttatgaagcacttataaatatacaaattatcccatttaatctttttaacaactattcagttagaaatatttaatactgagcaacctgagacttaagagtttaagattcttaattaagatggactcgctctaaatcatcacctcttcacactataccatgtgaaaagaacccacaggagtaatcagttcttgtgatgcacggccaatacattatggttacattaagcctgtacagtattcctagattaaatggtttgaaattatctatttaaaaataattacttctttatagatgttagtttccccttcagtgtaatagatatatttatgctctataaactaaattcctctactcatctatcttgcattgtacatttgatgaagtatcatatgtgttagtcattgtagtgacaggcagaaagaagcaatcatgtttattatcattccaagactctcattgaggaatagcacaaaagctccaactgccacttatcctagagaggtagcaatatgtaaacatcgaacactcaaggttagagctgagccttgaatatgagctggtagggctgaggccttcacttgagtcaacaactgcacttgaattttgcacagggagatgagggtcgtggaggaagaactcttacatcatgcatgcctaacccacaaggttaaggataaactgacaaggaaagtgatgtggattcttcctgcttgtaatcctcaactataaaggcattgcaagagttagatacattcaaggatgatgggattgttatgatttggatttttatcctaactttcttctattgagactatttcaactattaccacagcctttcatgcaactgctagagaccaaaccacaggttagaggaaccgctggtccactgtgggtatcacgttaactcacaaaattgcataccattcatgtgctacttcagatccttttgtctcacctgtttcttggggctttgctactttttgattttggcaaccacttgcactgaccaggtcttgtgggctccaatcagtgcaatagatatatttgtgctttataaactaaattcctccactatagtgatatatccatagatatatcactctatatatctttcattcttacctcctgctctggggattccctgttgacactgaggtcacaacacttgcccagcaaccatgcacatgcaacctggaagagaggggagctagcctactgtacaatgagcctttgaccaatgagagacaagacaatgaataatttttttttttttttgagacaatgtcttgctctgtcaccaggctggagtgcagtggtgtgatctcagctcactgcaacctccgcctcccgggttcaagtgatccccctgcctcagcctcccaagtagctgggattacaggcacgtgccatcacgcacggctaattttttgtattttagtagagatgggttttcaccatgttggccgagatggtctcgatctcctgaccttgtgatccacccacctcagcctcccaaagtgctgggattacaggcgcgatccaccacgcctggccaacactaaataaactcttatacctttctcccttcaaaaaaccttttctgagatgcaattattcagatgacaaaaaaattgtcccaagagatgagcaaagctttccctgacttctgttttcttgatatcgtactccattaaaaaggaaataacacaggtgcttttgcctcaagctttgctttcaggggaatccaggctaaaacacacactactaacacaaatagaaaatccacatcaaatacacaatgaaatccttcagccatcaccaatacttcctgaatctcctgcaaacactgaaatgagcaaagtcatagttttctgcagctctttaagaaaggtgtaaaaaaatggtattgattcaaccaaatgctctgaaatagaaagcttcctctttttgttttcccaacatattataaaatgattaaaattataattttatggatttaattcagaattttatttcacttatcataagcttgtctcataaaagcaaaaactatagagaaaaacctaaatcataatatctccccaatacaatacttttctgtgtttgaagtttcacatcacctcaaataattgactgattatatagcatgcatatgctaagtcagcatatgtcagtgttcagaaaatgttgaaatgagattatttatgtaatttataatcaatcttgttccaaaaaaagatttaggaccaacaactagaaaaatgcaatgtggtcaaccaactacttctatggggacactttctctatttgaacgcctcatgtttctttcatattttttctatcaaaagtggtaatcccacaactctccttctcagaaaatggatcaaaaccaaaagtgaaataatccaggcacatttgtccctagggaggtgatacggtttagctgtgtcctcacccaaatgtcatcttgaattgtagctcccataattcccatgtcttgtgggaaggacctggtggaagataactgaaccatgggggaggtttcccccatattgctcacatggtagtgaataaatctcacgaggtctgatggttttacaaggggtttcagctttcacttggctctcattctctctttgcctgctgccatgtaagatgtgccttttgccttctgcatgatatgaggcctccccagccatgtgaaactgtgaatccattaaacctctttttctttataaattacccagccttgggtaactttatcaggagcatgaaaatggactaatacaggagggaaagaagtcataacatttagtttatctcgttgtttatatctataaaatgaacattggtttgaatcataatgagaataataaatatatacacacatcgtgcactcttggtatatggttagtcaacatcaagtaattaagcttagaggagagtagcaaagaaaataaaaaatttaattagggccatagtgagaggctaaaaatcagataatattaacattttccctttattcagaagtcctttagtttctgaaatctccataataaccacctttttcatgacctccttacccaattccaggtcagactttcaggaatgctttaaaaagtcaacattattactataaataattactttgcaaaatttaaaattattattaccagtaaaaatgaatattatatatctcactgccttcttcgtctgtatgtcttttaagtcaaatgcttttttttatgattgaaaatgatcttctaatttctactgaactgtaatcaccttgaaagtgcgaacagatttatctttgtaaaacttcagtattacacatgaagccttgcatgtaagaggtcagtaaatatttcctggataaatgaatacattttttgttgaaccttaaccagcctctgcattactagagcattaatttcttagagtgggttaataaccataattaattcaaagttgaacaactgggggtagatggtggaagttgaaacataatcactgttttaaaaccaggttaatgcagtttccaaatcaacataatttgccagtagaaacatcatcctggaagaaattgacaaaacaaattctaatcacgagcttgtgttttgtattacagacagtttttgtgtatttcaacttgccatgttgaagaatacagccagggtggcttcctatgtaattgatacaattcagtaaaatatttctgctgttttaaaaacattttcctgcattaaaaaaaaatcaatgtttattaaatcctttcaaatgtttaaaataagattttatagctagaacagatcttgtctagtctggtctgaacttggagaaggtaaaacttttaaaaaccaaaggtaacattgtttcttaatttatgttactgtagctttgtactgtcttccttagccaggtatattgctcttctctttggtatttcctttgttatttctttcattttaggaactgaaaaatgaagtacagcaatgcttcaacctggtattacagtttatattagacagctagcactcatttttctccttttgtaactcctagagattgggggaaaaaaaaaaaatccctgcttttgattaaatcatctttattcaaagttagcttaaaaagtaaatgaaaattcatctgtgtcattggaagagatgaaaacttcattactgtatattttttaaattattgtaagataaaacaaatgactcacttggttctttaaaaatgccaaaaaataaggagaaatgtttgcttttactagtagatatttatattattatcaatactaatgagatgaaagaaatcggagctgatttcaaggtagaagaaaataatatggaagaaaaataaaaatggactgcaaagtgttttttgtttgttctgtttcctttctaagaagtagagatctggggaaaacaagggatgtcagaggatctgtggtggtagtttcctcttccttttttgtagtatgcagaagggttgttccttttgcatactatctcatcttctcaatatctggcctctaagaaaatattttttctaactactgtaaattgaggataaagacacatatattgtgtttatggttaggcaggggaaagaggggccacaagaaagaaacatagacactaagcatatgcatccacagaaggagagagagatacacactacgaaatgtaggccggcatgctgaaccattgagaaaacaactgagcagaggttatctagaagagtttattaaaaacaaaaagattaattaaatggagagtcttgaagataaggaaaagcaaaatggtaacctctttctaaagtactctgggccaaccattttaacagtgtgtattagttcctacactgctatttaaaaaaaaaaacaataaaacaacaacaaaaaaaaactctgactggataattacgtcggtgcaaaagcaactctggttttgccattttatggcaattaaaatgctccggtaatggcaataaaatggcaaaactgtgattactattgcactgactcaatataaagaaaagaggtttaattgactcatggttttgcaggctctacaggaagcatgatgctggcatctgcttggcttctcggggagatctcagaaaacttacaattatggcggaaggcaaagtgggagctggcactttacatggccagagcaggagaaagaggggcaggggtgctacacacttttaaacaatcagatctcataactcacacactatcatgagcagcactgagggatacctgcccccatgatccaatcacttcccaccaggccccacttccaacattggggattacaattcgacataagatctgggctgggacagagatccaaaccatatcggagtgattgtatgttattttttaactttctaatggaaatacaagtgaaagtataaatagtctcaaggccagtttcaataagtgagcgagagttacctgtgacaatgaatcagaaatttgaccaaatagcaactcgcagaaagacaagtttcatgtggtccagaaggtgaaggaagaaaagggttttttaaggaaatgatttgtaccccaagactcaaaagagactgttcattgtttaagcgagcttgttccagttcttactttataatgggctgttacacttcttaggattcctagaaaaattaccattcccaaatgctaattgcaattccattttctaaaagtcagtattttgcaacaaactatttaagtgaaaaaaatattgtcagctctctacatgttttattttagcctatatttaaatagttcatattgaatctgaaattatactagagttcaaaatcaatgtttttgtttctcttcaatccaacctcaagctatactttatagtttctctttttcactcaacaagaaaaagtaacacatctaagaccacaacaaaaataaatctgatagaaagcagtttgttgctctttaggaataaactcaccacaaatattccactgctgtattgtagtccatagttagaatgagtaaattagaaataatttacccaccctaaaattatcccagaaaaaagaaattcctagggacttagaaactcaggtggaagatgctctttagttacatgctgtgatgcccttgcttaataataattctgtgactgaaaaagaagttaggaatctagtgtaatctctgtaatcagtgattctccttcaattacaaaaagcggagctatagtttttagtttcaaggattcctggctcaaattccagcagggtttgttcatgtacaaattgcaaagctactcacttgattaagaaggctaatttaatattgctatgtggattgcacactcacacctcagtgattttactaatactacttcttcctgggttcctatggggaattttgaaggtgctagatcagcgttggtttgcagaagcatgcagtctgctgtagcttcattaacctaactggaagtgggcctcatttagcattacccagatggtaaaattggggctgattatctgctctttggaagctgaaatgtgctaataggtcaggcggtacttcacaaagtttagtggacataggaagcagctgggagcaatttaaaatgcagattacataatcccacttccaaagattctcactctcagatctgggtaaaattcagcattttaaaacaagtatcctcctcccctcctacagcaggcctttccaggaagttgaagagtaggttggatggtcgctctatcaaatggtggtttccagacattgcttcattcaaaacaaaagtctaagtcttttcaatgacattcaggaccctaaatgatctagtccccattacctctctaatctcatctccctccccatcactcacgttgctgtagccacacaggcctccttactgtgcctcaaacattatcaagactgcttcaaccccagagattttgcatttgttcttccttctgtttatagtgttgtttccccaaatatctgcatgtcagtcttgcttttttcctttaagtcttatctcacatgtcactttctccatgaaaactaccctgcccacctaatctaaagttgcaaccactctgtatttcttctccctttctttgatttaatttccacctgggcatttatcttgttattttgtgatttctctaatagaagataagctcaacaatagcagaatttggtttttgtctgttttgttcacttctataagcccagcacccaagacagtgcctagaacatacataataggcactcgccaaatatttattgggcatatgaattaatgatgaggcactgcgtagagttatgcaatactgtggccttccaaacagttggggtattttccacatcagcccttttgtcagaaaaatataattacaggtatgactgaagttcttcaatttcatcaatttcagcagtacctaaacaaaattgaaggctaaatatattctggctaatgcaccaaaaccatccttaacatcagaaaatctgtatttaagtgacagctctgtcatttattatcttgtgtggtcgtggtcaaatcatttgaggattcaatttaaaaagtacgtcactaatctcactaatgcatgttctacaactataaaaaggtaataatagtaaaagcttctcccaccctatagaatcttcagaattaacttgagaaaagctttttttatattatacactactaaataaatatgagcaagtttatactcatcatccttcacatttaacattttaacttgatacaacaggctgttacagtggtggcttctaatggaccatacctcactatatccatgaagtcccacagtgatgttagaacttagccaggagacttgctttgactgattgcatattaacaagcacaatacaagcagaggcttaatgagaggcatacaggataataagaggcccactggagcttaccttgtttttcttttttttttcttttttttttttttgaggcaaggtcttcctctgctacccaggctgctggagtgctgtgacatgatgatagcttactgcaaccttgaacttctgtactttagtgatcctcctgcctcagcctcccaaagtgctgggattacaggcatgagccaccacacccagcgagcttacattcttgaaagccagttccgtgctttaaataggcttgagctagactacccaccaaggaaaaaccacgtggaggattcgcaggtaggtgagaggctatcttgaatattttgacctcagctgaatgcatgaggaagatcagacaccacgtggaacagaagcacctcccagctgagtccagtcaatcacagaatcaagacaaataataaattactgttttaagacctaagttttgggatgaattttaatgcggcaacagaaaattgaaatccctgggtttttaaaaatgacatcatagctttaaaaaaatactttaacagcaggaattctgaacattgtatgaaagagagaagataataggggaaggaggaagacctttaaagtaaaatcagatgttcacctacttcacttacttttgaagcctaaatgacagttagtacataagatactgcttatgcctatgaaaaaaagggcctcaaatagagtcattttgtataagtcactgtataatcaaaatctatcttgaacaaatgacaacaaaatacaggacaaagaaacctcctatctgcttttctaagacttgccggtcgagagtagccaacccactacgagaaaattctgaattcttattctgtaacttacagtagttacctctgggcaggagtctattgttcatgattaggacttccaaatgggagcaaatcccctggcaacttccagatttaccagtggggatttgcactttgatgaataagtcacactgctaaaaattcagcatgggtcttaatcggtgctgaagctaagttcggaataaacaaaggtcagaccctttttgctgtcattcctcctttgtgttattaaggtcttgtttggaagcattttgtcatacatttggcaaaagggtaggaagcaaagtagtgaagtccttgtgaatgtacaagcagtcaccagggcactttgttaccattctgagagaaatgttctcaactcggaaagagctctgacatttttaaaagagatattgcaaacgctttatgaagtctttgtgtcctccaggccggcattgttgtttagcgtaatagccttcactttctaagcaaaatggttgggaagcttttcaatgtaaggtaaaaggtgtcttcctactaccagtaagtaacatgctttcatctttttgtgtagtttttttttttttttttaaaaaaaaaaaaaggaacacattcaatgatgccatgaaatatgaatgagttatcttttccaaatttgtagttaacatccttgttattgtcaaagaattcaagactccaaagagtaaatttttgttgaatccaggacaggatgccaagctagattctttggtactgacttacatgtgtcagaactgatctccaacaacattgcaaatttatcaacaactgagttcagtatgcctgaaacactctgtgggtggcagaaataaacaccacacacctgtgactgactagttattattaatttctcagtaactgcaatgaattcagtgagtagaagaaaaaagtgtcagaaaagtgctatggtttacagaccttttttaaaaagaaattcatcccacacaaagccatcaaatgaggatattcttattatctgaaatctatgtgggcttccaaatggtaatgctccaatataagtattatgctgcagagaaaaaattcccaccttataaatggtaatatatcagttttcctctctctctctcttttctctctccagtatttgattacatgctttcctttatgaaatacgtggtaagtggcaatattgtaaagcaaatttttgctgaattaaaaatatagattttaaaggtgtaatgcattatattatatatattactgagatcttcggatatgccacagactgacctccaatgtccatgttagtaattattctaaaaatcttttctttagagtgacagaaccccagaaattttactttgtgttatgcagtgggttgaataggagtttgtaggtttcattgatagtaacgtaccttttccagagcaagtgccaacaattctgggaaaactaaaaatactctaaagcagaatgagcgttaatcggaaagcaagagaactggtttcttgttctcactacattctgactcaaccacccatcagtttctttatctaacaaataggagcactggtatctggtctatctctctgggttgttgcaacctttagtcagatgatgtttataaatgtgatctgtaaaagcacaatgtaatgtacaggatcaatattaggtgtgttgtttttaggcagcactaatgtatttttgttttgtactgtaagctgtgcctgcttgtctacgttcacagtgcttccacctgtccatgcagtggaccttctccttggaaataatcctgtgtaaatatcttccctggaaagtataaaccaaaaagaaagcattctaatctggctgaatttcatatctaatatagagtatttggaggccatagaagtggaagaccattaaggaaagaaattcattagcatgctacatattttcttagtttaagtgacaaacaacagcagagtaaggctaggccatatgggaggaaagaagctaaattccttgtggaaactgtaaatccatgtctccttctcctccaacccaccaaagggtgatctagataaaacatgtgacttaaaccctagatcagcattcagtaagtatgtgattcccaaaatatgcagggaaattgggccaatctgacttttaccttaaatggaaaatcttgttatttccttttggagaaagtaaaggagcaatctaaggatacttctacacccaaatttaaagtggctgttgacagggccagaaaaggagatggagataaataatgtggctggaagtggatggattatataaaaagaaaaagacatgtaattagatgcaagtagatttttggacatccactctacaacggtcacctttagtattcatgtaaaccattttggagatactaaagagaaaaaaggaagagtcagaaaagaaaataaagagagcaaaggtctagtaatgaacaactacatgcaggcaaggatatgctaacacatgtctgtgaacctccacaaaccagaatatttaacagagagaaagagaaggaaaatacaacactgccactgaatgttgtgttaagagaagataagatcaaatgtgtgcctttatgaaagggaaatagcacagcaaggatgatgactatgccaacccatccaggggttttgactgtcacgtgtgacacacagataagagcatgttcaaaggatgagggctgtttgatagagaacagcaccgtgcttataggaaacctatataaaaatctggacgttatagatacagaggggtctatttgcctggaaaaatgtagttcttgtgaaataagaaggtgggagaaacgccccccaagtctacatacaccaactcagaagaggtctttagtctaaggactttgagcaaatgaggctaatgaaagaaagccaccgtgtttgatgtttaagaggacagatgtataaacaggaaaaagttaaaatgggattactactttacacctccaacaaataaaataacagaagaatactatcatggtgctttcatcattagcctcaggaaatatctgcccctgtgtaatgtggatcctgcagaagaataacaacaacacaacaaggatggcaacaaaaaccctgcatactcttttacaaaatatatatgtatattttcttctgcttcaaaaaaaaaaaaaaaacccttaaaggcagagagtcctgtgtttcatgtacagcattgtcaagttgtctggtagagatgagaaagctgacagccctctggagggcctgagctgaggctgcgtgcagaagtctggaatggcagagacctgatcccgcatgtaatgagaccaaacagagctggaagggaaactctgctcgtaagccccttcagacaaagaatcaagcagcagctgcttgcctgtcatgcttcaccttcctgtccatggtcctccttttctgcaacagcaggggcaacacgaaaagactgaagtagattacagttagctcagaggccatataggcactgtgtaaatatattcattcatttatccatttatttgaaatttatcaaaaatttgccatgtgctttgtgctgtgcaaagtatttgggatgcagtggtaaataagacacactttccagcaggaaagttttcatagtctggtgggggaagtgaaaatgtaaacaaatcttcatgtgtacatgagatatgcatgtttattccaagacagctaaaaccatttcccacaagcatttcaatgcaaacaaaaagctagtccattaaatatatatgtatcctcctaggtttgttaatcttaaagctagaggaagatcttataatgacagaagaattttggccctgtacataagagtggttaagaactgaagtctttttaaattatacaaggaatagacatagtcttttagttataaaatttgcattgacaaactaggtgttaactgaaatccttgtcataactaaatcgcatcttagtcatataaaatctttgtcgtgcaagtataactcaggtacataactttgcattctgcagaaggagtataattgcatatctattcctttctttttaagaataggaaaagatttagcagaacaaagaggttgctcaaagcctcccagtgggcaacagtcaaccttaagtgtgtttaagtgggcttggggggggagattcaagtgttaaatcatataattatattaagagagatacctgaggaattggggtattccggttataatcatatacttgaaaacatgaggaacaaggtacaagtaggttctttccttttatttaaaatataaaagacttataattaacaattaatccctcctaaaggcacttagtgatttctcgcttaaaaaaaaagggcttcactccttgtggttggctgcagcaatcaaaaagttcatatttaaatggaaagaagtacgtcccacactaatattaatggtacaatggtagtaggaacagaattgataattgagttattaatcaacattgccatttttaagaatatggctacattcttaaaaagaaaaggacaatgttagtggcactagcaccctgggaacttggctgtgcccagactgactcctctttggctctctgacttcctacataattagaacttaaggtgtaaaattggaacatattacagaacagttgttttcacataaatattaaagcagatatcatgtcaaggaagaaaataaccagtctcacaatttggctgaatgtagaaaaaaactgaaatcagcaataggtagcattttttttactttcatctatttatttaattttttaaatttaattgttttgatacctcagttttctaatcagtaaaatgaacatcagtggattttagagagatactttaagacaactttggaaatcccgtaaaactaaaactgtacttctcaaactttaaggtacatgtgactaactcaccagtggatcttgttacaatgcagattctaacttagcaggtctgggttaagccccaatctgtatttctacacatctcattttaagcaacgagattctaaaaacaccttgcccaactgtaatttccaagtatgtctgcagcaactatcattcatgccacatgccctttggcatgtaaattatttgctgctgctgcatccggaggtagagcagcatctatttctccatctccttaaatctgagtgtgcccttcaaccatttggacaaacaggctatgatgagactgtgccattttgggttatatcccttaactgcactggcagcttcaacttccaggctttgggagccaggtgtcatgaaagtagtatggctaccgaagaccattataacatgagaatcccaagccacttaaggaggcccgggaggataagactaccatatgaagagagacaaaaagacagagagagagggagagatgagacaatgaggctgagagggagaagaatcaaagagcatggaggcaccagtcacaggtgaagaagctacattgaaagtagaacctccagcctcagatgatatcacctggatcagagaaaccatgagccaagcctttcttaaatttctaacacacaaaatctgagcaaatttaaatggttgtttcagaccctaaattgtgcagtgtattgcttctcatcaacaggaaactaaatctgaattaataagtaagggaattttaaatagacataaaagtgaaaagtcagtactttaatactatttacattcaatatatgtgctgataaagcagcgccaaaaaaaaacttgtgagtgacctgtttcatttcccacttctgaaaaatatagatattgtatcaatatccaactgcacaatctcacagttaagaggtggaactgggatttgatgtcaagtgtggctaatgccagaaaaagcacacaggcagggaacccagctgagaatgttttacgaaaagcttccaaaatgagaaggtggttgaacccagtctccatggagaagtaggagttaaaaaagtgacaaagtttggtaggacaggtatctcaatcagagggacagcagataaaaataatgagcagtctgaaagaatggcacattaatgagtggaacaggaagactgaagtaacaaaagataattctggcagtggctcatgcctgtaaccccaatgactcaagaggacgaagcaagaggatcgcttgaggccaggaattgaagaccagcctgagcaacagagtgagaccctgtctcttaaaaaagggggaaaaaagataattctggagcagtaggcttcatgctgtggagagccattgcaaacttttaagttgacaaaagatttctgaccaaatgtagattttaaaagattaagcaatttggttatccaattggaaaaatttcaggctagaggtagacagacaagtgtgaaggttgttgcagcattacaggcaagacgtggttctgttctaaactaaggaatgttaagagggaaggaaaatactggttataaagatattttagtgataatgacaagtgtcatgatatggccacaaccatgacaataataaataatatttattataaatcttattatattaaatataatatttaataatattgatatgataaaagtcaaattagtgattaacatccctgtctctacatagattgtgtcatgaagagagacagggatgttaggaagagacactcaaatttggtaccatcttacctttattctaactcttcttataaaacgctattatattaatatttctcagatgtactaatgataagatccttctccttcagaaaaaaaaacaattccaagaaaaaacaccttcaaatgtgcattatcccacagcataatattaaaactcctcacgacggtaatttaaggcttcttcatgctttcccaactacatccttggttttgtctctctaatcaccttttacttattcttcaatcagtcacatggacctcctcctgtatgtactccatgttttgttatcttgttcctttgttctagatgctgcctctaactcagtgcttctcaaacttgagtgtgaatcggaatcacctacggaaattaaagcacagattgctgagtcccagcctcagagctcctggttcagtaggtatagggtgggacctaaacacaacctcaacaataatataaatattatttattatttataatgataattaatatttattattattattttgactgtaggatataataagctaaaaaatacctctgcctcccccagggatatatgtgttctaattcctggaacccataaatgttactatatacggggaatcaaaggggtctttgcaaatgtgattacctgaatgatcttgacatggagaaatgatcctgcattatctaggtgggctttaaatacacaagtattctcattataggaaggcaaacagagagtttacacacaaatagaggtaaagaggatgtgatgtgaagatagaggcaaagatcagattaatgaggccaccagccaaggaatgttggcagccactggaagctggaagaagcaagaaatgggttctcccccagggcttctagaagagagtaggtccctgccaacactttaatttcagcccagtgattctgattttaggtttctggcctccagaaccataagagattaaatgtcatttgctttaggccaccagtttgtggcagattgttacagcagccacagaaaattagaacacaggaaaataaatcttctttgaatttcttagtgctcctgtaaaaagggccagctttctgggacatggaaatctgtatgatataaggatggagaaatttgccttcatttcccctcaaaactttttccttttcccatactataaggattagatctatagccatttgtcaagttaactgctctgttccaaaggataataaacctcatcaccctgagggaaccaaatgtttacagcctggactaggcatctaggttaagctccctgggagccagggagatgggagctctatctccctatttacatttcaatggtaaataaaacccaaaatgtggtacagtagaaaatacctgacagtggttacctgttgcatccaaatctgagcgagtaagatggtatataaataccaaattgaattgaagataaagatatccctaggtcataaaagccagaaatttgaagtttgtggagagattcaactactgggaaggatcctgggttatcgtaaacccatgagcctttccatttcgtctccaaggagcaaaggtttttctcccttctttgaggattaaaagggtgcagctggctttctcttgtatataaatggccaaaaacaaaaaaatctatttttctttgtctttctctcacttatgaagtatttggccacttgtgtaagataatattttatctggcttttattatgttgctccaggggtaaggactggaacaagaggggccaatttagttattatataagtaataaataatctgtctctggtctagaatacctaatattcatactaaagattaaaattaataaagataaataataaaaaccaaatacctatgttctaaacatttctccaaacctattattatctatattatacagaagacaacactgaagttttgagaatttaattaattttattagaatcacattaatgataagtggtatagccaggatttcgtgtaagacatatttgactccaaagcccttgctttaaaccatggatttaataattaactttaaagaagttaattattatgaggtagatagaatctaggatgattcaacatttatgacttgggctcttgcatatggtagttccatttaccaaggagtgtacaggaactcaaaatcttttaacctggaaagacaatgtattcaatttccaatatgttgattttgataccataaaaatattttttcaaaacattctaaccaagtaaaattgtaatataatcgaacagatgagcaatgaagacatacatttctgaaccactcacaggtaggttataggtaaagctttggtttggatgagcttcttagaaagtctagagtgaatgagaagggaaggcaatggaggatgggccattaagtacatggatggaagaagagttgatgtgaaggagccagagaagtaggtggaatgacaagaggaagtagaaacatggagtgcaaaggaagcagtcaaagaaaggaaagtgatggaagactggggaagagagaaatgggaagctaagtcagggatacagaaaggcaaaacagtatggtgaggaaaatttaagaggagggatgacaggaaagactcataattgcaatgcattatcccatgtaatccataaggatgttttccacaggctcttttattattaatgtcaaaagcatgtaaatagcacagtaaatgttttgtcattctaataagttacttgaagatatttgacatgataatataaatgttgtagttaatttagaggaaaagggcagtttttatatagagggataagttacaactaaaagacctgtattagaatctctttttgttttgcattcagtattgttataaatttctgcgagttaattgtcctctctgaaactcattctccttaactacttgatgacaataatgtcggcctcacagtgttactgtgaaacttcagtaagtaatgtatataaaggtatctaacacagtgtattaacatacaccataagaaatacctgatcaatgtatttcctagtacatgtaggaaatagtaagaaatacctgatcaatggacatcagttgaatctgaagaactataatgacatataaatatggaagcaaattgaaaactacaaaaacatcatataccaactaccgtataacctcgttgtttgtcagtatacaatgctacagtcttaattttgctttgtgtttttattgggcacaagagggcagaataatattaccccttgtcaaaattggactagacctaagcagaaaactttctgttaacagcttatattctgaaaatcaatcatctgaaaaggatgaagataataaaataactataggattaagtgaaatttatttatgttttcaaccaaacaataaaagtaataaatgtgtatttgaatttatctgtagtagtataagttgttgaataccgcttatgtcagattatgtaatagagtagtggaaaacataaaatgttaaaataacaaaataactacacgatcaattccatcaagaaaaataacaaatataaaaatgactcaagtatatggcaaaatattacgatcaccataaaaagacagaaagtctaagggagttccaaaaaaagagattatatgtgatcagcaattctaggtagagctggtggcacttcagttgtaccttgatagactgactttagaacttcagctgaagagaaagtggggaagggcattttaagacagaggggaaaacatgagcaaaggctctgagctttggacagctgagacctatttaggagagcagcatagtttggttggaatgtatgaaacctttgtgggagtgatgaatacaaaagctagaaagatacaaggacatggtttgatagacattgagtgctcaataaaaaaatgcaaacttcctttgtgagacaaaagagaatcactgggatattttgggtaggggagtgtgtggaccagagttgaatttgaggaagagtatttgaagggaaggatttattgggtttgtaacatcaggtagaattgacagaaagttacttaaagctaatggagaccctgagttacagaagagtagaagaatctaagtttctctttaagaaatactataaataaaaaatgaagaaaaaaaaaaaagaatgacttagaatatcatcattgtgcaactcctaatgaatcaatggatttgagcatcaatggctgataacctcccaaaaagagacaagcagatattatgttgaataatggaagcgatttgttaaatgatagacactataaacttgttttgcaaaatacaaaacaaaagaaaaacctgaatttgattgtgcctctagatccaactagtagcttagaaggaaggcataaaacacaggaatatgtcaaactacactctaacaaggcagttgacaaaattacacctatgggaaactctacaagtgaaaaatctagattcttcaacaaataaattgcaaaggaaaaagagtgcagggagggataaacctatatgtgatggctaattttgtgtgtcaacttggctgggccatagtctcagagatttggggtcaaacatcattctggatgtttttctaaaggtgtttttggatgagattaacatttaaattggtagactttaactaagcagattaccctccctgatattggtgggcctcatttaagcagttaaaacattaatagaacaaaaatagaccactctcaagcaaggaggacttctgtcagcaggctgcctgtggacttgaactgcaactcttcccttggactccagcctgccagccctaccctgtgattttagatttaccaagtctccataattacatgagcaaattccttaaaatctctctctctctctttctctctctctctctcctacacatactaacatacacacatttattctgttggttttatttctctgtgttggttttgtttctctggagaaccctaattaatacactaaagatgaaaagagacagaatatacaaaaggaaaaagaggcaaaaataaaatacagtgtttggggatgttcatttgttctataaaactacaaaggaaagagaatggaaaggggcttctgggttgggtggcaaaattttatttcctgacctgtgtaatggtgaagtgtattcgctctatgaaaatgtattaaactatgcatatgttttgtatatttttctagatctgtgttagatttttataataagaaagcaaaagaaactagagaaggaggataatagtcacttgctattaataatagctaactcatatcagtgagtaattctcttggaaaccataaatttgctaagaattttaagtattaaagttcaaaagtaacttattattgcataacagttctctttgcctttgtggaacgactgacctattatttattagaataagaatatgatacaatgacaactaggtaactttttgcataatggttgttgtgtaatacatttaaatgactattcaggtgggttgagaaagcacttcaccattggtggcttaaaagtagtaaaccagttaaggcaatattccttgaacagtccaagctacaacaccacttggctcatgaattcttggcattcaaggccaacaggaagctagatctgctgtccagtttctgcaggtgcacactcagccaaataaagggatgccaaccacattaatgggatcactaaaacacagtctgcaaaatctacagaatgagaactgagcaaggtattaggaacacagcactatctataccagaacaatagtctatgccagcattggccaatagcttacagttaaaacaaacaagcttaatcactgagataccaaggattcctagatcagtatttcaacagcttcgggatggtatgaagaaaaaagtgatagtatagtttaatgtctctatattcaaagacaaatctgcgtttccagatatatgttgccttgaatgtcatgagtacctaaaatcgtgtgtgttcaaaaggaatcacagattcttcctctcactgtctcttcataacatccctgtctctcttcattgtacaatttacatctaaatttccagaagtaaagtcatttcccttcttcttcccacttcatttccaattagaggcaaaatagatttgatttcaaagcttttgaaacacttcttgtaactgtccacttaagcaaataaaacaccacttgaatctactcacttctctccatccctgctttcaacatcctaattcaagctcttctacttcttgggtggaatacaacatatcccctaattcttcacagcaccatcttacctcttttctaactcttatgataaaacattattatgttactatttctcagatgtactaatggtaacatccttttttcttcagaaacaaaaccaattccaggaaaaaaacatcttcaaatgtgcattatcccacagcataatattgaaactcctcaggatggtaatgtaaggcttcttcatgctttcccaactacatcctcggtttcgtctctctaatcactttttacttatccttcaatcagtcacatgggcctcctcctgtatgtattccatactttgttatcttatccttttgttctagatgctgcctctaactcagtgcttctcaaacttgagagtgaatcagaatcacctaggaaacttaaagcaaatattgctgggccccagggtcagagctcctggtttagtaggtatggagtggggtcttaaaaatgtaactttctagcactttcccagggggtgctgacactgctggtctggagatcatactctgaaaaccactgctcaagctaaatagctcccctctatttctgctcctgcaatatggccacttaaggcttcatgcaaatttccttctatccctgggtaatgcctccagtccaaaaccatcaagacatttttttcttctgaatgcctatagtgtcatatttctatcattcttataatacttaggatagcccactattcatgtagtcatgtggtaaaatttaattttgcctatagactgtacattgtttgaaggtggtatccatgtgtaaattttctaaattatagatccacagcacaaagcatggtgtcttatgtacgagaaataaaataaatattttcttcctgcaaaataaatccatctgatagaggacataattattctaccacaaatatctatcggcacaggaactggcaaacgtaacagaaggctttcttttggtgcaaagcttggttttcactttgcatgtattcatgctctgccaatgaatctgggactactgctgtgtgtccatctgttagaaccaatcacaatgttttggggcaaaatactggggcaaaatatttggacaaaatatttaacagctcaaattacaatatgttatatatgatgagaaaaaagctatgacaacatttgctgtacaaatctcatataattaacactttttttccctttttttcagagaaaggtaaatttcagagcaaaatgatcttgaataaaaagcctcatggtctcatgggaaatgcagaacaaggttgtaggcaataggtatgctgaagtgtggcataaccagttgtctctgccaaaagacatctaaacacttaaacaaaaatctgatctatctgccaccattggaactgacttaaccctttatttcttttttcttcttgttacatgcaaaaacttggaagtacatttggtcttcatgcttttcctcttgtccttcatgccccttcctcttgtcattccacctacttctctggctccttcacatctcttgtctttagggaactggcattgtttcttagtatagtatcttggttatatggtttggctctctgtccacacccaaatctcatgtcgaattgtaatccacggcattgggagagggacctggtgagaggtgactggatcatgggtacaaatttctcacttactgttcttgtgatagtgagagagttctccttagatctggttgtttgaaagtgtgtagcacttccccctttgctccctcccctgccaccatgtgaagacaaacttgcttccccttggcccttctttcgtgattgtaagtttcccgagtcctccccagatatgctgcctgtacaagccatggaaatgtgagtcaattgaacctcttttctttataagttacccaggctcaggtagttctttatagtggcatgagaacagactaatacacttgggtatgaggaatctggtgttccagtgttgctactgcccctatctacctggtgaaatactttatctcattaggcgtcacagtttttatccaccaaatgatagggagtgaaatgttttgtttatctctgtcatttcctaaatttattcctcttttgagggaagtagcttccatggcactacaaggtaacatatcattctcctgaaaagattaataggacctctgcaaactagtttttatttgaatcaggaatagcatgcttattatattcattacaactgaaatatatttagttcataaactgccatttctattattcaatcagctctatatatcagcatgacataactgcttgatgcacttaagtaggactcacaacctccagtcacttggttcaccaattacacacctatagtagtgtacatatctttcattttaaatagcattattttcattgtcactatcccattaagaggtcatagaaacattagtaaaaagtgattgaataccactttgaacttagaacaaagctcagtgggatatttgaaatgtatgctaaagtaataagaaagagataattgatatgaagagatgaaaaaaaactaaacaaaatagaaaaagccacattgtgaacacacatgtttgaattctaagagattgatactatccctattaattttaacttctaatagagactttcatatattcttatgctattctgcattcgtttctgaattttttacagcattctaaaggcagggtaaagttaacacagcactagtatttcaaatatttgtaactaaagaaactgaagttcagggagctgaagaatttgccactcataaggtaacacaccagggctggaaatctttttttttttttttccttacaaaccaatatctactctctggaagtactgctgtgcttatgaacaaaggtaatatatgaatatatgatcatggttacatactccgtgagtatgtgaggagctgcttcttaagtgactttgtgtctctcttaatattcaacatagtgcctatagcacaataggacgatatatctaggatactttgttggataaacacatcagaatttcatttgtcctggaaaattgaaactagatatgatcagtgaataaaatccaccatagttttaggcttctggttaagatggagcaacatgttgatttactctcccaactaacatctaaaaaacaacttaaaaaactggaaagaatatatcaaacagtagtactcaagacattgaatatcaggcaatgaagaatgtgacccctgagaaataagccacaagattgctccagcttactgtttaagtaaatttccaggtcacagtgcaaggagagggaatccaagtagagacaggcagtctcctatcttgagcagaaaaaactggaatcccagagaaggcaaagcaagtggagttcacagggcaacagagacatagaatagggaactgtataaggataatccagagaactgcagagtgtccctctttgaggattcactagaataccgatcagtacatggatgtgaagaaactatccaaacccaggtgaagaatcatccaaatttattataagaaaaagtgcttgattttcacataagccctaaataatctctgttcccaatagccagagtagaaaacttcacacttcaggaatcatcaaagaattagaagggtcatgcctcagtattggggaaaaattaactctagactaaatgcagttgtattctggcctaacaaagcttttttaaaagcaagacctgaaagttacttcccaggtaactcagcatctcagaagaaagttcaagaatatctatgggaataaaaataacctaactttcaacaagtcaaaattcatagtaaggtatcttatcaaagatcaaaatgtacacaaagaagcagaaaaataaaagcaataccgaggataaaaaataaattaatcaggccgggtgcagtggctcacgcctgtaatcccagtattttgggaggccaagataggcggatcacctgaggtcgggagttcaagaccagcctgaacaacatggagaaaccctgtctctactaaaaatacaaaaatagccgggcgtggtggcacatgtctgtaatcccagctacgcgggaggctgaggcaggagaatcgcttgaacctggtaggcagaggttgcggtgagccaagatcgcactattgcactccagcttgggcaacaagagtgaaactgtctcaaaaaataaataaataaataaaaatttaaaaaaatcaaaacttacccagaaatgatacaaataatattactagtagacaaagacattaaaacaattactataattatatttcatatgtttaagaagcaatagacatagaagttataaaaaaagaatgaagccaaaacacagggataaaaagcctattggatggaattaaaagcagattaatattgcagaaaaaaacgaatgaacttgaaaatagagaaataggaaccatcaaaataaagactgaaaaaataacacagaaaatacgtgtcaattgatggacaaattaagtaaccaaatatgcgtacaattatagtcactaaatgagagggattaaaaaaaagcgctgaaaatttttcaagaaatcatgttcaaacattttccaagtttgacaaaaactataaatccacagatccaagtaacataatgagccccaagaaaaagaaatatgaattaaactattccaacatcataatcataattaaattgcttaatgtaagtaataaagacaaaaatcataaaacagccggaggaataaaaaagacacattatataaatagatacataagagtgacagcacatttctttttttgtttgtttttcttttgtttgtttgtttttggtttttgtgttttttttgagacagagtctcactctgtcgcccaagctggagtgcagtggtgcgatcttggctcactgcaacctccgcctcccagattcaagtgattctcatgcctcagcctcctgagtagctgagattacaggtgtccaccatcatacttggctaatttttgtatttttagtagagactggttctcactatcttggccagctggtgatggccatcctgacttcaagtgatccttcccctcagcctcccaaagtgctgggactacaggcatgaaccaccgtgcccggccaagaatgacaacacatttcttgttgagaataatacaagtaagaagataaagagcaacatatttaaagtatggaaagaaaaaaataatctgtctatctgaaattctttacccggagaaagtctgtctaaaacaaagataaaggaaagacttttttagaaatacaaacgctgaaagaatttaaaatcagtatatctcacaagaaatgttagagttctaatactgtatgtgaagcagtagaaataccacttaaagatagactgataaattaaaggcacaaaccctaaagacaccattaaaataaagcaacaaagagttatagctaatgaaccaacaaaggagatagagtcataataattaatgaaaaacgggagggaaaaaagagcaaaaggaatcaaagtacacatagggagaatagaaaacaaatagcaagatggtagatctaaatctagttacaccaatgatcacattaaatggtctaaacactggaaaacaaatagcaagatggtagatctaaatctagttacatcaatgatcacattaaatggtctaaacactgatgaaaagacagagattgttaggttagataacacttctatatcctgcctacaagaaacccaatttaaacataaaaacacaaataatttaaaagtaaagggatggaaaaaattataacgtgctaacaataacaaaaataaaatttaaaagactgcattaatatgagacagagtagatttcagagcaaaaaatattaccatgaataaaaagcataatttcataatgacaaaagtgtcaatttttcaacaggacataacaatcctaaatatttatataagcaataacagaccttcaaaatatttaaaccaagagtgaaaagaactacaacgattcttttaaatgtaattatagttggagatttcaacatctatctgtcaatagttcacagaacaagtagaaagaaaaccagcacagataaagaacacttagacattatcaattcacttggcctagtacctaggaaaggcccccttattagtgcatgtatcctcacaacctggacaagttgaacagtccagcagtggctaccataagctgctcaaactgataaaatcagagttctcacatatttaaaaatgttgactgaaagtgaacatagtctgaagctaaaaggtaaaattcaagggtggtcagcatccatcagaccatccacatgggccagagtattggaaggactgttacacaaagagaaaaagatataaggagagataagagactaatgtgatgctctgtggtactctagttgctgattctctttctgatagctactttcatttaccttctttttgtgtcttagttttacaaatcttgattgactttgtgaaatagcccagaatctacctttgcttcaggatgccagatcaacacagaaaggcatacataatgtaaacataaagtcaagatgtaacagtctgctttctgagatcctgcctttttaatctgtcattaaccttgttcgtttatcctttttctgtaggaaaaactatagaccagcaggagagtattcttactctaacaattcaccctatctggaatccatttctcagtttttttcacttcctccttctggcccagctcaagttctgtctcttcaaacaagacttccaagaccaaatcaaattctcagggatcattttcttctctcaagtcctgtaagccactattgtgaaacttagccaattttctctttctgttatacattatcttatatgtatgtcttgtctcctaattcaaacagcaaattctttaaagggattatgctttgtcttgaatatccaggaacatgtcgcaccccaaactcagtggggtggggggaggggggagggatagcgttaggagatatacctaatgttaaatgacgagttaatgggtgcagcacaccagcatggcacatatacatatgtaactaacctgcacattgtgcacatgtatcctaaaacttaaagtataataaaaaaagaaaaagaaaagaaataaaaggcattacagaaatcgtcaggggcttgtggattgatttacggacctttgcatttataattttatttttctaagagaatgtattatgatttccaactggtttataaatgagtatcagttgtttttatatttatgtttttctgtatctatatgtaaatatattcatacacaagaagcttggctctatagttgtatttataacaagatattataactaagcatactatataattaactaaaagtttacagctaatagcaaaaattacatcatccttcttggaactttgtatctgctaactgtggattcaaaggtaaagagtaccttgctttccttttcttttttcttaattaacactgcttgctcccttttcgttcccaggtgcaaaaaagacaattaatgaatgctattaataaatgagaaacaatattaaatattaatttttaccacttttttgtcctcaatagtgtagataaattttccctaaggcattccttttagtgacctcattgtaaattgattctaacacatttaaaacttaaagtcatggtaaatattctcagttgtagagcaacctatgtcgagttaacctcaaccagaatggaaatgacagctgtaaaatatctaagatgcagtagttttctattcaaaatatgaaaatgagtctaatcatcttacagctgttttgcttttgatacgtaacaggtgatgggtgtaggttcggagccttggctttgattttaaacagattttgggtcaaatctcatctttattatttactataaccatccatgaccctgtgcaagcgacactctctctccaagcctcaatcttactccacattacatccacatgaaaaatgtgggtgatgttagcacccaaatcacagacttgtggtgaagtttaaatatgttacaatatgtgaagtgctcactacaaggtaattgctcaataaaatttggattaaaatattttcaggaaaaagttagttttgttttattcaggttgatgaggagatttggtacagagtgtctttgtatagaatataacagcttcatcagataatatattcttaaaataatctatttttctttaaaatatgtttttttcttttttttgtagttttttttattatactttaagttttagggtacatgtgcacaacgtgcaggtttgttacatatgtatacatgtgccacgttggtgtgctgcacccattaactcgtcatttacattagatatatctcctaatgctatccctcccccctccccccaccccacaacaggcccacgtgtgtgatgttccccttcctgtgtccaagaattctcattattcaattcccacctatgagtgagaacatgcggtgtttggttttttgtccttgagatagtaaagctttatttttctgcttaaaagtggtacagttttatgttatccaactttatgactatttatgtactatgttaacctcactggaattaaaataaataaaaaaataaataaatagcaaatgtaatcactacataattattttaattccatgataccaaactgttttggtcaactttgttttttaactgaattaactattaataaatattttggcattatgtagacatacactcaaaacacctccttcagcattgcaacttgacattttaaaaacaattattttctattttattgtacaagccagaatttctgggaaaacaggtgcccccttttccaaaacaatggcgttgcaatgtttccattagtctaaagcgtggatatcactttatccccactggtaaagtgattcagaagctggatatcataaaaggaggtggtacctttaaataactagcagaaaagcctggtagcaagagaatattatgctattactgtaaatttcactgacagtaaagggctgcgggggttatggaaaaggagaggagctacacaataaccactggccagagtaattagctggtgtaatgaagagagaggaaaagtgtgttggacactgaaggcctgaactgtcagcattattgttctccaaggctttggaagaacaatgctctgctgagccttcagtaatcgctatacatgactactcatgaacagagtaattaagaaatgtcagtgcttctctggaaaaaaaattaacactcataccacacagagtgcttccctggaagaaccacatttttttttttgttcttctaaaatactaacagagcagtatttatacttcatgcagttcaaaggaatgagctatgaataactaaacaaacccagcaatgtgattgttccttcccccagcatgtacacttccaatactcaacggaatggctggacatatctgagctacacagaaactatcctgagcactgtgttcaaattgtcccatgttccccagccttcaagctgttctatgtgatatcacccaaatttatttttgcctggtacttgccgtatcttacttatgtatacattcatgtattcctcatttcattagatctttaagcttcatgaggatggagatattgtcctgctcatcactgtattgagagtgcctaaaagaatatctggcagtggaaaatgctgaataaagatttcttaaaataattcaagattaacattttatttaagaaaagtataatgtgaagcctctcatatgccttagaaggctagtttctcaattaaaagcagccaattttattttaaaataagtgtcagagtaagcaaaaaactgaaatataaaatattacaaactttttaaaagatacactgaatttatggtataaaacttacctgaaaaggaaagtagtctagataatgattcaaaatttctacaaaaagagtctgtcctcatcttgcaaataataaattggcaatattttttcctgtagaagtaaactattaaggaaatgaaatctcagacattgcagagtaaaaaggtgagagcaccaatcctgtactaatgaggctaataaaatcaaacactcttctcccattccattccaacttatttactctgctctttgaattaagcagttgtgtctatatggctaattgtagctttgattctccaatgtgctctctaatcagattgcattagaggtaaatatttatctccccaaagttgtagaatttatggctagaaagaaacaaaagctaatcttttgcattttccaggtagaacatattttgattcaggaaggaaataagttgaattccaagaatcaacaagatattttgtcaatttgagagagctttagctgaaaacagaattgaaaatgatttctgaataggattcttttcaccacagctgactgcttattgtttcattaattctataataagaataaatggataataaaaatgttttctaactgcaacagttcattatgatgactataaagcagtataatgcagtggaaatgagctgaattttgggagccagaatgtctgggtttgaatcctgtctctgttacttaataggcatatgactttaggcggcttcctcaattgcaaatttgggataacaataataccaatctcaaagtgttgtcgagagaatcatatgaattaaacgtaaaaaactttgaacaatactaaatgctggctattatagttattataaaaatatggttgttggttgccttgtattaatagctatgttcattttctgtttagtagccattgtcaagcaatttatcattatataatgtcaacaatttaattatttaagtaaaattatacaaattatataaaatcctcattactcataaaattaaaggtaaaagtgaatatgaaggtattgatttaatatttcaactgcattcatatgtatattgtacaacatgacaaatagcatatgaaaggaagctatgcagtactaatgtattcattcattcattcattcatttattcagctaatatattttgaggaccaactctccatcacatcaaggagatataaatagtgatcaagatatataaagtcttgacttttaaaagtttatagtaaatgaaaaaatcatgcaataagtgttactgagaaaatagaagctatctggctactatagcttgaatgtgtctcctctaaaatttaggtgtggccagtgtgattgtattaaggtgtgtggaggctttaagaggtgattaggccatgaggggtcctcctatgtgaatgggattaagctcttattaaagaagcttcacatagcatttggctagtttggtcttcattgggtaaagatataaaacatcttttcctaaaatatgcccattcttggaattaatattctcctcacattgcagttgactaatttttactcatctttcagatccattcccagggaaaattcttctgaactatgtctatgtattatacgtctattcattgttaccattagactctctcatgaaactcattatttctttctttatagcatttagcctaaataagttatatattgaatttatgcattttttccttgatagcctttctttcccactagacaagctccatggaagcaggggtggctctttgtttcctgttgaatgccagcagcattcaacgtatttcactagtggtaattcaaggtatttcactagtagtaaaaattcaataaatggatgacttaattaaaagtagaaagataatgagtttatataactcacctattgtaaatcatgagcgacctagagagagactttcagaagctatggagaggtgaagcattgggcccaggctggaggattaacaccaactcaggaaagtgagtaagtctcattgcctatggtttgtgagacgaagaagtatgggagaactaaaaggagttacgaaagtgtgctgtagacaaactgcattttctttcccttattgccctcttacagctttgcatcctaattggcagtacagttctattaaatagagtggggaagaaagagacatctttgatgttgtttgttctcaagaaaagtattacataatcacatatgcaagcatattattgtttgcctcagttgtgtatagatttaagaacatgaaactgtgtgatgtttcaggagttgttaatttaatatgtgctgttggatagatgagactcctcattctgaaatctatattcaccagagaccctgctaggatcctaatgcgatgctgtctatttcaggatatcctgtgggatttgtgaagtctcttaattcatcaggtgataatgtttatacttctaggacacaaaatgttgacataaaagggaagatttatcaaagactgattctgaaaaactgatcttaatggtttggtggaaatttattgtaagggatttttttctttcaagtggtttagcacaaaccaaattttagaaatgtacgaagtctcaaagggcattttatgcaatcattttgtttcatggataaagaaataaggtctagggagatgaagtaacaaaatcagggcagaatcaggataggtatcaatatctcctgcctcaagttgaggattctttaattggacatgacaattcctgggcattacaattgaacattacaaatggacatcacaattcatttcaataaggctaatatttattgaaaatgctcataagtggttaatacatttaataaatatttagggtatcaatttattatgttttagaactccattctaattataaaactacgtacatcattaaatattgattgaacacctactatgataaggaaactatgttggtttggtaattatgttataaataataaattataaagttcttaggaatggtaattaggaagtaaatttaaaacaaaattagagcctttagaaagtaaactgaatcctcaaattattttgactttttaaaataaatcatgaatgagatcaatggaaacgtttgaaatgttaattgtttgcagaaacatcattcttgttttatttccccacatcatttctgcctcatttgggtcatatatccagtaagaacttgataaatatttaatggtaatgataatgttaaagtctggggattcaaagcttgagacagggagaactacagactattttttacaaatacattgttattgttggtacataggatcctccattatgtattccagcatgaacatgaagatgcccatcacacagtggctaattcaggacatactgtatcacagcaaagacgtgcaaactcaccttaagaaaaaaaaaaagaattaagcaagtgagtttgttttaaactgaataggatatatttaccagctaaagagatgtgtcagtcagaaggctagactgccttgggagcctggaacaaaagtagtttcagtgaaaatattggcagtgtgcctctaagcactttcaaggtaagaagaagtcttcactaattaattcagttattctgattttggggggagcattcaggttttggagtaatatatagatggcaaagtttaaatcttggcccttggccctgccacttctagtaaagtcttggatgaagtactgcatttataagtttcattttccttatctgtaagattaagctaataaaacagtttattgtgaggattaaatgaggtaatataataatctacctaccactgaggacttattatgtggctggcactattctaggtattttgcataaatactctcatttaatgccgatgaaaaacctgtgaggtagagtctacaaaagtaggtaaaataatgatgggcaaaataagtttgtacctgctcagcaagaaatagaaaacaataagcacaacaacaattttaaaaaacagactcaaaagtacattatgagacctttgagtcccctctcttaacctccattcacactgtcaaactatatcttgagtcacaacaactgatataagtaatagcatagcaataatcagtaactattgcggtaataataacattagaaataaaatcaagctgttctaatcagatccactgctaactcaacacatcagctggcttctttggttctgatccttgtttcctaaggatgatcaagtcactaagttcgactttccaaataaatttatctccagctagagaaattgctaatcatgcagaaactagcattccaggctgcctgataataggttttataaattaacaattggcactcaggttttatatgtcattaatgatttcaattaatttaagttggcccagagagatggagtcactcttgtgaggctagattatggataatgaatgccaaactattacgtaatttgagagattatcaaccagctttccattgtagttgcttcgaaccatttttttccttcaaatttctacagttacagcatttgaaacttccctctcaattatttataccatacttttcttatttttatacatccaacatctttaaaacaaattcctaatttattttcttttctagatagaaaactaattgagggcaaaaatgcccaatttaatatattgaacagacaaaacaataaagtgccttcctttcactaccctatttcctttcttaacctgtaatgttgcaattaacatctggcctggataaatgtactactcacaggttggggaaaaaagactcattactaaaaatctcttaagaaataatttttatatagcatacaaagcaaaagttatttgggattctgagaaactaagacacaatgaataaccaaacttaaaatacaaaaaacaaaaacaaaaacaaaaaaaaacacctttgcatagcagtttatggttacattatctcattcaatttaagccacataatcatagaaagtatattatagatgatttgaaatatatattttttcttcattacaattaaatcttaagaaacaaggaaacaatcacttttcagagaagttctacttttaaaaagctcaagatgttaactaggttaataaatcaaaagtatttctggcaatattacatgcttccctaactccattgtttttccaaactatggtctccaaatggcatcagtgtcatctcagaatctgataaaaacacaaactgcctggcctcatcctgacctatgatgttctgaaaagccagatttctaaaaataaagaccctaatttatagcatttgctgatttgcatgatgtaaatactcccaacatggtcaattttgggctacccagccttatttccccaacatagcgttgcccaggctggagtgcagcggtgcgatctcggctcactacaacctctgcctcctgggttcaaacaattcttgggcttcagtctctcaagtagctgtgactacaggcaagtgctaacacgcccagctaatttttgtatttttagtagagatagggtttcaccatattgcccaggatggtctcaaactcctgacctcaggtgatccgcctgcctcggcctccgaaagtgctgagattataggcgtgagccaccgcaccccgccggactccctgttttgagtactagaaatgttgctaacaacatcattaaaatgtattagctcagctctgaaacaagtaagagtgaagttctaatgctaaaaaaaatgccacagcagtaaacatgaacaccaaataaaagtttactttttaaactaatttgaaataatacaaaatgcagcattattatttccctttgacttcactctgttttgatagtgcatagccagtctgtaactgagttctaggcagctgcccgtctttcttttcttcttgatatgctttttgaggaatctctacatgataaagaagacttctcagaaataattacctacttgccacctaatgattctctgaaattttgaaagaagcctgtatgattcccttttaaaaggcgtttgttgtgagttttcaatcacttgttagtttagataagcctcaatattttcaagtgacagcttcaaagctgcatgttatttaattggctgctttcagagggcagctgttcatctgccagtcatctcatgtgaaccaggattcactgtgcacctccttgggaattgttttaggaaacgaactgtgtttcctaataggaaatatgccaaaatttatggtaatcttcaaaataggagaaaaacatctcaaagcattgggacatagctggttatatagaatttttaaatatcatctttctttagaaaactgaataatcatattgtctaaattcttgaataaaagaatatcttagtacttgttttgggagatttaggctatgaaatatattagcaaaaatggggaaaaagtagcaaaaaaaagtataacttaaatgtcttcatagaaactacacttattggacaaggagtaagaagagctatgaaatctgttcttagagataaaaaagattgtttaatataacaatacattgaaaattatatgtaaaacagcaaaatatttttagattaagtgtttaagccattgtgcctggaaaaatcatatcaaaataattgttaaagatagactgaatataataaaaatattatttcttataatgactaataaatgagaacataataattcgccttttgtgtagaataactcttctcttatgagagagctgttaataaatttgtataaggatatgtaaaaacaactatttcatttttctcctatctgcaacactgatgctttttcacatactcattattgtgacaacaggttgaattggcaattcaccatctgtctaaatagcattaaccttcttgtaacctcataatatcactgttacgccttgtctgatatttgaatctctctaatataagctaggaacaaaatatattttcctctctactaggcacacatcagtccatgccagaagacaacgcaaataaagtaccacccacagatggacattaacatttaaaatcattttcattaaaatggattaagcagttctaaaaataatcagagaaaatgaactaacttgtaaataatcttagccagaacagattttaattaatatacagtattaataattattattataaatgtatacaattacaaatttatattcacaaacataatatcatttatatcttaaagagaaacctatataacatgctaaaaacgtagggttgtcctcttctatttctatgatcaaaaataatctccatactgataaatatgttgatcccttttaagttctcatctatttgacccatcaacagcactgacatagttgatcattctctccttcttgaaacatttgatttacatttgattcagtccagttttcctcctacctttcagacagctccttctcagtgtcttttgctggttcttccttatctctctatcatcctaatttggacttcctaattttgagtatttgaactttttctcttttttatgtagtccctccctatgtcactatatactgtttctaggttttaagtaccacctaaatgcccatgagtcctaaatgtgtagttcctgttgaaccactcccataaatagacccctatatacagttccctacttgacacttctgtttgagcctctaatatgttatgtgtgcaaatctgtgctcctaataatctctgccaaatcaggctatgcactagttctttctatatgttaatagcaacaccattcttccagttatcaggtcataaccattgatcggtaccatacttgaaaattctctttctctaacatcacataccttcttctcaaatttctcctaaaaaaaaaaaaatccaaatgatgactacttcttaagcacccataatactactaccctgacacaggttaccatatcatctctcacctcaattatttgattactggtatttctgccttagttctaccctcctcccctatagcctaatcttaatacagaagccaaagattttctattaagatggtggccatgattatctttggtgagcctccaatatgccagaaatatttctgcctcagggccttggtttatacttgtttcttttgcctgggttatcctccaaacaatcacgtttctatctcccctactttcttcatgccttttgtcaagtattctcagtgatgccattacggccaggcaatctgatattatatacacacacacatccctgacatttcatactcttttttcctatatgtttatggtttgtctcctacctcaaacataaactccaagaaggaagaatgcatttgtctgctgtgtacccccagtatgtccctagcacctagaatagtcctggtatagtaggcacttaataaatatttattgaatgcatgcatgagcagaattagacttattacttacttacataatataaatgttgttataaaaatggcaaaatctaaattataattaaatatatgttttgaccaatttttggcatgtattatttccataactcaaactttgtattttaataattcttaagaaatacaggtttttaaaccaaaaagatgcaaacacgagttaaaaaaacaaagatgagcatataatagtggcaaagtgtaacattttgtacttgcttttacattctattccttcatatttctaagtactttcaaaagtacagaataaacactatagtcccagtgcctctgacagtttctgacacatggtaggcattcaatatttgttgaattacatatctacttgtactggcaacctataaaaaaaatcactgataggaaaataagacgtgtgaggatgaataagggcatcacttacttcaacagagatgcccagggaagtgaagcacattataaaaaagttttctaagagaacagtaccacacaaaggaaacaggcacatacattgagtttaaggcaagaaaaattgacaggacttgctacaagtgattgaatatgctatagggaataaaaggatgaagaatagtatttttaatgaaaggatgaggctcttatgagacattatttatttcatggatggtccatatatttgaaaaagtaaataaaatataccttgctacccacactgtataaatgtctgggtctgaaaggcagaataatgtaaagttgcttaatttttcacatagcatctatttttgtctaactagaaaacacagacaagaggaaacttcaaaagcctctacgttcaagttgttcagcggcaagatgaaagatgtatgatgaaagaaatataatgtgcaaggttctgccaatagttcatccatgggtcgctgcattgtgtactatcaccaagagacctgcatgtttttaataaagaagatgccagcactccatgtggagcaccacatgaaacccttctcattcccttagtgagagacttctgtgtctctcactgctttttagtattctaagtctacagtggtctctccacaatatggtatgttgacttctttcaacctaggaacttctataactatcagtgttctaatttgtgctaaagtcttcagtatgccctctcgttacatagaatgagtgtcctattctaggtattcaacacccctaaaggatacagaattggaaatattacactagaagagttacttgtttatttctctgtcattaaactaattatttgtttgactttggtacattaaagttttatatatatctatatacaaaacatgaatgtataaatgtaatattaacaaatcttatcagaacaagctgcttataattatttctaaatatcatcactgccaatatattgtactaatttcccattcatcaaaattctaggctgttgttaaatacacattatgttacataaatgctttgctttaggaccattttttcaaacatcataaggagtaacaattgactccatagtaaaaattccaaattcttcatcaaagagcttttctcatattttccaaactcctcagcaggaaactaaaaacggggtcattcctacaataatccttttcattcagtcatattaccattacaattgacaaagaggccatatgcatagggcagtcttgaaggctgagagacagaagctaggaagctgtgtaatgtgaactaaagcactaccaccattagaaatataatcagaaaccattattagtggcacaaaagtaagtaagaatgcacctgctgacaaggtataactgctgatgcttccctcagggacacagatgaggaacagaagggaattgcccaacaatgggttataatgaggctccacgaagacagtagcctcacctgttacattctcctgtgtaactccagcgctagcacagagcctagtgctgagtaagcatgcaatcaatctttgatgagttctggaatgaataagcaaacacactcatcattcctcctcatactcaatattcctcccttttattaagtgctaggttctgggccagttgccttttatacttaaactccctttttatagatgtgctgcccattttagagatgagaaaactgtgactcaggccgggtgccgtggctcacgcttgtaatcccagcactttgggaggctgaggcaggtggatcacgaggtcaggagatcgagaccatcctggacaacatggtgaaaccccatctctactaaaatacaaaaaattagctgggtgtggtggtgtgtgcctgtcgttccagctactcgagaggctgaggcaggggaattgtttgaacccaggagaaggaggttgcagtgagccgagatagcgccactgcactccagcctggcaacagagcgagactctgtctcagaaaaacaaaacaaaacaaagcaaacaaacaaacaaaaaaaagaaaactgtgacttacagatcttaaatactgtacacacatactaagcaacagagctcagatgagttggttattccacagatagaaacaatatatttggactttgagatcaccaaaatgtgtaagtgtaagagggacttcactcataagcatcagaattttaacaatagggtattttgctttgctctttctaggtgaagatacccccaaaaagttctatttctgagactatataaactgttcccaaaccaaggtggtgcagttataaacttggttttgagaaaagtttttttttggcttcaacctcaatatctcatctcaagaaatgtaggaatgtgtgatatttctgaaacgtaggcactgtgactatcctgcatgtagatgacaagagaatactaaagaaatgcataatgatgtaccctactagtgagtgatgacaatcactagcccctctagttgaacaatggcatcttcactacctgaaacaaccaaacatatgaaagtgtgaagtgagactgatggagatgaaatggtctttgaaaatatttaggatttattttctgtatctggtcatggtacagtcgtctgctctgaccctaagttttataatgacacaattataattgtattcatcattttgttctaatttatagccatttaaaagggtataatttaagccacattacttattcaaatatttgacacaatatagccactggactataaatagcaacagacatttttaaaattctcactgctttatagctagaatagcaatttaggagagctctaggtaatagtctgaagcttatttactgaggaagaaaactcctaaaataggtcatttgattgaaaactgacttagttgccacagtcaagataatttatttaaactttcatgtattaataggtttgattctacaaaaatatgaatctaacccattaaaaatgtaatgtaaagtcaatttccattccactcaaatgatcaaactgcttcttcataatcattagtttatcactgaattatggagcccatgctttttaggtcacttttacgaaatgaaaatgaaacatccaaagagtcacagttgttgagaataagaaaagatcttttttcttttaatattctatatgtaagttatagttagcatttccaaactggttttttttgtgggttagtgcttcttccacaattttttgaaagctaaattttgagaatggtgtttgtacatatctcacactgagagcactggtttgccaggtcattctaattattctatttttaaaagagtgactcctttggtataataggtttggcattagtgaaattaaaggttgtgactgaataacagtaatggtcttacatttcaaaaagaaacatttttcttttctcttcaagtttattttctctcattactttagtaagatttgacatacatatgtcattggaaggccattgtttgttcattatgtgcaattccattaagaacattacctagttaatttacaagaggctgactataaaaataaataaaaagataagtatctactaaaaaaggtaaaagggaaggaagcatttatatacctcatttaaaaaggagtttattaaaaagcaaacttccctcacagaagaaagatttataaaataaacagcataagaagggttggttaatgggtacaaaaatatatttagatggaataagatctaatatttactaccacaatagggctaccataactaacaataatttattgtatatttcaaaataactagaggaatgaaattggaatggtcctaacacaaataaatgataaatgtttgagattatggataccccaactacttgatttgatcattacccatattatatgcttgtatcaaaatatcacatgtatcccataaatatgtacaattgttatgtatccataaaaattaaaaaaaacagcataaatcaagacatttgatttgcttgtgtgttttttttagaaaacaataagatattgttgttttataattatctttagtcctgtttctgaatgtatatacatatggatgcttaagtacatatgaacatattgtatttatctaacacaatatcaagacaaaattacaatgcatataacctcaggtcttccaaaaataataatttaacttacttttaattgtgctattacaatttctctaaaatgtattctatagctttcactattaaatacaatatataaaatctgacctaacattttatattgttaattcagggtcacttttatgaacatcagttactctattctgctgttataaagcaatgccttcatgggcttgagcagtgtgaggccacattaaatctcccagagcatttattaacgacttggctatatttgttgttcctccatatacttttcccctacctgaaatgtaaaatgaatcaaactcttcttagtatcgataacagctagatagcttatttgtaaaatttgttttggatccctgcttacagccaaagaaatgagttcaaaatggtggaatattgggatattacagcaagcagattgaataaactttctggacagtgtagtcactttaatgttcttcataaaggcctttggcacttcaaattccacctgtgtatgagatatgcaacgacaatagtttggagagtttgcatgtgctcataacatacttctatggcttctaacaaacaaatttgggaagaagatatcatttaacaatgcaaaggaagcctattcttgacattttatatactcaaattagggtaatgtaacagaaagctaatatattgagtggataacagtttctgaatctgtctcaaaggttattaattatttcatattgattactcttaacttcagattataaacattcaattacctattagcccacctaattaataaaactgtattataaagcaatctgctattttaaggatgcattactattgaacgaagcaaggcctccatgaacatgagtgtgctacagagctcatatctccctctataacttggaaagttgaaagcctacagacttagagagttctactgtgttttctcatattctttatatctagaaaccataattagattcatgaaaatgtataaatgtagagtacaatgtgatgatattgattacagccatctttgatggctcatttaaggatttataatctatggaaaatctctagctttataaatgccttgtgtaaaacttcttggagtttctcaggcatatttctgacatttttcctgaataagaagatcattaggattagagatggatgactaggtgcagctgggatgcacctccttcatgaagaagagtcacagtatcaggtaagccttggacttcaaacagatttattgaaagaagacactgaaacttaatagagaggcaatggaggacaccgtggttgaagagggaggaagcatggctacttgcttggcctcactagttgccaagatcagcccctggagccagactagacctgaggaatggatgaatgaagaaactctgggacaccacattcccactgcaatcctctgagaccctagttacagaagttcccaccaccctcgcagacctttgggcctagagaatacagagagaccgtttaaaccaaagtggaccccaaaaggcttcagtgagctgggcagctgcagcaaaacatgactctgggcacccaccctgcaaaattctgcatcatgccctaagcggctgcagctcctgctgtctgccgagccaggatagaactgagctggccacattcacatgcccaagatgggtcccaccagcactgtttgggaactgaggagcatctgaaccacatgtccccaggcccgccagtttctcccaagactgccagcctggttgttaccgcaatgggagacccacagcataccccacattgatctgcctgagtggtttgttggcagtcttggagcagttcctcctagtccagatcaggaatggtgtgacaagatagttgcaatttctgcttcagggactcacagttcaaaacatctggacccgcatagcgccttgggcacaggtggctcagaattagcctaacgggtcaggcctgcttcttgggctggatgctggaaggagatccacttgctggcaggtatggaagctgggtgagtccagtggccgactgctgggctgaaaacatcaggtcaccactctttccctgagaaggctctgtggcttaggagaggtgcttcctcctctgcctggagggttgtctcagtggactgggaggaaccctcagacccctgtgaaggccagtgcttgcacatgccttagagagcctggttgcaggattgctagattgatcccaccctttcctgagagtcccatgctctgcccataacctggaacatcctggagcttgccctgatcaacaaagacaaagtaaaaatcccactgtcatcactgcaattgcctctcacctgcaactgccacctactggctgggaggtcaaactgcagggccatttgcaacttctgctaacatcattgtacagtgctcagctggttcttacctgcaagtgccacctactagccagtaggataaattgcactacccaatatataatttctgcagacagaagtgcacagtactgagaaataagataaggctcccaagatcaccacatctccatcctctgtactagacagtgagccagataatatgcacagcacaccactactaaaacctacaaacaatgagcatttgaaaaaaccactagactaaggctatctataaccaaataattcatacagaaccttggccctctaatagtacatagaagcaaagccaaaagaccctacccaacatgtgcaacagctaaaccctcaaagtggggaagaaaaaaaaaaaactcacccaaatgaaagtaaattcaaaactaagatgtaacagtttctacagatgataagcaaccagcacaggaactctagcaccgtgaagaaacaaaatgttgtgacactcccaaaggaccacactagctctctagcaatggatcctaaccaaaatgaaaacttcaaaaagacagataaagaattcaagatatggattgcaaggaagaccaatgagctccaagagaaagttgaaaaccaacacaaagaattcaagaaacaattcagaagatgaaagtagagataaatatatttttgaaaagccaaagagaacttctggacatgaaaattcactgaaaggattttaaaacacagttgaaagcttcaacaatagatgagacaaagcagaaaaaggaatgtcagaacttgaagactagttttcaaatcaacccagctagacaaaaataaaataatttttaaaaacaagcaaagcatttgagaaatatagcatatgaaaagcaaccaaactgaagacttaaaaacattcttgagggagaagatgaaaaggtaacaagtttggaaaacatattagaaggaataattcagaaagatttccacaatcttgctagagattcagatatccagatacaagagattcacagaacacctggaagatactatataagatgaacattaccaaggtgtatagtcatcagactatccaagctcaatataaaagaaaaaattttaaaggcagctagagagaagtgtcaaatcacctctaaagaaaattccctcagactaacaacaaatttctcagcagaaatcttataagccagaagagactgtggaactattttttaacctctttaaaaagaaaaaagaaaaaaaaaatcagccaagaatctcatatcctgctaaattaagcttcataagtgaagaaatatagactttctcaggcaagcaaacactaagggaattgctatcactagactggcccaacaacttatgttcaaaggaattctaaacacgaaaatgaaagaatgatactcaccatcataaaaaaaaaacatgtaagtagaaatctcagagcctataaagtaataacacacttgagacctcaaggcaactagcaaacaaacaaacaaacaaacaaactatgacaggaacaaaacgtcacatatcaacattaacaaagaatgtaaacagcctaaatgcttcacttaaaagttatagacaggggctgggcatggtggctcacgcctgtaatcccagcactttgggaggcagaggcgggtggatcacgaggtcaggagatcaaaaccatcctggctaacacggtgaaaccccgtctctactaaaaatacaaaaaattagctaggcgtggtagtgggtgcctataatcccagctactcaggaggctgaggcaggagaatggcatgaacctgggaggcagagcttgcagtgagccaagatcgcaccactgcactccagcctgggcgatagagcgagactccatctcaaaaaaaaaaaaaaaaagttatagacaggtaaactggattaaagaaacaagacccaaccatctgcagcttataagagaaccgtctaatggctaggacacctaacagacttaaagtaaaggggtagaaaaagatatatcatgtaagtggaaaacaatagtaagcaggagtagccattcttagactttaaatcaacaacagtaaaataagacaaagggcattatataacaataaagagtgcaatacagtaagatttaagtatcccaaatatagcacccaacactggagcacccagattcataaaacaaatgctactagacccaagaaaaaattgacagtaatccaataataatgggggacttcaacatcccattgataacactggacaggtcatggaggcagaaagttaacaagaaaactctgtacctaaactggactctagaccaaatggacctaatagacatttataaaacactctttccaacaaccacagagtatccttttttttctttcatctgaacatggaacattctttaaaactgatcatatgcttggcaataaggcaagtcttaatgaattcgaaaattgaaaccatatcaagtttctgtatcatggtggaacagaattagaactgaataccaagaataactcaatattacaaaagtacatggaaactaaacaacttatttctgaatgacttttgggtaaacaacaacaataaagcagaaattaaaaaaattgaaacaaatgaaaacagagacacaacatactaaaacttctgagatgtagcaaaagtattgctaagaggaaagtgtataatgtttaaaaaactccatctaaaagacagaaaaatctcaaatataatgtcacacttccaaccccaaagctagcagaataaaagaaacaaaaattagagcagaactaaatgagattgagaccaaaaaaatcaatacaagggatccaaaaaatgaagtttgttttttgaaaggctaaatgaagtcattagactgctagctagtttaacgaagaaaaatattcaaataagcacaaccagaaatgataaaggagacatcacaattgatacctcaactgtaaaatacgatcagagattaactatgaacatgtctatgcacacaaactagaaaatctagatgaaatggatgaatttctggaaacatacaacctcccgagattgaaccaggaaggaaaagaaatcctaaacggacaaacaataagtgatgaaactaaatcagtaataaaaaacatctttcatcaataaaagcccaggaccagatggattcatagctgaattttgtcagacttacaaagaagagctagtacctgtcctactgaaattactctgaaaaatcaaggatgaggaattcctgcctgactcattctacaaaacaaataaaaccctgaaacccatatcaggcaaggatacaagaaaaagagaaaactacaggccaattgctttggctattcaggctatttataaagaacaaagcaggaggcatcacattgcccaacttcaagctatgctataaggctacagtaacaaaaacagcatggtacaggaagaaaaacagatacatagaccagttaaacagaatagagaacccagaaataatcccacatacctacagccatctgatctctgacaaagttgacaaaaataagcaatgaggacaggacttcctattcaataaatgatgctgggcaatcctaagcaaaaagagcaaagctggaggcatcacactacctgacttcaaactatactataaggctacagtaaccaaaacagcatggtagtggtaacaaaacagatatatagaccaatggaacagaatagagacctcataaataacacaacacatctacaaccatctgatctttgacaaacctgacaaaaacaagcaatggagaaaggattccctatttaataaaaggttctgggaaaactggctagccatatgcagaaaactgaaactggaccctttccttacaccttatacacaaattaactcaagatggattaaagacttaaatgtaaaaccctaaatcataaaaaccctagaagaaaacctaggcaataccattcaggacataggcatgggcaaagacttcatgactaaaacacaaaaagcaattgcaacaaaacccaaaattgacaaatgggatctaatcaaactaaagagcttctgcacagcaaaagaaactatcatcagagtgaacagacaacctacagaatgggagaaaatctttgcaatccacccatcagacaaaggtctaatatccagaatctacaaggaacttaaatttacgagaaaaaaacaaccccatcaaaaagtgggcgaaggatatgaacagacatttctcaaaaaaagacattttgcagccaacaaacatatgaaaaaaagatcatcatcactggtcattagagaaatgcaaataaaaactgcaatgagataccatctcacaccagttagaatggtgattattaaaaagtcaggaaacaacagatgccggagaggatttggagaaataggaatgcttttacactactggtgggagtgcaaattagttcaaccactgtggaagacagtgtggcgattcatcaaagatctagaaccagaaataccatttgacccagcaatcccattactgggtatatacccaaaggatgataaatcattctactataaagtcacatgcacacatatgtgtattctactataaggtcacatgcatacatatgtgtattactatttacaattgcaaagacttggagccaacccaaacgcccatcagtgatagactggataaagaaaatgtggcacatggcacctgtagtcccagctactcaggaggctgaggcaggagaatggagtgaacccaggaggcggagcttgcagtgagctgagatcgtgccactgcactccagcctgggtgacagagcgagactgtctcaaaaaacaaacaaacaaaaaaacaaaacaaaaaaaagaaaatgtgtcacatatacagcatggaatactatgcagccataaaaagaatgggttcatgtcctttgcagggacatggatgaagctggaagccatcactctcagcaaactatcacaggaacagaaaaccaaacaccgcatgttctcactcataagtgggagttgaacaatgagaagacatggacacagggaggggggagtatcacgcaccagagcctgtcggggagtgggggacaaggggagggagaggattaggacaaatactaattcttgggaggcttaaaacctagatgatgggttgataggtgcagcaaaccaacatgacacatgtatacttacataacaaacctgcacattctgtacatgtatcccagaacttaaagcaaaataaataaataaacaaataaaactgggataactggctagccatattcagaaaaatgaaactggacccctatctttctaaatatacaaaacgtaactcaagatggattaaaaatttaaatgtaagacctcaaactaaagaaatcctagcaaaaaaatctaggaaataccattctggatatcagccttggcaaagaatttaaaaccaagtccccaaaagtaattacaacaaaaacaaaaaatggtaagtgggaccacaattaaactagagaccttctgcacagcaaaagaaactatcaatagagtaaacagtctacacaatgggagagaatattaaaaaattatgcctccaacaaaggagtaatatccagaaactataatgaactcaaacaactcaacaagaaaaataaccaaacccattaaaaagtgggcagaggacagaaacagactttgcttgaaagaagacatacaagcagccagcaaacacatgaaaaaatgaccaacatcactaatcattgtagaaacacaaattaaaaccgcagtgaaatatcatcttacatcagtctgaatggctattcataaaagtcaaaaaacaacagatgctattgaggctgaagagaaaagggaacacttttacactgttagtgggaatttaaattcataaaacctctatggaaaacagcacagaggtttctcaaataactaaaaatagaactaccattcaatctactactgggtatctacccaaaggaaaagaaagcattatacaaaaaagatacctgcacttatatgtttactgcaatactattcacaatagcaaagtcatggaattaaacctaagttgaccatcaatgggtggttggataaagaaaataagtaccacatgttctcacttataagtggcagctaaacaatgggtactcatgcacataaagatggaaataataaacacggggcactctaaaagaggagagggtgggaggagggtatggattttaaaaaattacttactgggtacaaagttcactatttagtgcgatggttaaactagaagcccaaacctcaccattacgtgatatatccatgtcacaaacctgcatgtgtgtcccctgaatctaaatttcttttaaaacagaagacagcatagtgccatgtgccattgactctttagatgattcctactaaaatgttgcactaaaatgaaccctgttctatatttacctttttttgaagttatcattcaaaatactcagaattcatggatcttttcagatgtgattatcttgaaattagaaaatgttttcaattatatatctctctctgaaaagctgtatgattattaaaagtcattagttttctactcatttcatcattttagtattatgatattgcttcaatgactgtgcattttattcagaagcttgccattttttttctcagaaatttctgagatcagagatgctagcaatctcttctctttgaaagaatatgacaatctcatttatttttccttttgtcctgacgtagctttagacattgctagagtatatttatatcttgaaacaatattcaacaattttgaaaatttaagatcacagtataaaatagacaagatccatggtttaaacctaatataccaagagattatgaaaaaaatgaaaagcaccaagggattatgaaaaaacaacaaccaaaaaaacagagaggtaagaatgcttattggagtagttacaagcttaataagctccaagttaattatcaaatcaatgtattagtatattaaactgcctacttaaggccagacagaaatggaatgcactgtaatttaaatgtgacattaaaaattctcttaagtttttagcatatatatagatatatatcccttcttatatattcaatattatctagcattgtatttttcaattataggaccttgaaaaatatgttaagctaattataggtaatgtgatttgacagcaatgtcaaaatttttagttattatgattgtgttacatagcatgattatatacatgttcttgaataaatacagacagatatattacacaaaagcaacactgatattctaagaagtaacacaaaaatgaaaatgaaccatgagtattactgaaagagaataatttaatggaaaatttctgtgatgttaccctgagaaagcaaaacttgagccatatcaaccctaataagaaatgacaaaccttgaaaagctatctataaattttctttaaagcagtatgcttttcagataagcaaaattgttgtacattgttaccagcttctataaatgccagttcaatttcagaatccattgtttaattgtgatcatatcaaaaaagaatcctttctagagagaaaaagcattaaaaaaagagaaaagattatgttaataaaggaaatgtatcttgtaaccacggtaacattgaaactaaaatattcagaaatgtctttttcccctacgccattgttttgtgaggagatgattagttatcagctcttggatccataatcctttaaaatggtgtcatttgaaaagcagaacacaagacttacatggaacaataaggtctaaattcccatgcttctgaaaataaatcatggagacattgtataccagagggtactcataactattgggtggacaggaagaagattcacacagcattggtttaattttaaaattattgtttaaagacattatttttatgataaaccatattgtggacttgaaattcaaaatttgcagacatccttgggaaaaactggcaacattcaatttggaactttcactgactcttgtgaactgcaagttgaagaacgaaagtgcgctcatttatcttctattttagggcagaagtttgagaaactctgagtatgaactgaatatcacctgttccacttgtaagacatagacatgcggtttttccttccaccattaatgtcatcctatatcttattgcaccattctgggagaccttttgtaattaaaataaatatcaaagtttgggtcctctcaacagagcactgatttcagagcagacaggttctcttggtttattattccaaagaacaaaaaccaaaatctcaaaaaaaaaagcatttttatatagaaagaaacttcctaaaaatattcagacatttatattagaaatcactattgcctctgacaagtgaacaaacacaatgaaattaaaaaaaaaactttttggaactatctttgaacatacacaaatttcccccttctaatcaattaaaaaatgccattttcttaatagtaggcaaaacacgtttgcttttcattttcatttctatgtctttaaatttttacaaaacagttaaactcaaagtacaattctttaaaagggcatattgttcttggtaagaacaatcccagcaggtctcccactgccatgtttggagatttgcataataacacaactaagtacctgacccatctctgcatgcagaaattaataacaaagatctgtctcccttctaggtgtccattgccatagttacctcacaagttctgagaatatgcttaaataaaagatgtcgggtagaaattaatcattgactggaaaacaagttttcatgatgaggtcaggcttttgtttctgggtcagactgaaacattagacagtattctgatttgagcagagctgattgcctatggttggagatctacctcttagggtcttacacaaaacactggtctgcttaagtgtacaaagatgattgctttatgtatttgttccctcaagccctgtttaaaaaaaaaagaaaaaaggaaaaagagaactgtcaaccatgctgtttgcaatggtaaggcgtgacgacaagttttacaagtttttagtgagagtgcaatggaaataacaaatcaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaacaaaaaaaaaacactgatcctagaagagtatgtcaatggtcaactatgccttttttcacgggaagtatttgtgttgtgatcctagaccttttgtttaagaattctttcccctctctctatgaaatccctaattatttagccgaggcttgtccctctgattcaattctattaaatttacctgtggagaacttggccctgcaaggtgtaatagcattaagcttggggatagggaagagaatgagcaaatactattcatcacaacattccttttcaaaccccaggaaaagaaacttggacagctcctccagctgctagagtaataggtctttggcaggcgcccccaacccctgtctacgctttgttaacccctaacaggaagaagaaatacaatacaggctcagggctccagactactaaaacaagtgatgaggataatagctaaggtttctttatatttttgggggggattaaaaaattgattaaaaaattgtacagttattgtacacagtaactgtacaaatgtatggggtacatgtgctattttgatgtaatgatcagggatatccatcgtttcaaacaattattattcatttgtgttgggaaccttctaaagcttctcttctagctattttgaaatatacaataaattattgtcaactatagttgtcctactgtgctagggaacactaggacttattctttctatctaactgtatttttgtactcattagcaaatctctcttcatacccccttaccctctactcttccctttctctggtaactaaccactgttctattctctacctccatgagatcaaatttttttggctcccacatattagagcgaacactaacagctaagttttgtttcgatgttgcttctaaatatgaaacctatctcggtttcttggagttattgaaagtaatgtctcactgcaactgaaagaatcaaagtaaggtcagctgagcaaggtgagcctcctctaattcagccagagcctaaattcatggtgtaatgaaagattagtgttttaggctttttagcatcttccaacttttaatattgagcacataacaagaaaaatgttttgagtatattcagaaaaaaaatgaaagaagttgccattctcaaacagtgactcaatcttcactacttggaggctccgtaaggactaattcattcatgcacttactcagtaaacatttattacacatctcatatgtcctaggctctactataaaagatgaaggtgcaaaaatatatattatttttacctccaatcagctcacagtttatcaactgtaagaaaagacacatacaggttgagaatcccttatctgaaatgcttgggggcagacatgtttcagatttcaggtttcctgggattttgaaatatttgtattatacttaccagttcaacattctaatctggaaatccgaaatctgaaacattccgatgagcattttctttgagtatcacattggtgctcaaaaagtttcaagttttgcagcattttggattttgattttccagattagagatgctcaacctgtactaaaattagtgcaataaaatgtttacaggtgctttcattgaaatatatacaatgtacagtacgaaatgaaaaagggattgattactggctggtgaggagcaggaaaggcttcatatagcaggttagcctcaactgattcttaatacaaattggaaagctgcaaaagtatggaggagtttcaggcaaaaagagcaattcttgacaaagacaacaaacatccgatatttctcaagacctggaaattggatgatttagcagagctgaatctgaagggaaccaagaaaaaggaaaattgtgagggggtcttgcccatcaccctggtgaatttgggctttaatatggagacaatttattgaagggtgtgacacagaagtaatagaaaacccattagaacacactgttggatgaattctggcaagaagatgatggtttaaaggtgataaggaagaaatgctgtaggactttcaaaattcccaaacacagggaagttttaatcagaaatcttattaattccagatttctgacttgcaagtctggatggacaggggtaatgtcagttgagtagactgcatattagaagagagtctaaaagattagaaagagaagttaatgatctcaagttagacacattgaatatgcctcggggatgttagatgtttggaatttggcttgaagatgactaggttgcaaactcactctgtgaagacacccatttctctgctatcgtgcaagggtaatatttaacataatccagtatggcagggcaaagaacaatcagatagatgctgctcagagcacagggatgtggtcctggatgcccctactgtaccacacatttccctttaattcattgattgggaaatgcacagaggaagaagccaggcagctaagtcaagaaagtataagggtatttgcagtctttgaggtagtgactgtttagtaacttatataaaaacatatattatatatatatatatattttttttttttttttttttgaggcggagtcttgctctgtcacccaagctggagtgcagtggcctgatctcgactcactgcaagctctgcctcccaggttcacgccattctcctgcctcagcctcctgagtagctgggactacaggcgcccgccaccacgcctagctaattttttgtatttttttagtagagacggggtttcactgtgtcagccaggatggtctccatctactaacctcgtgatccgcccgcctcggcctcccaaagtgctgggattacaagcgtgagccactgcgcccggccaacattttaatattttcaccaccacacagccatatctgtaggtaacacattaatttttagccttgcttatggaatctcttttgtgggtttgttaaaactttatttcttcccttttttttcttttttttttcttttttggacggagtctcactctgttgcccaggctggagtgcagtggtacaatcttggctcagtgcaacctctgcctcctgggttcaagcgattcttgtacctcagcctccagagtagcttggattataggcgtgcgccaccatgactgtctaatttttataattttagtagagacgggaatctcaccattttgcccaggctggtcttgaactcctggcctcaagtgatctgctggactcagcctcccagagttctgggattacaaacatgaaccactgcgcccaacctgttatgactttatttcatccttaactacttagtaaaacttactaagaggaattgaaactaaataagggtgaaaggagtctttctcacgctgcagtcagagtgtatataaggattattgcatctctaagggacagatttcacggtagaagcaagaagtagtagctctgaagcaaatagaataggagaacccttgagtaacagtgatgtgaccaactctgatcattgattgttttctactgaggctaatagtaatccttctcaggcacagggatagagaatggatttgctccatcaatgtagccaattctttcccaccatcaggttctgaatctcaccaattttctcactgagcttctaaagaaaaacattttagagtgatgctcctacagtggaaaaagctattcacttaggagtaggtaaacagcaaattacaatttctccacttgccccatatacacttttgttgatattttccaaaacttattgcagggatagcacattagaataaaaagcttatggtactgggaattaaaaaactttggttctagcaccaaatttacactttctaatcataaaaataagactaacataaaaataatatgtttctttaatataaaataagactaaatatccttatctgaaatagtgataatgataccttctcattcaatttttataaagttgctataagtagtatctttgaaatatctgtgaaataagtgacatctttcacttttgcacttctatgaatcaattatgtcatttggctactttggattcctattttcttatctaaaaataagggttatttcttctaaatagtttcctgtatcttttctaaagctaacattttgcagtgttacaaactaaaaaaagaacatttttatgggtgaaagttaatggtgagatagcttttttcctttgcctcttttcccatggtccctgccttcataaaagattaggcacaccttgcctaaatgaagagagctctgtctctgacatttacattatttcctggctaggagaagatgaaatttgtacaaattacaagaaagcgaatcactgtgcttacataaattacataaaaatccaagacatgcattatagagacatttgcaagctgcttgtacttctgaaatccagaaaattaattgccatttccaccaaggtaaataatgacacaaaatagaggaggtagattttatttttgatgtctcctatgttgataattgcagagaattgtgagatgacagcttccttttatagtcaagcctctcaaatcctatcttctcaaaatagttttccatgagatcctcgtcactttgccatcacttcatttctttatttctgcctggtcttattgtacaagtgtaattatttgtcctcactaatcacaccataaatgtatctactcttattatctataattcctcatattcctcatatttatgtaatatgacttttcttattccatagtattaaatatggactaaggacgtgaggtctggaataaaactatgtaacttctaggtgtctcagttttctgtacctataaaatgggggtaaaaattctcccaacttcaccagactgatacaaaaattaaataaaatagtccacagagagccttgtactcaataagagctcagtaagtgttagctattattattctgcaaaggaagtaagaacaattcattaagtttgtcattgaatttgtgtcctcttggaaacacactaggtcaaggaatttagaaaagagtttgtgtaatcccagcactttgggaggccaaggcgggcagatcacaaagtcaggagatcgaggccagcttgaccaatatggtgaaaccctgtctctactaaaaataccaaaattagccaggggtggtggtgcacacctgtaatcctggctactcaggaggctgaggcaggagaattgcttgaacctgggaggcggaggttgcggtgagctgagatcacgccactgccctctagcctgggtgacagagcaagactctgccaaaaaaaaaaagttagtgtgattctatgtaaagggttttgtttagtagatgacttatattaggctgtagacgattttaaactgtatcctgtgtctgagatgattgatgtcataatataaactctgaaacatacaaaatggccataattattgaatgaatattaaaggggtttttttgtcaggcttaaattttgaaaatacaggtagagtgtttagcatcggttcactaaatattgggtaatttacttatttttaaaattaatttacacttgaatttccatcttccctaaaaggttagtcttcactcagccctctctctgtcttcaggggaaggttttgcttccttgccttccaacttccagttgtgaggatatcagtagggatttgggaacaggcaaagacccctgcattttctcacttccctaaactgtctgccctgagtggagctgaaccagtttgagtgagccaagttatctgtcagtggctccgtccaagcatcttggtggtaaatgatgacaaattatgtgaaagaatgctgtataaatttagaaagttttaatacagtgacttaatttttctttattgcataaatatttttgcattatttaaggtaattatagcccattagtttggaaatgtcattgattggctacatcctattaatatagactgtagattggctgtaaatttctcttttctgtttaaagttgtagatcaaattcacatagctgtgtgatggcagacataattaaagccattccctatctcctccactgccatgggtaccaaagactttccatctcgaagcagatggctactgaagccacaacactgctactgcagtgcagatccagacgagttactggataatagcttaaattttctcaaaaagcaaaagtggttcatattccaaatttcagacaaacaggactaaaggatatgtagaaaaatgttgctgaatatgaaaggtacaaattcacccaagcaaaacagttggacatgaattaaaatagggcaaaaaagaaaaaaagaaaaaaaacaggaaagaaaggcaacacaaggcacacatgtatgcatttgtacttgcatttctaattgcatcatggaaagacaaatagaaatccactgtaaatatttttatatgtatcaactattgtctagatcctggtttagctaaactagaaatacaaaaacactgttatcgaaaagagctatcctgaccacttcaccactgaagaaaacttgcttgctccatgcttgcatgtatctctgagttttgtcctaataaaaaggaataaaaatgattttccaaaggcccttatctatcagtgatacctcttccatgtgaggaggggaagcctttaatatactgctattgcaggtcacacctactcttctacttacctagattaatttctaattggatcatgtttagaaagggtgtaataaagatgagaggttagctttagaattttttttgaaaggtatgtaatgtgctttagcaatacatttgttggtaaagtccatcccagttcattcaaaaggaatggaattttggttttgtttcatacggggtgtttgcatttccagattttatcaaaagacaacatttttaacaaatggcataattccagtcaaatttgctttatgtctaggaaaatacattttaataaatatttacagtctttcagtattgtcagactgttacagggagaagacgacatattcaataaagaagagattatgtaaaacatgggttggcaaaatatagtccttaggccaaatctagcccgtggcctgttctgtactgcctgcaaactaagaatggtttttacatttttaaagggatgaagaagaaagaagagaaggggagagggttaagagagagaaagaaactagtgatcgtatatggaccacaaaccctacagtatttattatctggcttgttacataaaaagtttgtcaaaccttggtctagaaaaacagaaagtaataagaggtacaggcatacttctttctaccgtgctttagttgattgtactgcacagacattgcattttttacagattgaaggtttgtggcaaccctgcattgaacaagtttatttttctaatagcatgtactcactccacatctctgtttctcattttggcaactcttgtaatattttaaactttgttataattattatatctattatggttatctgtgatcagtggtctttgttgtcactattttagttgttttggagcatcatgaatcatgcccatataagacaatgaacttaatggataaatgtaggttctaactgctctaccaatcagccattacccaatcttttcccatctgctggggccttcctatcccctgacatacagaaatgttaaaattatgccaattaataaactacaatggcccctaagtgtttaagtaaatggaagagttgcaagtctctcattttaaatcaaaagctagaaatgattaagcatagtgaggaaggcatgttgaaacccaaggtagactgaaagctagtccccttgcaccaaacagatagccaagttgtgaatgcagacaaagagttacttagacaaactaaaagtgctactccagtgaacacaaatgataagaaagcaaaacagccttattgctgttatgaagatcattttagtggtctagatcgatcaaaccagccacagcattcatctagaccaaagcctaatcaatagcaaggccttaattctatgaaggctgacagaagtaaggaagctgcagaagaaaagttggaagctagcagaggttggttcatgaggtataaggaaagaaggcatctccataacataaaagtgcatgtgaagcagcaagtgctgatatagaagaagctgtagcaagttatccagaagatctagctaagataattgatgaaggtggctccactaaacaacacattttcaatggagattaaacagccttatactgaaagaagatgccatctaggatttttatagccagagagaagtcaatgcctggcttcaaagcttcaaaggtcagcctgactctctttttaggggttaatgcatctggtgaccggaaattgaagccaatgctcatttatgattctgaaaatccttgggactgtaagaattatactaaatttacactgcctatgctctataaacgaaacaacaaggcccagatgacagcacatctgttgtcagcatggtttgcgaaatagtttaagcccactgttaagatctactgctcagaaaaaggaagatttcttcccaagtataatggctaattgacaatacatctagtcatccaagagctgtgacaaaaatgtacaagaagaacattgtttttatgcctgctaatacaacatccattatctagcccatagatcgaggagtaatttgactttcaagtcttattatttaagaaatgaatttcaaaagggtataactaccacagataatgattccctgattgatctggacaaagtaaattgaaaatcttctgaaaaggattcaccattttagaggctattaagtacatttgtgattcatgggaggaggtcaaaagagcaacattaacaggactttggaagaaattgattccaactctcatggatgactttgaagggttcaagatttcaatggagaaagtaactgtatataaatgtagtggaaacagcaagataactacaattagagtggagcttaaagatgtgactgaattgctgcaatctcatgttaaaacttcaatggatgagtagttgtttcttatggatgagcaaataaagcagtttcttaagacagaatctactcatggtgaaggcgttgtgaacattattgaaatgacaacaaacgatttagagtattatataaacttagttgatggaggagcagcagggtttgggagaattgactccaattttgaaagaagttctacagtaggtagaatgttatcaaacaactttgctagctagagataaatctttgatgaaaggaagagtcaataaataatggcaaacttcactgtcatcctattttaagaaatttcaccatcagaaagattctgactcactaaaggcttagacgatcattctctttttttagcaataaagtattttttaattaaagcatgtacactgctttttagatataatgctattgcaaatttattagactacagtgtagtataaacataacttttgtactgggaaaccaaaaagttttcatgacttgctttattacagcattcactttattgaagtgatctggagctgaacccataatatcgtggaggtacacctatacttggtaacttaagagtttggtggtaagatgcattagtgatcttactgtagcaaagtgagaaattttggatacattttagaaaggcaagaggataggaaataacactggatagaatgaaaggggtagagcaagatggtggaacagaaggccccactgacagtaccccacataggaacaccaaattcaacaactgcctaaaacaaaaaagcaccttcacaagaaccaaaaatcaggtgagcgctcacagtatctggttttaacttcacattgctaaaagaggcactgaagaggaaaaacagccttgaattgccaatgcaacccctcacacatccccccacagcagctgcttagaaatctatgtgcttgggaaagggagagtgcagtgcttttgagatgttgaatttaactcagtgttgccctgtcacagtgtgtccagaattggtgggttcttggtctcgctgacttcaagaatgaagcggtggacccttgcggtgagtgttacagctcttaaggtggcacgtctggagtttgttccttctgatgttcggatgtgttcggagtttcgtccttctggtgggttcgtggtctcctaggctcaggagttaagctgcagaccttcgcagtgagtgttacagctctcaaggctgcgcgtctggagttgttcgttcctcccggtgggctcgtggtcccgccggcttcaggagtgaagctgcagactttcgcagtgagtgttacagctcataaaagcagtgtggacccaatgagtgagcagcagcaagatttattgcaaagagtgaaagaacaaagcttccacagtgtggaaggggacccgagcaggttgccattgctggcttgggcagcctgcttttattctcttatctggccccacccacgtcctgctgattggtagagccgagtggtctgttttgacagggtgctgattggtgtgtttacaatccctgagctagaaacaaaggttctccaagtccctaccagattagctagatacagaatgttgacacaaaggttctccaaggccccaccagaataggtagatacagagtgttgattggtgcactcacaaaccctgagctagacacagggtgctgattggtgtgtttacaaaccttgagctagatacagagtgccgattggtgtatttacgatccctgagctagacataaagtttctctaaggccccaccacagtagctagatacagagtgtcgattggtgcattcacagaccctgagctaaatacagggtgctgattggtgtgtttacaattcctgagctagacataaaggttctccacctctccaccagactcaggagcccagctggcttcacccagtggatccctcacgggggctgcaggtggagctgcctgccagtcccacgccatgcgcccacactcctcagcccttgggtggtcaatgggactgggtgccgtggagcagggggtggtgctcgtcggggaggctcgggccgcacaggagcccatggagtgggtgggaaggtcaggcatggcgggctgcaggtcccgagccctgccccgtgggaaggcagctaaggcccagtgagaaatcaagcgcagcgctggtgggctggcactgctgggggacccagtacaccctccgcagccgctggcccgggtgctacgcccctcattgcccggggccggcagggccgccggctgctccgagtgcggggccgccaagcccacgcccacccggaactccagctggcccgcaagcgccaggcgcagcccagattgccatttgcacctctccctccacacctccctgcaagctgagggagccggctctggccttggccagcccagaaaggggctcccacagtgcagcggtgggctgaagggctcctcaggtgccgccaaagtgggagcccaggcagaggaggcgctgagagcgagcgagggctgtaaggactgccagcacgctgccacctctgaacagcagaaagtaaaactgggctgaagtcagcttatgcctgctcccatagggagcattcagagaagacctagccaaaggagaactcaccatcctagtggccagaagttgcattccagcaagcctcaccactgcaagctgaagtgttctgggttcctaaataaaacttgcaaggaagtctgggccacaaagactgcaagtcctagtgctgagctacgtactgagccagtggacttcgggggcacatgacctactaaaacaccagccagggcagctaaggaagtgcttgaaccacccctcttgcaaccccagacaaaaaagctcatgactccataatagaccacttccttccacttcaggaaaggagagggaaatgtaagaggatttctgtctttcatcttggataccagctcagccacagtaggatagggcagtgttctaagttgtaaggcctctattccaggtcttagcagccaaatgacatttctagacacactctgggccagaagaaaacctgctgtcttgaaaggaaagacctagtcctggtaggatccatcacctgctgactaaagagcccttgggccctgaataaccaagaacgatatgcacatagtatgccatgggccttagatgagactctgagatgtgctggcttcaggcaccaggtcggccacacactggagtagggcaccaaacaggttcttgaagtccccaattttaggccttggttcttggatgacatttctggactttccctgggccaaaagcgagcccattgccccgaagggtgagtctcaggcctggcagcattcaccagagctgaccgaagagctttggggccttaagtgaacatcagcgagagtctggcaatactccccatgggcctgtagtggtggtgaccacagggtgagtctccccttcctgtggaaaggggagggaagagtaggaaggactatgtcttatggtttgaaggccaaccaaaccatagaatagaccaccaggtaagcttctatggtttttcactccagtccctagctgccagatgggggaactggatgcctactgcccatggcctgaggaaactcgacaccctgaagggaagaacataagcctggctggcttgccacctgctgattgtagagtcctagggcctggagcgaacataggtggtaacaaggtaatagtttcagtgggacttgggtgagactcagggctatgctggtctcaggtctgactgagcagagtcccagtgatggtacctacaggggtgcttgtgtcactcatccccagccccaggcagctcaacacagagggagagactccattttcttgggagacagtaagacaaaaaacaagagtctctgcctggcaacccagagaattcccagattttatccacagatctaatccacatcttatccagatcttgtccacaaccaccaaggcagtacctctgcaagtctgaaagaacaagcacattactgcccttggagatcctcctgatgcagatatggcttagattacaacagtcatgtccttgtgaatacctggagaaccttccaagaagaatgagtacaaacaagcccaaactacaaagactaaaatcaatacttaactcttcaatgcccagacagtgatcccaccaaataaactaaatatcccaccaaggaccaatcctggagaaataaagatatctgatatttcagagagagaattcaaaatagctgttttgaggaaactcaaagaaattcaaggcaacacagagaaggaattcagaattctatcagataacttaaacaaagagagtaagttaattaaagagaatcaagcagaaattctgaagttgaaaaatgcaattgacatactgaagaatgcatcagtctcttaatagcagaactaatcaagcagaaaaaagaattagtgagcttgaagacacactttttgaaaatatggtcagaggagacaaaaggaaaaagaataaaaaacaataaagcatgcctacaagatctagaaaatagcctcagaagtgcaaatctaagagttattggccttaatgaggagacagagaaaaaattatgggtagaaagtttatttaaacaaataataagagaacttcccacacctagagaaaaatatcaatatccaagtacaagaaggttacagaacactaaccagatttaacccaaagaagactacctcaaggcatttgataatcaaactcctaatggttaaggataaagaaataattctaaaagcaagagaaaagaaacaaacaacaaacaatggagcacccacatgtatggcaataaaattttaagtggaaaccttacaggccaggagggagtggcatgacatatttaatgtgctggaaaaaaaccccaacttttagcctagaatagtatatctggacaaaatatccttaaagcatgaaggagaaatagaaattttgccagacaaacaaaagctgaaaagtgttatcaacaccagacctgtcctacaagaaatggtaaagggaatacttcaactgggaagaaaagcatattaatgaacaataagacatcatctgaaggtacaaaactaactagtgatggtaagtacagagaataatacaaaatagtataacactgtaactctgttgtgtgaaccactcttattttaagtagaaggactaaaagataaagcaatcaaaaataataactacaacaactcttcaagacataggcagtataataagatataaatagaaataacaaaatgttaaaaagcagagggaggaagttaaagtgtagagtttttattagttttctttttgtttgtttgtttatgcaagcagtgttcagctgttatcagctaaaaataatggatgataacaggttatctgtaaacttcatggtaacctcaaattttaaaaaaatgcaatggatacacaaaaaataaaaagcaagaaactaagtcctctaatcagagaaagtcacgttcactaaaagaaagacaggaaagaaggaaagaagaaaaagaagaccacaaaacaaccagaaaacaaataataaaatagcaggagtaagtccttacggacaataacattgaatataaaaggactaaactctccaatcaaaagacagagtggctgcatgatgaaaaacaggaaccaatgatctcttgcctgcaagaaacactcttcacctataaagacacacacagactgaaaataaagtgatggaaaaagatattccatgccaatggaaacaaaaaaagagcaagagttgctatatttatatcagacaaaatagatttcaagacaaaaactataagagaagacaaagcaggtcattatataatgataaaggggtcaattcagcaagagaatataacaatcataaatatatatgtactcaacattggagcatccggatatataaagcaaatattattagagctaaataaagagactccaataatacaataataattggagatttcaacacccccactttcagcattggacagatcttccagacagaaaatcaacaaagaaatattggagtgaatctgctctatacaccaaatggacctaatagatatttacaaaacatttaatccaatggttgcagaatacaaattcctttcctcagcatacaaattattcctaaggatagatcatatgttatggcacaaaacaagtcttaaaatactcaaaaattgaaataatatcaagcatcttctttgaccataatggaataaaactagacatgaataatgagagaaatttttgaaattatacaaacacatggaaattaaccaatatgctactgaatgaccagtgggtcgatgaagacattttttaaaaattgaaaagtttcttgaaaaaaatgataatgggagaacaacataccaaaacctatggaatgcaatgaaagcagtactaagaagaaattttacagctataagtccctacataaaaaagaggcaaaacttcaagaaaataacctaatgatgcattttaaagaaatagaaaagcaagagcaaaccaaacccaaaattagtagatgaaagaaaataaaaaatctgagtagagataaatgaaattgaaacaagaaaacaaaagatcaacagaacaaaaagttgggtttttttgaaacaataaacaaaattgaaaaaccattagccagactaactaataaaaaagagaggagacccaaattaaaaaaaaaaaattagagatgaaaaaggggacattacaacttgtactactgacattcaagagatcactagtggctactaggagtaacaatatgccaaaaaattggaaaacctaggagaaatgaataaattcctagacacatacaacctaccgagattgaaccatgaagaaatccaaaacctgaacaaacaagtaataagtaatgagatcgatcataataaaaagacttctagcaaagaaaagcccaggatctgacggcttcactgctgaactctaccaaatatttaaagaactaataccaatcctattcaaactattccaaaaactgcaggaggagggaatagtttcaaattcattctatgaggctagtattacactgatgccaaaagcagacagacacatcgaaaaagaaagctacaggccaatatcgctgatgaacactgatgcaaaaatttttaacaaaataccatcaagccaaattcaacaacatattggaaagataattcatcataaccaagtgggatgtatcttaaggacgcaagaatggttcaacatatgcaaatcaactaatgtgatacatcatatcaacagaataaaggaccaaaattatataatcatttcaattgaagctaaaaaagtgtttgataaaattcaaaatcctttcacgaataccctgaaaaactaagtgtagaaggaacacacatcaacattataaaaggcatatatgacagagctacagctagcatcatactgaagggagaaaaactgaaagcctttttctctaagatttgaaacgtgacaaagatgcccaccctcaccattgttattcaggatactggataaaagtggatatctgaatagaggaatcagacaggaaaaataaataaaaagctccaaattggaaaggaagacgtcaagttattcttatttgcagatacaatctcatacctagaaaaacctaaagactccaccaaaataaaactattggaacgaataaacacgttcagtaaagttgcaggatacaaaatcaagatatagaaatcattagcatttctatatgccatcagcaaacaatctgaagaagaaattaagaaagtaatcacatttacaatagctacaaatgaaataaaataccttgggattaaccaaagaagtgaacaatctctataatgaaaactataaaacactgatggaagaaattgaagaggacaccaaaattgaaaagatactccatgttcatgaaccagatattcaatattgttaaaatgtctagactacaatacctaaagcaacctacagattcaatgcaatccttatcaaaataccaacgatatttttcacagaaatggaagaaacaatcttaaaatttatatggaaccataaaagacccagaatagccatagctaacctaagcaaaaacaacaaaactgaaggaatcacattacctgacttcaacttacactaccaaggccaggcagagtcgttcacacctgtaatcccagcacttgggggctgaggtgggaggattgcttgagtccaggagtttgagaccagcttaggcaacatagtgaaaccctatttctacaaaaaatagaaaaaaattggccaggcctggtggtgtgtgcttgtagttccagatactcaggaggctgaagtgggagaacgcttgtgcctagcaagtcaaggctgcagtgagccacgatcatgccactgtactcagcctgagaaaacagagtgagaccatgtcttcaaaaaagaaaacaaaaacaaattatattacagagctctagtaaccaaaacagcatggtactcacataaaaacaaacatgtagaccagtggaacaaattagagaacccagaaataaatccacacatctatagtaaactcatttttgacaaaggtaccaagaacatactttgggaaaacgacagtcccttttataaatggttctgggatagctagatatccatatctacaagaattaaactagaccctatctcttaccatattaaaaaatcaaattttacagtggattaaatacttaaatcgaagacatcaaagtatgaaactattaaaataaaacattggggacacgttttgagacactggagtgggcagagatttattgagtaatactctgcaagcacaggtaaccagagcaaaaaaggacacatgggatcacatgaagttaaaaagcttttgcacagcaaagggaacaatcaataaagtgaagagacaacccacagaatgggagaaaatatttgcaaactatccatctgacaagggattaataaccagaaggaactcaaacaactctataggaaaaaatctaataatctgttcaaaaaatgggcaatagatctgaacagacatttctcaaaagaagacatgcaaatggtaaacagttacatgaaaaggtgctcaacatcattgatcaacagagaaatgcaaattaaaactacaaggagatatcatctcaccccagttaaaatggtttatatcccaaagacagacaataacaaatgctggcgaggatgtggagaaaagggacctctcatacgctgttggtgggaatgtaaattagtacaaccactatggagaacagtttggaggttcctcaaaaaactaaaaatggggtgccatatgatctagtcatcccactcctagatatatatccccaaaaaggaaatcagtatatcaaagagatacctgcactcctatgtttattgcagcactattcacaatagtcaagatttggaagcaacctaaatgtccatccacagatgaatggataaagaaaatctggtacatattcagccataaaaaatgagatcctgtcatttgcaacaacatggatggaactggaggtcattatgttaagtgaaattaaccaggcacagaaagacatactttgcatgttctcacttattagtgggagctcaaaattaaaacaattgaactcaaggagttagagagtagaagaattgtcaccagagtctgggaagggttgtggggggggaaagtaggtatggtcaatgggtacaaaaaaatagatagaatgaataaaacctaacatttgctagcacaacaagatgcctatcgtcaataataatttaattgtacattttaaagtaactaaaagagtataattagattgtttgtaactcaaagcataaatgcttgatgtgattgataccccatttaccctgacgagattattatgcattgcatacctgtattgaaatatctcatgtaaccataaacatatacacctactatgtacccccaaaaataaatataaaaaattaactaaaaaagagcactgaactttataatttatggttttaatgaaaaggaaaattgaaaaatatatatagcagttatagagaatctgggagaaaaaaggagctatgttaaacattcggtccttagtaccatattatgtcaacaatgatctctacagatagaagatgataaccacaatcaaatggggatctccacagatggaaagtgagacaattttgtgtgccagctgaacaagacgtccggaaatgacaataacaataatgagaagagaaaagatatcaaaagatatccaaactccaaaaggttcaatgactgacattttgagtgtttaatcttgcattttaaaataagaaaccacccacgtaaaacagcacatagcaaaaaagttattatttctctatacttctcaaatatatgctattcttcagctatagtaaacagtttttagcttatataaactttcgtatctttttctatgcagttatttacaaatgtaaatatttaacatttatattatttagcataaaacaaatatatttcttttatttaaaataaaaatatttgacattaacatatattataaataataaagtggttgctattggttttacacaaatgggaatatatcatgtagatatttctataccttccttttttcattttgtatgttacatgattctcaggtcttgcagatagatttttccattcagtaatatgtaggtagacttcattttttaattgttccacaaaattccttaggtgtataccataattagtttaaactatttcttttcttttagacagaatgttttactattttcctgttatgaattatatacagtcttgtgaccatgtcttctgtaattttacaattcctcctgttgtatccctgctcagttgtcactttcaaatacctatttttcatagacagttcactttatcattattcttaagcactatacctaatagagctcgtatgtctttaaagaaatggatattcataatccttacttattttaaagttgaattttggaaatgaaaaactgtttgacaaatattgaataatctgtttgaacacagatttgagtattgttaggcaaaaaaccaggattatccaaatatacaatcttctgcctcagaaaatggtgtgctacttgtcactggaaatatttaaatatggaacagacaacattttttttacagagccatttcagatgagattaaagtactgaataagtggtaaatctagattatttttagggatttcccaaccttcaggtacttcaaaaagaaaaagttggggctatttgcagtgcatgactatttgtattttcttttaaattcattcatatatgacaaaataacagtgagctgaaaaacatggtcagtaatctttggtcaaacatgctataaaaacaaaacttaaaaaaatacagaaaatctagtcaaacatcttcatgctcatgcttactgaagagtagaaagttctcagaagactgactttcctatgatttcttataaaccagaattagatatcaatagtgctcccataaccattgctccaacgtaactaattatatatcattgctagaaatgcagctgtgggattatttggtgtgattttttcttatctgcccttagcaaataatcctttcagttttaaatccttctcagagtaggaatccgttgctatcagttgctactgtgtaagtaattatttcttcttaattgttgtgaagtaagtgtactggttgggtgacgcaggctaagcctcccacctttcttcatagcattgagacaggatttacaggtatacttatgacttgattttattcaaagggataacagataagtgggtgttctgcgtgctagtaaacaacatggtcaactcgggagaaaacctattttatctctcttatttttctctaaaaggtattgttaaactaggaacagtgctctcttcaagaatctcctttggatattaactctgcaaattgtccacacaaaattacataaaccctacatcctcttatagggcatcattacattttggcctctgatgataatcatcatgatttgaaatggccagtggcaactacatctttgacatttgttacactatctttagtggtctttttgccatagccataagggatgctgctttgtaacagcagtaatattaattgctaccattatcttgcttctcatgttaaattttcggttaaatcattgctataagtctaaatgagcagtcagggataaaaaggacaaaggagtaggaggaaaatacatgactagactgagccctgctgcatactgagaggtaatttacacaaataggcagacgaaaacagatgggaagagggagagagcgagagcgttgactaatgacacctgactgccaaatgaccctgtgggtttgaacgctggcaggacacctaaaactgtgccagcagccagttggaactgcccagttctcactcacatttcatttaacaggctaaccttggtctttctattgttaccatcaccagggaaatttatactatgtctaattatggtccagaaaatatacattctaactggtttttcttctttgagaagctatgtgctcctgaactgctcaggagtttattgttacagtcacctttgtttccaacggggaaaatttgatgtatttgttcttttaagagcttcttttgtaaaattatagtatgtggcaccttttgtggcttaataaaagatgtggagaaaaaatgaaatttattctaagaacataactatattgttaaatactttgctgttggtaaaatatgtttgatcctgataggtaaggcgttcctggaactatatctaatggactcctacctgtctcttattctcattctcacttttaacttttaatctcttttcaactaccaacattaatgtttacggatgtatattaaaatatactctgggcttggaatcaagagtcttaggtaccagcattaggtatattaccaagtagctaactgaactaaaaacaataatttggcattcctgtgcttcagtctttccatctccgaaatgggaataatgtattctctctagtgctgctgggaaaaacataatgagaaaaaaaaagagagagagagagtgtatgtgtgtgtgtgtgtgtgtgtgtgtccatgcacatgtgttgtgtatagaaagtgtaaaatctggtctatggccataccaccccgaatgcacccgatctcgtctgatctcggaaactaagcagggtcaggcctggttagtacttggatgggagaagtgtaaaatctggattactaaaatcatatgtgtctgtctagagtttatttacagtaaaagttcagaagtactagccgattaaaaactaattttaaaaaacattgaaatatttctataatagctaagaagccttagattgttgatagtaattatgatattgtgtgcatttataaacagcatttatggatattaacaggcctacacatgttcttgaagatacatttccctgtttttttaaatttaaagaacaccaagagtatactggaaaagcgaatgggaacacagactgaggtctaggccatatttaatatttctaagctatataatgttaaacaatcatctctattgtcatttgagaagtgattctcttcctgtattctcttcctgccctagccctttggagaagagattaaaatgacaccaaaagaaaatgagttacattcgataattaaaaatttttcagctgaaaggaaattcttaggaatcaatcagtttaacccagaaatgaaattacacaccttccacacctcatttgtttaccatgtctgaatctaaaatgaactgcaagtgtagtgtaatctattttgtcagaacaaataaatagaagtcattgggtatggaaatcaacaaaccctaaacttgaaagatgggtcttcctgactcaaactgtggacattactccggcttcccattggggaagaggcaggtcttcagacattacaaacatgacttgaaaggcaaacacttggaaaagtcccactctccaggccctggagtccagagatgcctgagcgaatgattgggcagtgtgggaaaataggaaatatcaaggacagccagagagaatatcccaaagaaaagggagaaatatatagaaccaaagaagatggagggaggttcttgaaattaagaaagaagcaggggagtgggaaaccaaagagaagcaagtcatcgaagaatgggagtcagaaataaagaaaacaactaaatagctgaggaatatgtcctcacattatgaatttggcctgcatctcactctgaattcttaggactcacaggtttctggatagcctattaactttaactggagctctttggctcacattgcaacataacgtccatcaccctctctctctccaaatcttaaatctttctcccaacctagtaaggtagagcaggaaaaaacaaaacaaaacaaaacaaaaaaaaaccacctctgtaaagacagttttaatattaaagacaaaagcttttctttattccttggttgcagcaatgctaaattctaaagagagaatactgcaaaatattcaaacaaagtaagagtaaaacaatttttttatttttaaaattaccctgaaaattagtgtaaaattaaaattttaaaaaatcaattttcccaatggcttgtatccatccgtgtttactaagagcattctcaaaaacttcaccattttctcaagtatcccaatggtaaagatattatgcatttttccatctactacaatagcttataatgatgtttataaacagaaaaaatgaataaaatatgcaattgctgtaaggtctggctcaatttgtttggaaatttctataattatttgacatttctcaaaatagtaaaaaagctttccttttaaaataaatttgtgaggaaaatatcttaaaatcatttagtttggcaatgagagaggtaggaatataagagaatttggaaagtatttctcagagttataacatgttaagtcattcgttctcttaactcaggcccttcatttttgaaacacttttcttcaaaaggaaagctttaggtttctaggtacttttatgttaccacacttctattcaggaaaacaagagaaggtggttgaagaaactgtatttcccttaagtacattcctgtgatattaagataaatacagcttccaaatataaagtccaactcaacattaaaaatattttagtaagttttaaaacttatgcctgtatcacacaaaatacaggctgaattgagttaaagggcttaataaaaattcatcaaagcagaaaaatcaagattgaagtttatttcttattttatcaatgtgtagttgtaatacaaaagaaacttccgtataaatttctctcattttccttttctccaatcattttcaaaaaccctttaagacattttttaaatgtgaaattttatatgtgcacctgcattagaaaataaccatcatgttcaaaatattgtttcagaaatggaaatgacaataatttgaggccaacagatatcaattaaggcagactcagaaacatccaataataggtgtccatacagggttattgcttattgtttactttaacaaaaataattataggatttgtagtcctttagtattctttgaaacataatcagatcatagaatcttaaatttaaaatgtacactgaagatcatctagtactgccttctccttctacaggtatcccttttgcaatacttcacgcaggagatgatatagtctttacttaaataccttccagtggcagagaaatcattactttatgaagcatcccattctatgttatacacgaatttaatactgtgtgtatgttccttatacaatagatagaaaaatttgccttcccagaaattcctaaaatttctgtatttggcctttttccaccatattttggatgacaattttactctttccagcttacaacccttcaatattttaaagacagttctggaatcctggggctctcttttctaggcataaaattcctcagaaaagaatcatatgattctctgaccattcaccagtctaaattgctttgtctccatttcattatacctgaatttgacacggaattaagtataatgctgtatgtgcaatctgtacagtaagtcccgtaatccttttattctggacattgtacatatgttacagaggttcaagcatgaatttgtattttagaacaccacagaaaggcactcataaaaagattcttaatattgggttcgtagaattgatggtatacatagatgtgacatccagggaatctgtgattccccatgtatgtaatgtgaatatgaatatgtgtatgttgtgggacagaaaacgcataacttccattattttaggagttaatgattccactatagttcagaaccactgtctctttaatatgcattactgtgtaaccagttctccccatcttgattatgtgcactgactaaatgaactaaagtataagaatctgaattttactcatatttatcatagtactaactccagatacatgaaacttgatttttcatctaaaaagttattaattcttcctggctttatctaacctataacattttttgaagccaattgttctgaataacctataacatttttaaagcataacttctatcttcattcatgaaatcaataaaacatttgacttaacagagctaagaataaattttctaaaacactattagagtcacccaagttatattggtatattaatcaaagctatttggtagtattattagtaccaagacagaattgaaaaaccataattgctgtatgattttttgtgcttccatcaattgtaaaaactttgcaaatgccttaataaactaaaacataccacgtctgtagaatttttctgatatatccatctaataaaccaatagatttgatttgttttaaataagcacatctgcgtctttttgtgcaacccttccttacctaagtattcaaaataatgtttgttaactagtgactcatatataatttgtcctcctattctgcatttttaaaataaatacataaatgtcattcacacaccttaaagctttatggctccctttctgccttctataatattcaagaattctggaaagggtagctcatttgaattcatttaaaggattaagtgactccttatagttctttacttgtctgatgtttcaatgccatactatacaagcctcctttaacctttccagtgtgaatgtgatcctccctaagagagaaggcagaaatacaaagggaggtttttttatgttcattgtatcacgtcttaatgttcctcaagcaatggaaccattctttcttatgctgaaaacttcaatttttgaagacatttccattgctcgttgcactttacatagcctccattcattcagcacattaggttatgtaataatgttatttttcaagataatgccaatctttatcatttgtccttcattttatatgatgctttcttgtgaacatcctggatatatccataagtcatgcaaaatgtctaagtcagtctagtaagtcttgatgatattgctgccatcaaatctattgcctgtgtaaacaatgaaaggccattttgctcattatctgttttctaagtactattataaagatacctgcacccattaatattgtccctgacctacatgatttatatatatatatatatacacacacacatatatataatacatatcacatattcactgtatatttattttgagcacctgtgctgcaggaagcattgcactggctagtggaaacacacacatgaataatacacagtggctaccctttaagaatcataatctggtaggggagagcaactcgtacacataattgcaatgcaatcgaataaactaaatagatgttttaagttccatgaaagcatccaggagggggaacgacacctgatggggactgaaaaggagctggataatatttaagaagatgatggcattttaagctgaggtttttttgttttgttttgttttttggtgtttttttgtttttgtttttgttttttgttttgttttgtttttttggagacagagtttcactctgtcatccaggctggagtgcagtggcgtgatctcagctcactgcaacctttgcctccagggttcatgctattcttctgcctcagcctcccgagtataagctgagttttaaatcctgaatagggtcactagagaaatatttttttttccaaaagatattaagcagctctctaatggttattcttttaaatccatacatagtacagtacagtaactcctcaatgtcatcatttgtttttaagcaaaacaacttactgtataacaaaaataattttaccataggctaattgatataaacaagagttaacttcctatggtatacagtatgttgttgtgcttaaagttgcagcagtttctaagaatcttttgatgatgttaagtgagggctgactgtagccataatatatatcctattagtttctagagggaggtgtcaatttgctctctccctctctgtgattatatctaagaaactgtatcaattgccatttccttttcgggggaaaaggtacaatgtggtctttatttttttaaagtctctttgatcaaatacaaaattttccagttaaatatacttgtcttggcgctcaagggatttatgctatttcctcatagagctttgataagctataaaatatttaggctctgtctgcatggctagtcattcacttccaaattcttctttcttttcaaaataaataagaagaaattgagctactttttgtgtctccctagactatctttgaatgtcctactcaggttttaaagtcccagtcctggagatatagctctgttattttaatagtactatttgtttcactatgacctacagttaactttgcttcatttcactggtctttttttatacccagaaagacagtgtgcccatgaatattcctatcagatcatgtagctgctgcccttttctttagcaatggttaaatgactaccaaagctcaaccctggggaaaaagtctttataataggttgtctaaatccttttatttctccataatacaggtgttcttcttcatcaggactttatccaatggaataaatgaggaagcttatagctgttgcaatttccactcatgggtatttttctcttcttttctacactagtttgttccaattgttaaatataacatttcatcagtgctatcattgtgaagttcagcagtttctccctatgcatggggcatcattaaactcttactatgtaacgagctctgtgctaaacttaagttctttatgcatgttaactgtcacgtgagtttcatgttaacactcacatctctaccaggtaaatacttgtattatcaccactcaaaaatgagcatgagttttagaaagactgactggagcaaaaccaaagatgtaataaataattaatggaggtagggtccacattttttttattgttattgatctcattacttagattgttttgattttctgggcttctttttggaatatcactttcatttcacctaagaactccattctatttaataaactaaaacatagaattactttcacctcaagaagggagattggcttacatttatagaacatataattggtgagtgccttagggagaaagacaaacatagcacatggcctgcaggttgctggaatggtttctcagtgccagactgcttgagcatcagaatgaagcagtcctttgtggatattcctcctctaaacaagtgaaggaaaactatctcttagctctgggctcccagttgtgacactatggagtggaagaggaggagaaaggctcttcttggattctgacttcaacccaacttttccatccccctctgctttccccgttagttagtctgactgcatccaaagtaactatgattcacgtgacttgtttaggctcttttctatggctctgtcatactttgtgctaatttgggtgactatgcttctcaatgcacttaaatattaataaaaatagaaaataagttagaagatgttctaaaaatttgtattttaaattttattccattcactttagagaattgagaatattatttgacaggtttgactaagagtggccaggggaataaaatttccacctagttttttgcatttttttaatctcccattatatttaaaatacagatttccctttaaataaacaaggataaattttcaagtgctttagaattattaataaccacaactctcccaggagtgatttctttggagttcctaaaatcacaactcttcaaggacataaagtggagctaatttacccgcttatctgacccaaagtagagatttttagattcgttcaatcccaaaagggaaaagtacaccctaggtagtatttttctgtgaaacaactcttatttagagtggtgaattagtaagttggcagaataaggcgatccatatttttcctgcctgtgttatatgtgttttggggatagaaaaatttagaacttccaatgtagcaatttctgttgacaagaaatttagttactatgttgcaatggggattgttttgctgataaaattcttgattctagtagtccacccctattaagtttataaattgtttatcagcctttttcgcactcaccagtaggaaaagcaaaaaacaaaacaaaaaataaggcactatttctaacggcagcaacatcagtagctttgagaatattatttctgtgggttgcattttcagtctttattataattctcccttgcctacaatctaatttcttttagacccatatagtgccaatttctttaaagcatattgtagtaatattaaaaatctcaatctaaatatcaaattagccctcaaatcataagaaataaatccatgtgggctcacagaattctcccttcaggcactgagattttagttatttgtttctttgtttcttaaaaagaacaaattgttttaatgttgcattttataaaggacttcaaatgtgtaggtgtcccccaaagtacttgacttttgtggcattttttttaaaaaatcataacttggagaatctcagtatttgagtgatgataatcaaaattattttgggctgaaattctgtattttgtatcacagtccataggagaatttcacagccaagtaataaacctggaaaatatgggtttataatggaaatgtcgacagactctagcaggcgctgctgtaatatcttgaatctgatttaaaagaagttttcaataatgtttctccaagccagtcttttgggaaatgcaagttaaaaaaaaaaaagaaaaagaaaaagaaaggttttctactacctctatctcaatgattgatgaaaatgtgagtattttgtggccagatacctcagggcacctgtgaataagatcatggtaacaggagaatatgcatggagagactgctgtcctgtcctgtaaaaagccacccagttaaagtctcactgcacagatacattttgatataatgataatccatagattcacatggattatacttgtatgttctcagatgagggtagtaatggaataaattatcaccccacctagtcgtgttttaatagaaacttttcataggaggacaattacaagagcagctgtgactaagatggtgattctggaattactgtaatttattatattgacatacatagtctgtgctctcccatattctctgcaaaattatggtataaaatttctgcctttggtatatttttatacttcaaatgttattgattatgacaggaaataagagcttttttccaatcatttaattaaggcaaaaaatcaattaggcatgggtaccatcaatctgagtttgctgccttgccccactcgtagagttatacaatagagtgtccctgagagacgtagcctgtggaaacgcttgggtcgagctgaagagactttgggcagaatcatgcctccatgcttaccagctatgcaaccttgaacacacttaggacctctttaagtcccagttttttcaggtaaaatgagaaggaagtaaacaataataacaagagtgagaaaataataatgatagcaaaacgttattgaatgctgatatacatcagatactgtgttaggtactttgcatacatcaactcatttaaacatataatagtatcaatctcataactttgttgtaagaattaagagaagtactctatgtacctcgtttgcatgacttcagtgaaaatgttggctagttttattactacaagattgaacttgtttcaaacacaacacttagattaaaaagacacaagggtcattactttcccttatggtttactgccgtggattgtcattatagatctatatgaaatcaaactataagacaacctgttccacagaagccccaatcacaatcggtcaagggcttgaacatcaggggctagaaggaattcatgaaattttctcaactcctacacaaaggacctttggctgtacactcttgatttagagacttcccatattctagactggccctacattcttccagtctatagtagaaactgagtcatttcaggctgctgttgtgacttgatatgccaaagctttaaagaaatagccatccaaaatatttaaagcaaaatttaaatggctagacgcttaacattttttttaaagtacaaaaagataaagtagaaaagaacacatcataagtatatacaggtcaataacccttcacaaattgagtgcacccatgtaagtgtcacccagattatgaatagtaatgacatcatggaagccaccccatccatattggctagatttttatggaaatcttaaacttacatagaaattagcacaagactattattttatttagcactcaaagcattcttgatgaaagctttgtaaattctacttcattttagtagaataacttcaataaatcttaatatgtaccacaaaggatataaaaatagatgggataaatcattcattttatttttaaaaataaaataactgattttagggctcaactcagtctggcatttaatctacaagggacttgataataaaatccatggcttaaagcttgtgtactacaatttctaggagtatggccccattagtaaactgcattcatgctaatgtgcttgcttggggcgataatcattagcgttcctagttccagttcttgccagggaaagtacaccaggagtgggtgatgtagtattgtaattatacaattagccttgtcaaggcagggagcattgggaatagtaggatcttgaaacctgaaatgtggctagctgatagatgactgtcattaagctaatcttttgttcactttgtgattgaggtggagactgagcttaggaaaaggcttcttcatgaaggataaaatccttgaccgagagccactcttcttcatgtgctcatcaccactcagctcaccctccctttccataactacacatatattttgttcatattttaccttagccaaataaaacatcatgaaccgttgccaaaaagctctttttaatcaatcaaatttagataatagaaagtgaaattacgtagaaatagtgtttagcctaatacttttaatcatcacaataatagctatcaacattctacatcccttttcacacatacatatttcactgggtattgtagaattgtggctacatagaatgactctatattcaaaatataaattattcttactagtatattgatgtttaaggtgtgtaaaaataatacatatgcatacatatatatttatgtgtatatgcatgtgtacacatatacacacatatagtatatattttgttttatcacatgatactaataagaattaccctaaatttttaaactttcttatagaagaatagattggcataaagccttaactgcttgctctcattcactttcagcctgtattcattattaacctaagtttcctcccttgtggctcaatgccctttggggtttattaggctttcttctgtaaccagagtgatctgctaagccactttcttatggttaaatgagggtgtacaagtaggaatttagatgttcccactaggtaagtattagaggatataatactacctgtttggtgttgcaccccttctaggctacataactacacagacccttttcttcatagccaccattatactatattttttgtacaaatccatagaggataccctttcaaggaagactgacaaattgctaatgctagaatcaagcttagtgtccagaatattgtatgcccattttagcgtgcaaaacacaaacgttcagaagatgttttaaaaataagtcattattacaaatactgatcgtgacaaggcttgagtgcatttagaaacaaataagtaggaggtggatgcggttgtaaagggatgggatgaggccatgaaatagctctatatcttgattgtggtggctatatgaatctacacacgtgataaaacttcatagaactacacacgcacatacacacacaaatttgtgtaaaaccagtgaatctgaaaaagttatgcagattttattaatgtcagtttcctgactgtaatactgcacttatagttatacaagatgttattattggggaaaatggatgaaggacaaatgaaatctctctttaaatttttggaaacttcctgtgaatctacaattatttcaaaataaaaagctgtatttttaaagagctatctggagaaaaaaaattggttgtgatcaattgtggaagtaagttaatctgtgtttcatcttcagtcccactgtagtttttctgtttccaagcaaatcacttgacattctcattctttgtttctcctatttccagaaaaaggcaaatcttatctccagattactataaacatcttgaaatctgtgggaaaaataaaatcgcatgcacacacctgaaagatcataaatatatatcacaacttcctgagagcactattgttaacacccgtctacctctacagttttagaaacaaaagccataggggagcaataaactagatatgccagtcctcctactttgattttgcatttgagaaaatcactgtgctcctaaaatctgctacaataccaagcctcaaaaagttatgactaacagatgaaattgtgtgagcactttacacacatgaaataaaatttaatccatttggattggggtagctttcacttttctgttaaaaaaaaaaagtaccgtaaaagtactagctgaagcataaattcacagtaaagaaattaagttctttactttctggatgtgaatggcagctgaataaaaaccctttgccatttatagaaaggagtaacttacaagctgaattagagttgctcagcatgccaaacaaagccacaggcaaagcaaagcaaaagggaagcttgctattttataggttagacaagaaaaagcctaaatgactcctctaagtgagaaaccttcatatttcatgcaaactccaggaaataattaaggcttcagtgggattctgggacctgtgctctataaaccgcctcaataaacttcattttcatctggtagtatagagattctctcttaccccttactaccctttaaatattgtcctcctttgaggcaatgaaaatttggcgcataaataaaaagcataaaattgtttcagggagagggtgaacatgattcaaattcaaccaggtgctttatcaccgatttgggaggttgcaatgttattagacaaactgatagaaagatcgagagggaaaactattggtggaaagggaagattaaaaaaaaaaaaaccttgggagataaactaaaaacacaaaaagtatttcaaagcaaaagtaagctagccaattcaaataaaattctatagagaaaaaattcataagctcatttaaaaaattatcacaagaggtatacgacctcatattttagaccaactctccatcacactgtagtagttatagaacctaaattacaaacaaagcgtccacaagtgttgcagtcagggcttggggatggtgctggatgccagttaatctgaactgggatatcagggtggcagagcagttatggatccaggtcttggctctgacaccaagaaccgtgaccttacctggactctgtcacctgcttatgtttccgtttccccatctccaacacagcacattagatgatcttaaagctggtttctgtgaggatctagagaatccttagggttccatgaagccctgtctacacccttctgctgctgcagttaggttcggttatatttgtttcgattttaaactaagatttcacatgaaacaaattcatgcctcaagaaaatttaaaatcactgaactagaccttctggggctccttcctgcaccaacatttcaatagactctgctaatcatttttaaagattcaccagttccacaaaagaaaattttcttttgggttcttttgggctgggttctctctgcgtcattttttaattgtttttctttccttgtgtagaaacagcagcaaaatgtattattaaaatatcaattgacgttttgtgcttgctacttctgaataaataggaaagttttcgtgtttctaatctgggctccctatgtggaaagggtttttgtactgcaagatgtaaaattgcaattttgaagcaccagcacccagaaaataagtctcacttaggttttgttgtctgagaaattgacttatttctagcaatggaggtgggaacatagaaaaggcagaactcaaccacctagaaaacaaaaggctagtttctttaagactgaaagggaaaggtagaatcactggtggcagttctagagggggctggtagtgggattgggtagggagacctatgttcctacggtcacactgcacccacaaaagtgctcggcttctcaagggatggtgaatgcatggatatccaggccctggaggactgagtagcatgagtcaagggtatataggactatgccctagccacgttgatcgggtacaagagttatgtggcaaagagcctcatcaccctagtcaccccagtctagttcagctgatagaaagtctatacctctgacacgtaagtgagcccaggcaaaatcccagagtcacccagcagaccaccagcagatttcagattcctgagcaataaacacttatgtgtcaaataaaatagagaggaagacaattatttggaagctagataattgtgcatgcctgactgagagactggagggttctgctgtgatgggagtgaaccagcagtacctttatgagccaacgacaaaattcacaaaaatggaatccctgctcctgtttgctcagcactttgtgtgcctcttcaggttcttcagtatctctagaaagaaccctgtcgggacttccttatacatgataaagtggaacttcaagccaattctaataggtgctcaccaagccagaataatttttccccagctttattggggtatgattgacaaataaaaattgtatgcatttaaaatgtacaaccagatgttttgatacatgtatacattgtgaaatgctgaccaccattaagctaataaacgtatccttcacctcaccctagtccccatttttgtgtatgtgtatagtaagaacattgagatttactctcttagcaattttcaaatatacaacacatcattgttagcaatagtcacccttctgtaccttaagtctgtacatttattcatcatataactgcaagtttgatcacagctcttttcttctaacccaaagcccctgatagccaccactctactctctgatactatagaataattctaatttagaaaaaaaaatgtactcttccttaaatctgatatatctgaccatacttatttctgattaacatgaggaaagaggaaatgacgaggaaaatttgtctggagaagacttgtctttcagcttctggctttcctgggtctccagcttgccagttgcttattttgggactcatcagcctccataatctcatgagctcattccttagaatatatatatatatatatataaatatatagatatctatctctatatatgaatatatctatatatgaatatacttaggaatatataggtatatatattctaagcttatttcttagaataagtatatatataggaatatatatatatatatatatatatacacacacacacatgcatttcattggttctgtttctctttacaaagcaatacacttaatatgatttctaaattaatcaattaattgttcctggttagatcatggctgtagataattttcctttgggattcaattctcaaatctctaattatgacatgtcctaagaaatacaccgagacaccgcaagaattccattattaggttccccccgaccaccttttttgttgggggacagggtctcgctctgtcgcccaggctggagtgcagtggtgcaatcacacagctcactgcaatctgcgcctcaccggctccagtgatcctcccacttcaggctggctttttaattaaaaaaaattaaacactgtatctccatgaaataatcaatgacttgtccatatttctgagtttagttcttcttccttagactagtatgcagtgtgaccctggtagagtcactgaagctatttactgtgaataaaatcttaccatcaaattagattcatgccgctgacatacacaaaaggtctgatgacaattaatcacactatatagtgtattcaaatttaaatgatcacagtaaaaatgataaataataagctatcatcttttttcttccaaaatgtggttatataattacaataaatttattttgattttaagggtgtattgtcattaaagggagtttagctatgccactaatactgtgacttgtaattttaatatttatcttttatcgtgcctttataaaatataaaaatttttctgtgtccaaatatacccaaggaatccattcaaacaactggtattcacaaacttccaaacagtattaaatgtctctattacatgactgaatatattaataagtgccaattttatgttttctatgatgttagtagggttatttctcttctctagactattattttttaaatttctataatttgcatatacatgcatatgactgaggccatatctacacatagcatctggtcttgaccagaattaaactagaaatgtcagcacccagttcaagcatttaaatgacatcagacattcatatttgaatttaattttaattcatgcagaaggaaatggctggattgaataagaaattaagtttcttgtcacccatagttactactggagaaaaatggaaaagaggaaagaaggtaaatgaaggctctgctcgtgtaacatattcaagccttaaggaagctttcacatctgtcacagaagaggaatccatttcttaacacaagaatctgctctctttccaatcattgtgaaccacgtttttaatgtgaaagaggttcttctctcccatttgccccttccactaactcccactctgccaccaatagtaaagaaaagtaaagcgcacagatacctgtccctgggccacaaaaataatcaggttttattagctccaattagaaatatgacatggatattcaaggtaatttggtgataacgtagagttggaaatgaaaaaaaaaaattgagaaagtctattaaactggtcccaaattacactaaactttgaaacagtactaattttctctgaaaatataaatggtagaatcagtctgtttgcaaaaatacactgaaaaattctttatttataggtagaatctaaattattttggctagacacactaattcttaaaaatattgaataaattttttaaaattttttttggaagaagtttaagttgagtatacaacttaatcaggtaatctgtgaatcatcttgaagggtacgatggaccactgacatatttttagaatcaccctttcaactagtttcaatggcaaaacaccaaaaaaaaataaagaaagcccatggaaccttacatctgagtttaacctcaaatcaattagggcaccggaaaaaaaaatctgacaaggtaaataggccagcaaagctctgaggaaggttttaggattttgaaaggtaatagtggcctatactcagtattcaggctttacaaatacagcaccagtgatatatgtatcataaaaaagctacaaaagatagtttccttagagcaaagtcagaaactaaaatttttgcaggaatagtaagtcaaacaaatattaaccttttctagcttgagattgaaaagttagaattttttctttgctcctcttcagtaatagattgtcttaagaatttcccctgagctcagttctttgccagttcactggtggtttcacatgttttcaatattacaaataatacatttttttttttttgagatggagtctcactctgtcacccagactggagtgcagtggcatgatctcggctcactgcaacctccacctcccatgttcaagcgattctcctacctcgacctcctgagtagctgggattgcaggcacccaccaccacgcccggctaatttttgtatttttagtagagacggggtttcaccgtgttggccaggctggtctcgaacttccgacctcacgtgattcacccaccttggcctcccaaaatgctgagattataggcatgagccaccacgcccagcccaataatacaatttttaacataaaaattagaagccaagttaagaccacaagcatcctaggaacctgtgtaggaaagcatatgtggatgagagactcaggttccttgttccaaaggcaaaaaatattgaatattaaacatgagattccctgctctcctcagcctggtatggtctatgaacaaatgctaaatactttgtatctgaaattttaaaagtcatatttttaaatgacggtattttttacgtgtcataattagggtattctaactataaacatatgtctgtccttattgtagtgatttcagatattatctaaaataacacatagtttacattcttactttatgccaaacagtaagcttagcacattacaaatatcatcttatccttaaaattaccctacaaaataggtagcactgttatcccccttttcaagagcacagagagattaactaacttattaaagttcgcacagttagtaagtgatagagatgagatttgaacccagaatctgtaggctaaacacaaactagtaccagactacacattttaaattcttattttacagtgtcccttgtaattagtatctatgacccatagtagctcccagaattgttttgagtttgctttatttcaatagttaaaacattgcttgaagaagttcctccacaaatattcatctagcactttctcctgaaaatgcggcatagatgttaatgataaaacatgttctcatgaagacaataacaagtattattcatgacagtttttctcttatggaattaatgatgagacacaactacagataaaatggtatgctccccttcagtcctctaattccggagtgccgttgaagaagagcaggtcactttaagctgcagtgatgtgtgtgtgtatggagaggaaagaatgcagagtggtttggagacctggctcaggagtcagagttatctggcatagcactcaggcatttcaatatatttgtgtgtccttttggacttaacttcccattttcctcatctataaactggggaaataatgagccatatctgctagagtttcagtaaagatttaacaacacaatgtacgtaaagcaccaaggatatgccaggtgtgtaatacacacttgatctacatggactcattcattgtcaatgttactccaatgcagctctggacccagagccacacattcccacccacacagcacacgcagtgctggagaggaagtgggcctaggagggcctgcaggtacaggcagctgtagagctgctagaagctggggtgatgctcgccccactttcctgtagacaccacaggtactgtctgcctgttgtcacacagttcatatgcttgcttgtgatggaaccttggtcccaggatctgtgctgttttccactttgttacactgtctaaggtggcttttaactggaacccaagtgcaaataaaggttggtattcggctcctgactttgtgtagagaaaacagtccttttggtcactcccagaccacagcaatcagtcatgattttgttgaataatcaaagctgaacccatacatggtagggtcagttaaggatgtttgctttgggcaacagcctactttttgtctcatattaaattaatacctgagttaaacaaaaacagaaacacctcacatacactattcagaatctgctaaattgtcttttaaaaactgcttgcccaacttattagcaacaacgataaaagacgaaattttcatgatttcctagtatcctggattcataaagcatcaagaaggcatatggtattatatgagcatgaaataataacatggactgctctgcttaccaaattcagtcaagtccaaaggcagcacatgcagagggagcatgactgcctataagaaacaaacaattttggtgtttaagtctgtgttttctttttttttttgagacggagtttcgctcttgttgcccaggctggagtgcaatggcacgatctcggctcaccgcaacctctacctcccaggttcaagcgattctcctgcctcagcctccctagtagcttggatcacaggcatgtgcccctatgcccggctaattttgtatttttagtagaggcggggtttctccatgttggtcaggctggtctcgaactcctgacctcaggtgatccatccgcctcggcctcccaaagtgctgggattacaggcatgagccactacgcccagcctaagtttgtgttttctatcacataaaatgtcgtagaatgatgaactaatggaagaatggaaagaaaacttacaatacaaatgaaaatattttacaaaatacttccttataaggaagcccatcagactaacagtggacctctcagcagaaaccctaaaagccagaagagattcaggaccaacattcaacattcttaaagaagagaaattccaaccaagtatttcatatccagggaaactaagcttcataagcaaaggagaaataagatctttttcagacaagcaaatgttgaagtaatttgtaaccatcagacctgccttacaagagctcctgaaggaggcactaaatgtggaaaagaaagaccattaccagtcacagaaacacactgaagtacacagatcagtgacactataaagcaaccacacaaacaagtctgcatgataaccagctaacatcacgatgacaggatcaaatccacacatttcaatactaaatcttgaacgtaaatgggctaaatgccccaattaaaggcacagagtggcaagctggataacgagacccaactacatgcaatgacaacaataggctaaaataaaaagatagagaaaaatctgccaagcaaatggaaaacagaaaaaaataggggttgcaattctaatttcagaaaaaatagactataaaccaaaaaagatcaaaaaagacaaaaaggggcattacataatggtaaagtgttcaattcaacaagaagacctaactatcctaaatatatatgtgtgcaacacaggagcacttagattcataaagcaagtgcttagagacattcaaagatatttagactcccacacaataatagcgggaaacttcaataccccactgacattatcagacaaatcattgagacaaaaaacttaacaaaggtcttcaggacctaaattcagcactagattaaatggatctgatagaaatctacagaagtctccaccaaaaacaatagaatatactttcttctttttttaagaaaaataaaattattttttattttttaaactttttgtgggtacataggtgtatatacttacagggtacagaatatacatccacctcattgccacatggtacatactctaaaatcaaccacataattgcacataaatactcctcagcaaacgcaaaggaactgaaaccataacaaacactctctcagatcacagtgcaataaaaatgaaattcaggaccaagaaagtattgacattcttcacagaactaaagaaaactattttaaaattcatatggaaccaaaaaagagcctgaatagccaaagcaattctaagcaaaaagaacaaggctggaggcaccatgttactcaacttcaagctatactacagggctatggtatccaacacagcatggtactggtacaaaaacagacacataaaccaatggaatagaagaaagaacccagaaataaggctgcataccttcaactatctgatctttgacaaacctgacaaaaaacaagcaatggggaaaagatttcctatttaataaatggggctgtaataacaactgcctagccatatggagaagattgaaactggaccccttccttacaccatatacaaaaatcaactccagataacttaaagattgcattgtaaaacccaaaactataaaaaccatggaagacaacgtagacaataccattcaggacataggcatggacaaagatttcatgatgaagataccaaaaggaattgcaagaaaaacaaaaattgacaagtggggtctaattaaatcaaagagcttcttcactgcaaaagaaactatccacagagtgaaaagataacttacagaaagggagaaaatttttgcaaactatgcattcaacaaagatctaatatctagcatctatatggaacttaaacaaatagacaagaaaaaaacagaaccccattaaaaagtgggcaaaggacatgaacagacacttttcaaaagaagtcgtacacgcaaccagcaagcatatgaaaaaaagctcaacatcactgatcattagagaaatgcaaatcaaaaccacaaaaagataccatttcacaccagtcagaatgctggtgaggttgtgatgaaaaaaggaacacttatacattgttgttccttataagtgtataaggaacacttatacatggtgggagcataaattagttcaaccactatggaaagcagtctagcaattcctcaaggagctaaaaacaaaagtaccattcaacccagcaatcaccttcctgggtatatacccacaggaatataaataactctattataaagacacatgcacacgtatgttcattgcaacagtatttccaatagcaaaaacacagaatcaacctaaatgcccatcaatggtagactggataaataaaatgtggtacatatataccttggaataccatgcagccataaaatggacaagatcatatcctttgcaggaacatggatggagctggaggccattatccttagcaaactaacaaggaacagaaaaccaaataccacttgttagcacttatacaggggagctaaatgatgagaatgcatggatacacggaaacacacactagggcctaccttagggtgaaaggtggctgaaaacaatgcaaatttattctcttacagctctgtaggttggaagtccataatcagtttcaccaggctataaaatcaaggaacagggaggcctgtatttcttctggagattctaagagagtctgtttccttatcatttccagcttctagaggtgcctacattcctcaatgcatggtcccttcctccatcttcaaggtgcactgctcagctctgatctgttcttatgtcttctgtctcctgctctgatccttctgcctcccacttacaaagacccctgtgactacaatgggccgatctgggtaatccaggataatctcatctcaagatccttaatttaattacatctgcaaagtcccttttaacatgtaaagcaacattcacagattctggggatagaatgtattagcatctttgagggtaagatattattcaacctaccacaggtagataccatttattacattctttttgcacatgagaaaaaaatatagtaattattaataccactatatacaatgagaaacaagaattcagaggctaaacaacacaaactcacaaaactgaaaagtaggcaccaacatataaacatagtgtttctaaccctaagtctgtttccactacacaattctgctcccgaagtagaaaaaaaaaataaaggaaggactccctgcttaagggtagattttgttattttcttggattaaaaataattactatatatttattgaatggctaactacatgtaagatccaattttagattccgggaataaatgagaatcagatacagtcagtctcaaggtaatccttcatctttccatatatttaaatacctataattcctaaatgtatatatacagtactgaccaaatttaactacctcattaacattcccagtttcatgttctataaacttttccaatgtgccaagtctgaaactgaactcttgattttttcctacaaatgttcatcccccatccttcaccacctcaggaaatgatctcaccgtactcccctccctcaccactcatagctaatcaataattgaataccttaaattttgccccccaaatatatcttaattccatctacttctccttattggcattgcctccagactcctaattagtatcttcattttcattcttatatcgcctcaatctaacctccgtacatagactgcatgatctatttagaatataaatgagattatgtcaattgcatgttaaaatacttcagtaactacctacagcacttaaaataaaattcaaatttttcttgctatactgggtaaccatataatatgttctgtttaggacttttctgtgcctgttgtcctggcataactagtaatacagtctcctttcatgcctaaaattattccacttggatgataagtctcttgatcaccacatctgtagagccctgtgtgatctttcttttgcctaaatattattctcatagctgaagacttctccctcaggactcagtgtcttctcttaagtctccctagtagttggctttctttaaaatctgaaccactgtattcaatcctatagttaattctttcatttgttgaatgtctgttcaatccattagggtgcacagagagaaccaggctcgtatctgcattgtttactcatacatacctcagtcaacatcgtatctgaaacaagataaaagcccaccaatatctgctgaagattaatgactaaataagcttaccatatagacagagagatagtaaaagtatagtatgacatttacgtaatatgaatgtgttcaagatatcaactaccaaaattaatacaaaaaagaaaataattatttctgcctccagagaagggttgactaggaaagactccataaatggaggatgcccaaacaggcttgatggatgaataagatcatgcagcatgaaccaagaagccaagagaagacttctaagcttaggggatggcatttgcaaaggcaaaaaggtataaaactaattattcaggaaactcaaagtagtttctcttattagagtgtacaatgtcatataaatgatatattaataacacaaaccttaaggacaaaacctaaattgtagagacacagcagaaaatacagacagcactaacaaatttgaagcttagctttttttttttttttttttttttttttttgagatggagtttccctcttgctgcccaggctgcagtgcagtggtgtgatctcggctcaccacaacctcagcctcccaggtacaagcaattcttctgcctcagcctccttagtagctgggattacaggcatgtgccaccatgcccagctaattttgtatttttagtagagatggggtttctccatgttggtcaggctggtctcaaactcctgacctcaggtgacccacctgcctcggccccccaaagtgctgggattacaggtgtgagccatggcacctggcctgaagcttagctttgttttcatttatagtcctagaatgatttgataagttctattgcatatttaactcaccttataaattatagaagttcttagataaatccatttcggaagtgctatatttcaaacttcattgccataaagaatcctcacagttgcagttattacataacagttacaaaattataatacacagtccataaggaaactctactgcgagttatggtgtatagaactaagctgagcttttctgtcaagtaaaatttttggtttaaattttaataattatgtcaaatttcttttttctataatgtgcttttattcattattacattatttaaaaaaggccaaaaccactatgttattattttggcatttatattgtacaaacgtatagataaaaatatctatggaatcttaaaagacttcgggtcatattttgatgtaactaagagttgacataattaaaactcatcattgacctatttctctagaaatagaaaattatcaagatagatatctggtatagataatcatagatatttgttttgaacatttagaatgtatactagaagttgcacactagcagactgcatgataagaatgctttgtttagactccagtgtttcaaaaattgacttaagatttaaatttgggaaatcacaaaaaatccagaattctggccactcttaaaaaaattaaaagatcagctaactctagtaatattccccaattcacagtcccctagaaactagtaaatgctctctgtaaccacagacccacctcccctatcaccccagaacactgcccttatatatgtgacatgcctaagcctttgtgtaagactaaaactctcaaccattaaaaaccaattgaagatcatcaaaaagactaagaatatatttagactttgctcatttgtaatagtgagagttaaacataaaggctatttttaaaaatcatctaaacatgaacaaattcagacattcaaccctttctttcttggattttattagttaactagactataccgaaacaaataagccaaacaaatccagtataacaattcctccccctgactaccaagctatttgttttggcacctagtcaattcaataaaaatgatacaacacaataatctaaaaatatatatcacgcatttaatctgtagtttacctaaaagtacctctctgttatgtatctttcattgcagcaaatatactttattttatttaaatgggaagacaacatattttcaatatgaaaactgttccaggttaggaaatattaacctaaaaatgtaatttccatagaaattgacaggcacttaccttagctatctggacacaccagttaagcagcagttgtgatccaatgttatccttgtgctcgtggacatactccaacaggcagccatggggcataagttgagtaaccagctggatggttgggctcagacacacacccagcaaccggactaggtgtggatgatccatacttgccatgatcagagcttcctgtaagaaaaaaatgcaataccatgatttcaactcaaattttcttagatttagagttacttggattgtactaatggtgctgatgatttttaaaaatgtactcttactcaatggaatcaatcaaaatgaaaagacataatttcagttattctatctttaaagtgatttcattcaataaaattaaataaacaacaaagtctctacatgcattaacatggaagctgttatacaataactgcctacacaattaatagcagtattttctcctttgtaatatgagcaatatgagattttacttattgccaagtaagtcaaaatgaattccagcttatattatggatttttaacctttgacctttgctctggtaaaataatgtatacaaatttagttagttgcaggtagagtaaggtgagctgaactttgaagtcacccattattggtgtagagttggacagcttacaacggtgtcatgtataaatcgtaaatatggaaatgtagataattacaagtaatatgtctattgtcaatttatataaaataataaacattttaataagatattttgtttcataattttacctttcctcaaatttatttcattttcaaaattataagtgatgtcttattcatagattcataaaatttgagagctgagactataaaaatttgactactccaacttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatgttttgtatttttagtagagacggggtttcaccgttttagccgggatggtctctatctcctgaccttgtgatccgcccgcctcggcctcccaaagtgtactccaacttttatatttcataaaatgagaaaactgagttataattttgcatcagaatcataaaggcaccactgcttaatggggataaaagtggacatatgatggttatttagtgcataccagttagcttctaataaaaagttattataagactcttgattgtaatttgaaatagacataaccataaaataaatgtttatgtactttgttacggcttgatatgtgcttttatattatgaaagccaataaaatattgttcatctcctacgaaaacaatagtaaatttttgcttttgaaaagctatgtaatatcacctacgtagtattcttgtcaataatatctgaatctaatcatgaggaaaaaatcagacaaatccatattgtaggacattctgcaaagaaactggcctgtacttatttaaaatgtcaatattaggagaaacgtaaaagaagtgtatgatgttcaaactaacatttattacagaaatagagcaatgttgcatctttggctcttggataaaaaaatatataaaacattcttgggataattgaggaaatctaaatagggactatatatcatgtactattatatcaatgttaaatatttgagagtggtaatggtattgcagctatgtaaagtagtattctttgatcttagaagatcctgaagtctttatagatgaactatcttgtgtctgccatttactttcaaatagtttactcacacagggagggagagagatatataatatatgtatacgtatctatgtttttgatgtgtctatacatatatatacacacaaatgcacatacacatagagggtgtaatatgtatatggcaatggattatcagttggtttttctatatgaaggtacagtgttcattgtattactcttgaacattttctataactttgaaacatttcaaaataaaaaattaaggacacaaattatattgagtttccatttaacatggtatggcagattgaattcacaaattacttccctttcatttcaacttcattatactgacaaaaaaagagttaattttaaaagacagacaccaacaatcacagaaaggaggcaataaagatagaatagtaaaagtaggaagtggcttatcagtgttagccaacttggtaaacataagcaatctgaagcctaatttaatggggggaaactgagaagcaacccaataatgtataacaccaaaggctgaggagtagtagtattacaaacctccctaaacagagcaagaagaactgttttcagcgggaatgcttcagagtacatttaggaaacacttagactacacatctccttcttccctttacctctaggaaatcttaaaccaaaagaactgtggactgtggatatcaggcaaaatggaaagagaagtactctggggaaaatagaagtattatgtaaatttacatatgataaaaatatggacgatttcttccattccatctcccaaatagagctgtgacttcaaaattctcaaagttttgtttcaacctagaattttacacctagcagcatttcaaccaagtgaatgcatacaacagacatgttcagacatgccaaatcttgatacatgtaccttccatgcttcctttctttgtaaacgtgctcataaaaaagggagggggtgttagaagagtacataaaatcaaggaaacaaacatcaagcatgagatatggaaatacaaaaaatacagtgaataattttctagaataaaagctatacaacaaacggaaatagcagccagcccaaactggaacaggacaaatagctctgggaaaggtgacccaagaagatggaattgatagaatgcctgatgaacttaaaatacattaagaaagtatttatttttctagtgggagttgaaggtcaaattagtgatagatacatagaaaactaagctaaagtaaaaaagaagaaattaacctgagataaaacacaaagatatgcacaagaaagactcagaaaggtgaggagctaagaggggagtggatgatgagagattgctcaataggtacaatgtatcttgagtgatggatacactaaaagtcttaacttccccattaggcaatctatgtatgtaacaaaattatacttgtactccataaattaatacaaataattaaacagaaaatcatacttacgatacagcacaactgggaatagttacataatcataatagtttaaacatgaaatactgatataatcagaaatcatatagctgtgggaagatgggacagagtatgcccttctgaaaggtggtgatgggaatggagtgaaaggtacataaccattgctggttgcaaaaagttagcatatgatacataggctaaaaagaaaaaattaagacttcacagtataagcatattatttaaatgtatggagttaagtaacagaagaaatttccaaagatttgaaagtgattgatttgggcagtggaaaatgggggcagggaagggacagcagggtagctagcatctttcatcattagtcttgtcaaagtatttcacttttttataattaccttaaagctacttgggaggacattatcccctttaaccgtccctactattttaccgctgttgagttcagctgtgccttacaagagttattcacaaatatgcagtgtttgatggggtatgtgggcttcccagatccagccaagggtttatcgtgaggtttaacattttattttttcagtaaggaaaagggggcagcatgggaacacgcctggagaaaggagtgatagaagaccaaacaaaagaagtaagctggtaaaatgctgtcactctccctcaaaagactttttgtttctgaggtttggtggcaaaaactgaaatcattgtttttcacatggcttccaagtaaaaaagatacttcaattatctcttccctagctgccccagggaacaagaagagtcacagaacagagaccagtttctatgctttcttgctgagcccaccaggactgcaacaagatgatgactggaagttccgggtgcactttgaggcgtcacgcctagcaaggacttcagcatcctcacgtggtaccagtcagcagtaacaggagtaggtcctctccaatggctcagagagaagagaattcaacatagggaccagaactggtaggaaagatcactgtagaaaccacagaagcatccttacatggtatcagtcagcggtaacaggagtgggacctctccaatggctcagagagaagagaattcaacatggggatcagaactggtaagaacgatcactgtacagggagactgcagctggaaggccagattataggtaaataggagacacccaacaagtttccaaaatatctgcggagactgcttggggggccagggttttgcataattagcagagccagaaatctacgttattactattcatgtggcctcgtctggattcacgaggtgaaaacatttgctttcacttcttgtgtatctcagtaaacatttgaaataaagcaaagcaatgtagttataaagagagtatagatgaaaatgttagccaacttaaatgatctattattacctattatttaatctagtattaagtgtattcacagtgtaaaccagagggttccttcattgaattataacatgcacatgtaaaaatatacacataccgacaaatcagcaaaacatctaattagattaaatcattaatttaattatatatttaattgtgtattaagttagatacttaaatattagatatcagattaaagtcaatttatacttatgttatttcttttttggtggctctgaattttttgtgtatatgaaagtcacctaggtttacagttacaagtgtggccccactcccagatactcaggtttagaagaagatcttaggagtctccattcgtagcaagtacccttgttaaaggaacttaggaaatataaaatgttgagaacctctagcacatcttgatgtctccatcgaatgtgtgcttctataatccattgcaaaagcaataacatctaataattatttgatccttattataatcccatgaagcagttcaaactcaaaattaattctcagctgcaaaatgaggaaaccaaaactcaatgagattaccggcccaggtcatgtgacttgttagtagcaggatcagtaaacactcaggatttttattctgactgtactgttacgacagtagaaatatcatattttttacttcagtttcatcagcatattacagtgtcaatctttatgtttttagcaagacagccccaagcacctcacattagccctacctgcatgaattgggtcaaattatgctttgcttcctgagaaggaactaaaatcaaacaatacatttgtgcttacaggtaaactgtcatcactttacaatgttttcagaaaaagtcaaataaaatatttctctctgatttactgagggtagtatttgataaatgttatttattaaggtaaagagaatgacaaaatgtaaagtagaagaaagattttggggttacttttgcatttgaaaagtttacattaagaggtgtaaaaaagtcacacggaagctctctttttaaaaatctgttagtaagtcctggcaaaaaagctgggtttctattaagaaaaattgctcatcacactacaaagagtatttgaaaccaaattgcagagtatttgcgtaatagttctctttttctgaagaaagaaaaacgaacaagacactaattgtagcttgcatttttttttttttttcataaaagaaatagcagatggctggtttggaggataggagagtagataaagaaaagggaatatgaatttatttagactgatgagtgggataaaaaagggaaaaatcccaatattttaatcatagagtgtcggctttcaataaattactctgtgttaaacttaatgtcctctgttagttatctttgtgtgggacctatggaggcaattttggaatctttgctgctgtcactagaaaatgtcgctgaagaccatgggaataaatacaacctgacagggacattatctatttttccagaaaaaaattattctgtcttttttttcctttttgctttacaatttttttttttcttgtaggtaagtttcagagttttctcattgaacagaagggaataatgtaacaggtgctacagtaaaaattctaaaacaaaaatatttttctttataatgaagtctggtgtaaataaggtctttttaaaaaaaccatcaagggactactgaggtatagattaaaaagctctgaagcatgtatgtcaagtctctagccacatattatctatatctctatttcagcctgaagggaagacatttttgtacaataataagtgagcaataccatttttttatattcagctatcgttttgcacaaccaccagatatttatatctttccactttagtttttcatattatttagcggtttcacaaagacaaaagggaagaaacaaccatattgccagtgaaaacttataggctattctgtttttaaaaatgttaacttcagccaaactctgtttcattgtatctatggaccattaatgcaataccctccagctgaaaaccaggaaaatctcattgcatcagagatagggaagattaaaagagagatagaggaaaagaaaagagacaattaatgtagacatataaaactacacatcatgcaaccatcagcagatttgtgagcgcttgaaagaaatgctgcccctaaagatagtgagagtgctagtgatgaagaacacaaagaagataatgacggccacaatgatgaaaaatgaaataaaatcactggtccataataatttttttactaacttgctttgctgcagatggtatgaagataataaaataaacgaaatctgcatctgttccttcatgtctagaataaattataatttatctgggtaaataggtgagcagtaattagagaggctgaattaatatgccttcaatttaaatgtgtccacattgctcagtagccttaccactcccttccaatccttggtatcatttttgtggactccaacaatcagatcaggactcttctaaactttgaagtcagcacttttccatctctattctacatcattcacccattgggtggccatacgttagatttagtcactaacactgccacttcattgaagaccttttgaagaagtctacatcgggaaagaattctactttctgttttccctcttttttcttccactccggattacactgaaattccatctttatgatattttttatcccgttagttttatatttcttcacctaaaaatgtttattgagaacttgctaggtgcctagcactgtgattgaagttgtgtctacaaaataatctccagcctcaggaagctttcattctacctggagaggcaactagtaaacaggaaagccaaataaacataaaacagatgcataagtatttttaaatgagattaagaggtatcacaaaaataaacagagtgttgtgatagataatgaaacggtggtcgcagagctactttagataaggagagccaggaaatgtgtcctgagatcagatttatgaaacaaagtcatatatataaatacttggaaagagcattcaaggaaaagcatgacctaagagtctggcatattttggaaggtctgagaaggctcatgtgcttggaatttagcaagggctctaatggcatgagatgggattgaaaaggtgggtagggaccaagtcatgtagggccttgcagtcataaagggtttaagtcttaaatccttaagaagactggatttattcataaatcttttaatgcctggtttctgttgtacttcatttacctctatcatagcttgatctccaatattaactattacaataaagcacttgccaatatcatataattttctcccctctgatgtttccattttgctgctctttggctgaaggtaaatgcccccatcaccattctcaaactttcaaatgttagagaaaggcacagattcatgagattttgcctaaatctcctgatttgatcctccaaaaattactcttttagttgtttaaaatttatttatttttgtgttttttatgttttattattttgtttttgagacggagtctcactctattgcccaggctagagtgcagtggtgcgattttggctcacttcaagttctgcctctcaggttcaagctattctcctgcctcagcctcctgagtagatgtgattacaggcatccgccaccacacttggctaatttttgcttttttttttttttttttctcagtagagacaaggttttaccatgttggccaggtggtctcaaactcctgacctcaagtgatccacccaccttggccccccaaagtgctaggattacaggcatgagccaccatgccaggcctcttttagtttttaatttcttactgatgctttattacacttactatggcttctatctctgggcagggaaaaaaaaaagctttctacctttcttaatatctactctgtgaaatgtacttttgacaccattttactctgtttcactgaatcattttaccatgatttatctctagtacaacttcaccttcactgtgcttaccaccttcactgtaactacaaggacatatatgtgtcccatcccatattccaaaaataaaagttccttcaattttgccctatctgtacattagggatatttgtcagtccccctttagctatttcttcatgttatcctcctttgtgcctttgagatccggtttttctgccacttttctaaattcttacccctcaaattactctggaaaatgtcatcaaatacctcattttcaccaaagtcaacatgtttctcatctcattacatttccccagcctgcattgttttatctcactgaccatccttcttcaaaatccttctttggctgatattagcactttatcctacctgtcctgatttttcactctctgagtactcttcttcttttttttttttttttttttgagacggagtcttgctctgtcgccaggctggaatgcagtggcacaatctcggctcattgcaacctccgcctcccgtgttcaagcaattctcctgcctcagcctcctgagtagctgggactacacctcttgtcccttcaatgcagaaatactacccgggctttggctgtacctcactttgttttagtctgcagtctcttacctccttacagatttgttctccaacctcctagagatgaaaatattttccaacattaagaaatatgacagagttgtcaaaaacatatggaattgattgcaaagtttttgtggtttgtcatgatttgatttagtttgaagcaatgtaaacagcagggcattttttttctctcgagataaaaaataaaatccattatcttcacgtccaaagtatctgtgcccttccaaacatgagaattatgttatgcccatattccaagttttctcctccactcctataatttcagttgtcatttctgagcagaaactaataagcttatctataatataactatacaaaaccatgttataacatctatcttattttattagaattatcggtgaaatgtctggcatctctgtttttttctctggaagcagtaatgtgagtcagtcatattcattggtttatcaccaaatccttgttgaatatatggcttataagaagaatgcaataccattttatgaataaatgaacaaaatctgtattatatcctcccctcccacacttactccattccaggaatcaacccgtatttcaattgctttctcatctcttaaaatagatactactggatttgtaagataaaagaaaacacggtaaataattttcccatacgagcttgcctgctttactttactattttttttttaatttcagaaacatttcctaattcagttttaagatcttggatttatatttggtatttgcatttctattttttccattccactttgtatctaataatttgccaagtcctattaattgcttatcccagtgtagctcaaatctacatctttctgtgtcttttcattctgactcctacttaaattcaggctcacatcactactgtaaaaataccgctttttttaattaacatattctgtttatgctacaaacatacaaaatatcagtggcattttttgattgacaacatagagtcgtaacattgcacgtactcaataaacacatgttgaattaaattttatattgtgaaaattgcaataaattttagaataaagaagtttagagtatatttccaggtatgacgctaacaatctgtgacattggcctgtatatttttctttgtccctcaagctctattctccaccattttctaccaatactcaccctgccacgtgctcagtgagactgacccaaatggatgatgacaacgggctacgacgctccctggctttcatttgggttcagccagtgcaaagcagtggtacaatactgaatgaagaacagagtgagtttggtacttatcccccaccctcactttcctgcaaccccttagtgagggtcacagctgccgtcaatttgaggtaaccttcccctggtttcttcaagcctagcagtgctgttactcatcttgaagtacttcaacaaaccctgttgctgttacttaatcctgctcctacttttataaagactcttttgctaaactctgttcaattccttcaactttgtatgccatgtgtttcctactgggatccttctaatgtagtcatcttgaacaaggcacttgacaacagttacctgtaaaatcacagatatggtcattgatggcaaatacgtggcttgcatgttaccaacactcccctcctcctacccatgaaagatactgctaaacagtcattgtgtggtaggctgatgatggctctcaaaatattcccacatcttaatcccaggtcatattcatccctgaggtgaatactaccttatttgggaaaaggtctgtgcagatataattaaattaaggattctgagtttaggagatcttccttgattattcaggtaggttctatatccttataaaagagaggcagaaggagattagacacaggcacaaagaggaaaaggcaatgtgaagaaggagacagaaattagagtgatgcccccacaagccaaggaacatctgtagccacccgcagctggaggaggcaaggaatgtatttttccctagagcttctggagggaatgcagccctaccaacatcttgatttcaaatgtctagcccccagaactgtgatataatatatttctgttattgtaagtcaccaaatttcagttaaattgtttcagaagcaccaggtgcggtggctcacacctgtaatcccagcactttgggagtctgaggtgggcagatcacgaggtcaggagatcgagaccatcctggctaacacggtaaaaccctgtctctactaaaagtacaaaaaattagccgggcatggtggcaggagcctgtagtcccagctacccgggaggctgaggcaggacaatggtgtgagcccaggaggcggagcttgcagtgagccgagatggtgtcactgcactccagcctgggtgacagagcgagactccgtctcaaaaaaataaataaataaataaaataatagaaaatattaaaaaaaaatgtttcagaagctacaggaaacaattacaattactgtattctttcctgcctggactggatgaggactcataacactcagtgctagagacactcagtgctttaagcaacaagaactgatttattgggaggtgaaggtgagctgaaatattgttgccttgattttttcacatattttaaaaactgatgttgctaccaaatctttagtttggataagctatagtagtctaatctaaatgatgcagatacttttaattcatttggtaagtaacatatatatgtaattgctaaatgatacagtacaagaaaagagcttatcacagtgcctagtagatacttaaaatgttagctattattatttttattaaaccaattatatctaaagggaataaaatcgttaagcaataaggcatgactgaatctggaaaaaagctgcagctgcagggtgagtggtcactttgatcttttaaagtctggaggggacattaagcatgcaagacaggaaaactgacagaaaacagttttgctgtcagcactttatcagctattcttttcctagttaaccccagggagagctagcagtatctcttcccatctcaacatataaccatgaagagttaaaagatggctaaagtagattttggcattataagagaacttcaaagactacataaatttgttctttaacaaaaagtaatcacaataacactaataataatcaataacaatatggaacaagtagataatagagatcaggatactaatgaattcttgtagttttaggcataggcagtttacagtttacttattaatcttaccaatgctacataaagagaaacacaaaagtgtctgcaaacagcatttcagaattgatgtgaaaaattcttagcaagctccaacatggagtttctcatgaagaggatactgtaatgtgctataaagaaggaaaacacaaacatactagaactagaataaatcattccaggctgtagatactaccactagggagaaagaaataattattaacattcatttttctttctccatatgaaaatgattttctaaagagattattagacctgtcacttggttcacttgtagctttatttagttcacctgtagttttctaattcttaacaaccatactgtggtccctctgaagtcacatattaaagaattctaccagagcttaataatgactgctacttcttgttgaattatgtcagcacaatgctattgatttacacctgaactcactgagttctcaggacaatcttgtccagtataaaatatattatgttaatttactgatagcaagacacatttaaaagggataaaccatttgccatgattctaaattccttaagtagccaagctgagatttgaatccagttcacattgcatccatagcctagtctctttctgccatgttttctctgcaggagctattcatgtcagttaggtaactaggtagatctagcagattttgtggtgattatcctagtgtccataggcatgatcaatataagattaactagttaatgaaatatttacaaagtgacattctaacaggcattaactaaccttttttggtatagatcaaatgagcccaacttatcctcaaccacttaatcttccaataataaaatgctaaatagtcttttcaggaggaactaagactactcatgtctttattctcagttgtgaatgggagaatgtgaatctaaaagtgctgaatcaatatttttgaaacttaaatttgacttcaatagaacagactttagtaaatttgttaataacttttatttaatcacttagagctttactgtttactatttagtataacttgggaaagtagtatgcatttgttttcctggacactgcatcttgtttaaagggagatatctactctgcttttaatctgtaagaataatctcagttaattaatgacattcatattaaaggaacttaataacaagcaactcgacaaaattagaaaaatgctacctttatacttaataaactatatcaaacatacctgtggtaaaggagcaggcaggactgtgtcattctgactcttccaagataaaacagtgagtgactttaattaagttttccatttttctcttatagcttcatgcttatgtaggataatttatatgtagaaatcatttgtctgtcattcacatatttttatctcctctacttttataatgaacttattaccatcatatattaaatttgaaactgtgattaatatgcaagtttttatattaaatattaatgctggtgttattttaatattctacattgatcctgatgtcaaggggatccagttggaggtaacagcaatgagtacaaatctgcgttaatgttatttattattttatatttttaatatagtagcagtaaataatattaccacccactcaggcaaaaggggttataataaaccctgaaagaaaatatatggtgtcacaaaagactcttactgctagtgcctttgtttcagggggctgagtcaaaggaacatgtggctttttgtctagacgcacactgtgagagggtaagcaagtggcagtgggaaaaggagtacctcataaagaatctctgcaagagggcatccaattctggtccagtacttgaaaacagccactgaaaattaaccaatactttagaaatggcatggtatcttgggtttccataatgcctgccctaggaaaggtcaattcatggccattatatttatcatcagcaacttcaaacagtagtgcagggtgctatcatagttattttgttgtatgttaccttattaataactgtattgactttgggaatgtttgcaggaaataactagccatctttcattcattaatttattaactcatccccgatatggattgaggacttctctatacattcacaagggtacaattattaaaaagacatatatcctactcttaaatagccaatatcctaggataagtctttaaaatttagtataaaaattataaacattagtaattataattataaatgtatgatataaatttcctatgataactctttcaagagagaaattaccttctaacttaaaaaactgaatgcaagtaaacaaaaagctgtgttcagaagaaaaatatgaatatggtatttatgtgtgggaagaatgttaaaagcaaaaagataaataacactggtagggttgtaccatgaggagaaaggggtgtggatgatacaaattccttccagagtcttccttctgttttactagttgtgtgacataaagcaagttattcactctgtcaaaacctcaatctgaggttactcagatatataatgggaactataatgcctatcttctgaaaagaacaatttcaggtaatatatgtgaaagagtctagcacagtgttggtatataacagttgtccaatataattagtttcccttgcttctaaaattaagaaaatggaaaagtgtggcatgcatggggaatacaaatagatcagcttcagtgaagcatatggtacatgacagaacacagtaagaaacaagatggaaaaggcaggttggtactagggcttggaggagtttgaatggaaggctgacatttggattttattgtaagcaaaatggggatttcctatttctgctcttttttttaccctcccataaataacagataatcaagtaccttgtcttgcggtggataaaaatatgatctacattcttccctaactcattttatgaggccagtatcatcctgacaccaaaacctggcagagatacaacaaaaaaagaaaacttcaggccaatatccctgatgaacatagatgaaaaaattctcaataaattcctggcaaactgaatccagaagcaaattgaaaagcttatccaccatgatcaaactgacttcatccttgggattcaaggctggttcaacacacgtaaatcaataaatataattcatcacataaacagatctaaagacaaaaaccatatgattatctcaatagatgcagcaaaggccttcaataaaatttgacattccctcatgttaaaaactctcaataaactaggtattaaaggaacatatctcaaaataataagagacatttatgacaaactcacagtcagtatcataccaaatgggcaaaatctggaagcattatctttgaaaactggcaaagacaaggatgccctctctcatcattcctattcaacatagtattggaagttctggccagggcaatcaggcaagagaaagaaatacggggtattcaaataggaagcgaggaagtcaaactctgtagataatatgatcccacatcaagaaaaccccattgtctcaggccaaaagcttcttaagctgataagcaacttcagcgaagtctcaggatataaaatcggtgtgcaaaagtcacaagcactcctatacaccaacaacaggcaagcagagagccaaattatgaatgaactcccattcacaattgctacaaacagaataaaatatgtaggaatacagctaacaagggaagtgaaggacctcttcgaggagaactacaaaccactgctcaaggaaatcagagaggacacaaacaagtggaaacatattccatgttcctgaataggaagaattaatatcgtgaaaatggccatactacccaatgtaatttatagattcaacgttattcccattaaactaccattgacattatccacagaattagaagaaactattttttaaattatatggaaccaaaaaagagtccacatagccaagacaatcctaagcaaagagaaaaaagcttgaagcatcatggtactagacttcaaactatattacaaggctacagtaaccaaaacagtatagtactgttacaaaaacagacacatagaccaatggaacagaatagaggacacagaaatgagactgcatgtctacagtcatctgattttttaaacagctgacaacaagaagcaatggggaaaggatttcctatttaatacgtagtgctgggagaactggctagccatatgcagaaaattgaaactggatcccttccttacaccttatacaaaaactacctcaagatggattaaagattgaaatgtaaaacccaaaattataaaaaccctagaagaaaacctaggcaataccattcaggacataggcgtgggtaaagatttcatgaaatcaccgaaagcaattgcaacaaaagcaaagattgacaaatgggatctaactaaactaaagatcttctgcacagccaaagaaactaccttcaaagcaaacaggcaacctagagagtaggagaaaattttgaaatctatccatttggcaaaggtcgaatatccagaatctacaaagaatttaaacaattttacaagaaaaaaacaaacaatcccactaaaaagtgggcaaaggacatgaacagacacttctcaatataagacattcatgtggccaacaaacatacaaaaaaagtttaacgacactgagatgttgaaatgcaaatcaaaaccacaatgaggtaccatctcatgcccgtcagaatagcgattcttaaaaagtcaagaaacaatggatgctggagaggctgtggagatataggaacacttttacactgttggtgagaatgtaaattagttcaaccattgtggaatatagtgtggcaaatcctcaaagatgtaaaaccagaaataccatttgagccagcaattccattactgggtatgtacctaaaggaatataaaccattctattggaaagatacatgcacatctatgttgaccgcagcactactcacaatagcaaagacatggaatcaacccaaatgcctatcaatgatagactggataaagaaaatgtgatacatattcaccacggaatactatgcagccataaaaaggaatgagatcatgtcctttatagagatgtagatggaactagaggccattatccttagcaaactaacacaacaacagaaaaccaaatactgcatgttctcacttataagtgggatctgaatgatgagaacacatagacacagggagaggaaaaacacacactggggcctgtcagggggtggggttgggggagggagaacattaggaaaaatagctaatgcatgctgggcttaatacctaggtgatgggttgataggtgcagcaaaccaccatggcacacattaacctacgtaacctacgtaacaaacctgcacatgtagcccagaacttaaaataaaaataaaatactaaagttgtcaactcatatccaattttatattaaagaatatcaaactgggggactaaaccagaaacgtgaatacccacaacggacccttaattggaaactgttggtgctttttaaataagttgttttgaggagagttcaaattacagtataacaaaattcatttagtgaattaaagcagtctgtggttagcatatcatacagaggtattatccgtttaaggaaaaacacagttgaaacccacagagtgggagaaaatcttcacaatctatacatctgacagaaggacaaatatccagaatctgcaacgaaatcaaacatattagcaaggaaaaaacaaacagccctatcaaaaactgggctaaggacacgaatagacaattctcaaaagaagatgtacaaaaggccaacaaacatatgaaaaaatgctcaacatcactaatgatcagggaaatgcaaatcaaaagcacaatgagataccaccttactcctacaagaatggccataatcaaaaaatcaaaaaataataatagatgttggcatggatgcagtgaacagggaacacttctacactgctggtgggaatgtaaactagtacaaccactatgtaaaacagtgtggagattccttaaagaactaaaagtaaaactaccatttgatccagtaatcccactactgtgtatctacccagaggaaaagaggtcattatatgaaaaagatacctgcacatgcatgtttatagcagcacaatttgcaattgcaaaaacgtggaaccaacccaaatccccatcaatcaacgggtagataaagaaattgtgatatatatatatatatatatatataatatatatatattatatatatagattatatattatatatatagtatgcatatacatatatatatatatatatatatatatatatatatatatatatatatatatgatggaatactacttagccataaaatggaattaattaatggcatttgcagtgacctggatgagattcaagactattattctaagtgaggtaactcaggaatagaaaactaaatgctgtatgttctcactcatatgtggaacctaagctatggggatgcaaaggcataaggaagacacaatggactttggggactcagggggaaagggtggggagggggtgaagcatacaataccacaaatttggtgcagtgtatactgctcaggtgatgggggcaccaaaatctcacaaatcaccactaaagaacttactcatgtaacaaaacatcacctgttcccccaataacctatggaaataaaacaattaatatagaaaaattaaaagtaaaaaatttaaaaaaagaaaaacattacattttaattccccaaaagtaaagtaataagtgtaaaatcaccactgaaagaacatggaaatagtcaagcaaaacacacctacagaaagataattatcacaaaatataggaagtacatctacctgcctgctcacctcttcaagcctatgcttaccacacatgcaaaaatacaataaaaaactatgatctacaagtcagatttaaaacttttttttgttctttccagagttacctttttcaactctcattctctgtagtggggaataatttacctccaatatgagtagaattttgcttctaggcactgctctttcttcccatcattcccacagttggttgtattttctttatagttcacttcacccctatggcctcatttttttcccaccaaatttcatgtagtggccggacatggtggctcacacctgtattcccagcactttgggaggctgaggcaggcagatcacgaggtcaagagattgagaccatcctggccaacatggtgaaaccccgtttccattaaaaatataaaaattagctaggtgtggtggctggcacctgtagtcccagctactcaggaggctgaggcaggagaatcacttgaacccaggaggcggaggttgcagtgagccaagatcatgccattgtactccagcctaggtgacagagtgagactccatctcaaaaaaaaaaattaatttcatgttagtattggtcaatcttgcccattgctgtgtttgcacatatcttctggtgactacaggcatgacaattactctttgaccattctgctaaacaattctaaaaagggcaaaagaagttacagcattcaatggtcaatggtaatttcaataatgtctcagttctttatagacatgtaaaaagacagctttttaagggtaggcgtgccggctttcatctgtggaggacattaattgttattgctttgtttttggtctattcccacataacaaactctgaagcaattctacttatctgttctactgttggtccttcaaagtattatagcttccagaactctccaaagaaatccctgtgcaaattttagctaattttaaggattggatggccgtgatctaagtctttcctttaagaaccagatcaaactgagatggaaccaggactagaagactaaatatgagattcttttgaaagttaaaaaataaaaattttaaattattagaaaatgtttctgtggtacttcaactctcaaagaattatttgcacagtctgtttcatcagaggaaccagaacttatttatgatatcatactgacataggttacttagattaaaagaattcatatattcagagtaattattcatcagatctacaaatggtatgaaaaacccactcataaaaaataaattcttcatcttttagctatttaactgaaatgtctatacattaaaattcacagatgtgttaaaacatgtactggaacaccataacctaacatttacttcaattattaaaaatgtagcatgaagaaagcaagtatttaaaggttcttccaaaccaatttcagtgatttttaagtgcaaactaggcaattatatgttatctgtaattaaagcaggaatgcacttgagaatatttgagatatcagtatatcagtacagaattacagtgctttttaacattagggcatttttgcatgtttaatatattttcttttgaaaatgtgatggaaatatttaaatacttcattcagtatttattgaatgatttaaatggctttgaaagtaaatatctacagatcttctggttaaaagctagtggtttctagtggacagtgtatttttcagagaaaacattaaataatgaaattcactttatcgacaaacacaaatatttactgagcacttactatgtatccagccatattctaaaaataatacatttcatactacatgacattcagaaacaatttaatttcataaattttcatgttttcaatgtctacacagataaaaaacattgttatttggtattttgaaatagtaccactgggtggtaaaaaagttgagaggaataaattttaattaattgttcaaaatactagagccaaacacatcaataaaatgattaatagttattaaaatatcatgagtaagttatttatattcccaagatttttggaagtatagtagaataaattattttccctagataaattactttttaaattttttgatagttttattttctaaaataaattcaaaattaactgtattcaacaatatacctattaaaaaaatttaaggtacagcactttgttgtaacaaataagtatctataggactgtcttttatcacctttaaatttaaaaaatgcaagagtaatgaaatctagtaaaatattttttgtaactatgacatgttaatataaacaatccaatttacgaataaagaaatcataaagaggtcacagtagttattttttgtcaattattttttgtcaattataatatcattattgtataattgttgctgtattcttcaacgttccccggaaataagaaataaattattcttttgactttgccctataggtttcctttaatagtacaattcaaacaatttaaaatgcaattttaactactatttttcatttggctatgcatttctttgaaaagaatttaaaaagaatgtattatgacaggtgagatagcatactagatgctttcatttccccattaattttaaagtaattgcaagagcaaaagccatgtccattgtgcatgtctgatctgcctcaagaaagatccaattataaactgacatgttttcaacatacatatcttgcatatttaattcaggtaagcctccaaaataaaacatgtctctggttttgttaaatccacaataggtttcagttgaactagaattttcaaatatattagcactattttggggtattttgtttttgttgttattgtttatatttcataggtgcatatatataatatttgatgttatggataggtaattcatttgtacatttgaagataaatatgtttatcaagcacttgagagcagaataacaatatgtttaacgaaatagcatataccataaatcctaggactcctatatgacatttttcaatccagatgtataagaccccacagtgtgtaatggagcaactttatttgatctaatgttggtttcttgatccgtgaaaagagtgtgatatattttgatttagaacatagatcaaaatatattttgagtactagttttctgtattactgaattttaagtctttgtccaggactttggcacataaagattaaaattacatactatatatgaataagaaacacaaatgaggtacttcatgtttaaaagctcacatagaaaaaagtggaaaatgtatcctaactttaaatatatgtatattaaatatttacatataaaaaatatatgtatatgtgtatattttatgcatctatgtatatacaaaatatataccatgaaatccagttattttgttttcttcctcctaatgtaatatatacagggatccatttataattttctttctacaacttttaaacatgttttatttatttgtggcgcattttttctctatgaaaaaaaaattaccactatattctacactaatatcacgtatcaataaaaatgtataatgattagctagtaacccaggcctataaattaacaaaacaagaaagaataataaaaagacttccttaggctggccgggcgcagtggctcatgcctgtaatcccagcactttaggaggccgaggcgggcggatcacgaagtcaggagatcgagaccatcctggctaacacggtgaaaccccgtctctactaaaaatacaaaaaattagctgggcgtggcagcgggagcctgtagtcccagctactcgggagactgaggcaggagaatggcgtgaacctgggaggcggagcttgtagtgagcggagattgtgccactgcactccagcctgggcgagagagcgagactccgtctcaaaaaaaaaaaaaaagacttccttaggcttagaaagacattcaattctataaaaatgtgttgtttaaagccaaatctacctaacttttgtaaattgattaccaaattaaattgacattaattcattgataattgatagcataaataagaaattgactttgaggggtcatgatttttaaaagtcagaatatttatatatttaattatacatgtttaaaaattaaatcagtttattaacttcaatattatttttcaagtattcagtatattttacaattatttacaaacagcttcaatatagacactgacttagaatggataagttgagaaaaaaagcatttgagcaaatagggttttaagaaaatattttcttaaggtataatacatttgtattaggtaaagcataggtacctattattcaggtgcagactgtctattctcaatgctcaataaatgttatcaatattattatggaaaaattactccaaaataaagaggagataattaaagccaacactcagcttctgtttcatgaaaagtaatctttgaagaaaataattaaagttatacatatccagttactgagattgggattatcattttacttgaaatacttcaatagcttatttttgtcataattttccaaagttcaagaaatttacatcaaaatatttcctgccttccttccattacctcttcttcctatcaaatgtgatgaagtagagttttatcagataaataatcaaattcaataaaccaatgcaaaattaaaattctaagaaattgctttccacccaattaagaaaaagaagccaaacaaaaacaaaactgatcaacttcatgtaaacatagttatgcacattacatatcaccataacacaccaaaaaccaaatgacaaacaagaaaaatatttgtaatttttatcataaaaactaatctctttaacatataaagagtatatatatagaacttaagaagtgaaagtcaaccaactcagttaagaaaaaccatagatataaaaagaatttacagcaaaagaaatagagttgtataacatcattcaaaataagggaattcacgttaaaagtaccctggaagtattttttaaagttagatattgatctggtcagcaagttgttttcggttcctgccatatcttgtagtgggaaacccttttcttttcttgccagaatacttccttttacttctgcccatacgcaatcctagagaatacaagtaggaactctattcctccttttacacataccccagggaacacatggtgactggaaatgtagggattcctggaggattgtttttgagtctattctggtttctttttatttgctgaatataggacctctatgaatttgaaaccatagtaaaacttatggatatggaaatattgtgccttggctttggctgtagctgtttgtctcccatacaaaatacacttcagtcagtctcacccagattgataagaaatatcatttcaagactcacttattctttccgataatatttatctggtgctgttctggattaaatgatgtctcccaagaaaaatatatattgaagtcctaacatccagtacctcagaatgtgaccttatttcaaaatatagatgctcctcaacttatgattgggttatgtgccaataaacctattgtaaaatcaaaaaattaagttgaaccattgtaagtgaggaaccatctgtaggtcattgcagatataattatttaagataagacaccctgcagggagaccaaggtgtgtggatcaaggagatcaggagttcaagaccagcctggccaagatgggtgaaacccaatctctacttacaaaaaaaaaaaaaatagccaggcgtggtggcgagcacctgtaatcccagctacttgggaggctgaggcaaagaactgcttgaacccgggaggcagaggctgcagtgagccaagatcacgccactgcactgtagcctaggcaacagagcgagactgtgtctcaataaataaaaagatgagacacgctggaatagagcatacctctattccaatatgactagtgtccttataacaggatggccatgtgaagacacagaagcatagggagaatggcacatgaagccggaggattgcagcgatgcggcctacaagccaaggagctaccagaagccagaagaggcaaggaaggatcctcccctagagacttagagggagcatggccctgccaacaccatcattttggaattctggtttccagaactgtgagaataaatttctgtcattttaagggaaaaaaaaaaagtacagtgaatatcatttgtcactttttaaattggaagaagatcctaagatttgataatgacctatcctcgataggccacgaggaaacaaatgctggcgtgtattgccagtagaaaggtaaaatgaaacaacctctatgaaaggtaacctcgtattatctgtaaaaattacagatgtatttagccttgacctgggattatattcctggaaattcattctacacttgtaccttcagatatgtgaaatgacacaggttcttaattgcggcattgtttgtaataacaaaagtttagaaaacacccaaagttctagcaataaggacaaattaagtaaattgctgtacagccacagagtgtaatgatctacagctgtttgaagaatgtgaccgttttctatgtactaacttaaaaagatctctaaaatatattaagtgataaatagcaaggtatggaattatgttttaatgtgtttctttttgtgtattaagaagaaaaataagaatgtatgttcacatttgttcacatttttatttttaaaaattggaagaatatacaagaaactaataaaatggttcattctggagggatgtttgggcaagcattgagtaaactgagataatatgggtatgaaaattcatcatgtaatttttttcatattgctgtagtttggggctatataaatgcatgaacacttcaaaaaataaattaaaacaaaaagtaatacgagcaaacataaatgcttggaacaaatgaggatacgctttcaaatccaatttaaatagacaatctaataggtagctaaaagaatgagaaaatccaaattttctttcttttggcaggtaaattttgactaataataattataactgacatttaaattattactattgtaactacattttatattttgactcatctaattcccaaaacagccttataaaataagtgctattattattactaccattttacagatgataaaacttaacccagagaggttaagtaacttgacccaggccacttagctagtaagtagtggagctgaaattctaacctggcattttgtcttcagaaaccatgatgttaatcactccgcacttaaccattgagaaaatcacatgatatatactagttttaaatgttagccattaggcactgaaaggcagattgagaattaaaatcttctaataagatttagaattttctgtcaacaaaaaaatcttgggcacatgtccttctgcagtacttaatctatacctttgcaaggggtggaaaaaggtaatacctgccactgctatagaagatatgagaaaaaatatgtttataattttatattatgagtatgtggaaaatacaagaagaaaataaatataactgtgttcaaatcctgaaaatctataattgcaatctgagctttaaaattatcacaggcaattatcagctttaacattattgtgggccctaggtaagatctcaagccaacaaaagttaggccaagtcaaaagtatttccagtttgtccaatcttaacataatatgaacaaaatgttcatttttttagattgtaaaatgtaatcacagcaaaagatacacattcctattccctcaagtaattgatgatctcttctttccttaggtgtattttttaattaaaatgcagtatctatatctagaaaatgtatcagcctgaagataattgtcgagtcaatgtgaaagaaaatataagaatgtcagtatgtctaaaagcataaacctagttaacatttcaaaaacattaaaatgaatgtccacatataatttccttaaatcaaccagactcagttcaaaacaaatttgtagcccgaatgagtagccctaatagcttagccatcagtctcttcttcattttccgtaacatccactcccatacaaaaatgttttcaatcagttccaacttttaatttccaggagcagaaacctgattaagtattgataatatagaataacttgtaactgagaatacgtatcaaaacgaatagctaattttttaatgatgtcagtcaaaaatttgaaaaatctatttagaagtattgcctaatacttctgaattcaaaattgatcattaactataaaaaaaactattgtaaaaatgattacaattgggtaactatgttcaaaatgttcattttatgtttagcattattaaaaacatctatgtccaattatgagagaagagcatctgatcaatttgtgaccacagttattagcatgcattttagaattatcattataaaaactattaattgcctcaataggtacagttcctcattattgatctacaactacaggaagttaatgatgttaatcattttcaaatgtacacatttattctgtttctagaaaaattactggcagaaaaataggatgaacatattaacagaagagttctcatgctaaggataaccacattttccagataatttacactaaaaatatccatagggatgaaacgcctttgcaaaattatgactgtgacagtgaaagaggtccaacttaaacgactccatcgtgcctctaacctccaagctgtccttattcattcctgagcataggcagaactaactttgggaggaacttagtttatagtttaaaacaaagacgataatggccctttcccagaacaaacttccttcttgcctggggactagactgctaacattagccataagattagaaattatggtttaggagtcacatagctggaggctacaagattctgcttctccctaaactgctcctaagatcagtgcctgagatattttgcagcctctatccttgatggatcaaccagcaccacccagattaagaaaccagcccatctgatcttgtgactcccatccaggaactgactcagggcaagaagacagggacccccctccccacgatttcaccttcgacccaaacaaccagcactccccaactcactgcccctcccctcccaccaaactgtctttataaactttgatctccgaatgttctgggagactgattcgagtaacgataaaactctggtttcccgctcagctggctctgcgttaattactcttttgtctattgcgattcccctgtcttgggaaatcggctctttctaggcagcaagtaaggcgaacccattgggtgcttacaaattgggtaagctgaacccactgggtggttacagggagaggtttctgttaaatgaaaacttgctatcttgttatgcaacaggaagagcagcaacttaaaaactttttgaaactttctctacaatgatgattatactcttaaacaatataattcttttcaccaaacgtgatcttaaaacacttaagcaacataactgactacactttccctgtaaggatctctcatggggtctgttatcacattgttagcaccaaaatgctaaaactgtgaaatattctagtggctacccagcaaattaataaagatattgatttatcatacatataactgcaaccctgggagctaattggagcatcattatttacttattaaaattagatccttgattgtaatcagaattatgtggaaagtcgctagtttcagttttccaattatacattacaaacatccatttatctgccaacgaagggggatagattaggggaggggaggacattctagtttaacacatgagggtcttaatttttttccctacttacctctctggttttatctcttctcacttcatccaattaactacatttccagacaggctttttgaagctagatttcaacatgccagggctttccataccactatactgttgcatggaatgttgcccttctctcagtcacttgatcattgacagactaagtcatactcatccactgcgacctaatttaaacatcacctcttctgtgaaatcatctccaagccctctgggcagagtaagcactctgttctccaggctcccacagcatgtaataggtaccgctattatagcactaactgcactagtggttccccacactcagctctgcagtcctcaaagcaaagagagtctcttaaagctttgtgtatgttaacacctgacactgtgcttgccatttattttttgacaagttgaaagtttccaggtgtcagagtcataaaaatcccagtgtgaatcctgcctgaaatataaaaaccatgtaactttagctagtaaatgatttaagccgagtctcagtttcctcatttttagggtaataattacaatacctaccttgttgaggttgtgttgttgtacctgagcgagttagagaaaacgccactctttgagacgaattaagagtccaagagacagctaacgctcaaaattctctcggccccgaagacggggctagattttcttttatactttggtttagaaaggggagggagggtctagttaaaacaattttacagaagtcggcaaaaaagttaaaaggataaatggttacagggaagtaaacagttccagatgcaggggctttaagactattacaagctgctagacgcccggtagacgcagggctttgggcgttatcaatcggatgaattcctgggaactgcgggtattgctcgccacagtatcttatcagttaattgcattcttgaacgtgctgggagtcagcttgcacaagttaagtccttgaggaaggggctgccagtgaaagagccaagacggagtctgtctggctctcttagctaagggagagtcaattcaggtggaaacaaggctaggtgattaaaggaaagggagagtctaaaaacggggtagtaaaaacaaagttgggcattacagtgtaggcagtaaatgtgttatttatattgtaaagcgtaatgtctgacatgtcagcatccagtgaatgattgattgctgcaaaggatgcatgaaaaataaaactgaaagacaaagaggatttcaaggttccaaaacataaaagcagctgtaagcagttaaactagatgaaagaaaggggaatctccctggatgaagcataaaaagaggtctttaagtagtacaagggccaataaaatggagtgaacttaaaatagtataaaagggccagctgggcatggtggctgacgcctgtaatcccagcactttgggaggccgaggtgggtggatcatgaggtcaggagtttgagaccagcctgaccaacatagtcaaaccctgtctctactaaaaatacaaaaaattagctgggcgtggtggtgggcacctgtaatcccagctacttgggaggctgaggcaggagaatcgcttgaaccgggaggtggaggttgcagtgagccaagattattgcaccactgcactccagcccaggatacagagtgagactccatctcaaaaaaaaaaaagaagggcccttctgcacactgaaggggcttgctccatcttggctctcgtagtgagaagaatgtgtctttgggtttagcatggatggcagctggcaaggtgactctagcagaaagtcaatggggcaaaaaagcagattggatagccttaagaaagtagttaaagttactgacgatggaacaagaaagtaaagtaggctatagcagctaacaaacttgaagaagagagaagggttaagggctctgagtgaagccaagagaatatttattgaagtgtgggagtaaaataaatgtaaggcaaggtaattattaacagaaagtggaaacgttgagtgtaacttctcaaaggtagaacagtttttatgaaatgcaaggcaaatctatcttaaggatttgagaaatgcaagaaattcactgtgccctaaccctatccaaaccaaatccacatcaaaacaatgagctcaagttgtatctctttcacatctccctggagttccagtatttcttaagcttttactctctgaagcaaaaaatacagcactttgtattattctgtcttgcattattctaagtatcttagcttctcccatcaaatgcagttagccatgttaatttacacttgtatctgttgtcacacaaagatactctagcacctttcccctaattacatagttaatgttgaccagagataggtttatttattgatacactatgtgcaaaacaaccaccaccctgataccctttcaaggaaagacttatccgagagcgctgctggcaaacagccttcattcaccctacagagatttcttcagctgcaaagagccaatttgcccaaacttacaccccttcccagagggaccctaattaatgactgattgatgccaaccaggataactttgatgggtcgttccagcaccacagctaccgaaagagttagacaaggctgctgtcaggcatgactcacaacctggtatctctctatgtccaatcctacttcctactgcccagccacagctgttaatcccaaagtcattctccaataacattttgcacactaaattccatcgaggcatatccttcttggtggaacccaaccgataacaacaacaacaacaacaacttaaaaataaactagctgggcgtggtggctcacacctataatcccagcactttgggagaccgaggagggctgattgactgagctcaggaatttgagaccagcctgggcaacacggtgaaacctcgtctctactaaaatacaaaagaaattagccgggcgtggaagcgtgcacctgtagtcccagctactcaggaggctgaggcaggagaattgcttgaagctgagaggcagaggttgcagtgagctgaaatcgcaccactgcactccagcctgggccacagagcaagactccatttctacaaaaataacaaataaaaaaaaaaaactaagcaataatttgcttttatcaaaattttgtagaccattcagaaatagctatgacatcaaatatggaatgtttatttgatgccatagctatttttattttttctcataatactgatagattagtgtaaattagagagaaagtaaacataaatagcatagctgtttattcataagatattcacaatgatatcctattttattctaggaactagagtagtaaccaagatggacatggtatcttacatcagaaatttactgtatctacagaaaaagtaaaagcctttaaaaattaaaataatgacaatttaggtaaagggtcttgttgcattcttttatgtattctttcattccctaaagaagggctttttaagttcacattatctcaaacttcatgaagtgactgaaggtaaaatcaatgcaatccaagactgaaatagtataaacattataaagggtgtggcagtcgtatgtctacataaatatatccaatctataatgaatttattgtcaatcaaattgcattctctcatattaccttcttgaatagaatgtctttttgtctttacatatacctaggaagtggtttaagttacaccctgaggaaattcagttcataataaatttgtttgagaataagaaagattcaaataaaatagtcattgaagaagtacaatatcatttctgggataaatttttatagaataaggtaataatccatcttaaaacgataggcattaacttgcctagaaagcaaacaacttggagaatttgcagtgtgagagacattgtgttggctgctgaagattatttggcaagaccactttaaaattaagagctaagatccctgacaagttttaaaatcttaaaatacatttttaaagacttgaaaaacagatgtactagaaaaaaatcactaagttgacagaaaagggaagacaataaaagaaaaatattaaatggaaatagaaaaaatatatgtggtctgagatataccagaggatgagagggtcttgtaaatcctgataaagaaagagcaaaaagtacaaatataaagcattaataataagaaaagagataaaactataggaattatatcagaaacaagatgaaaacatcatagttataagaaccagatgttattagactactactaacagaccacacagaaatacagttaacctctgaagaacaacagcccatgggtttgacctgcacgggtccaattacaggtggatttttgtttcaatacagctgaccctctgtattagcaggtttcacatatgcaactagtactgcaatatagtattgctgagaagcaaatcatgcagatatgaaagggtcaagtttttgtatacgtgggttcttcaggctgactgtgggacttgagtatgcgtgtattttggtatctgcagaggtcctggaaccaatccctccctggatatagagggataactgtatgcaaaacaagaagagttaatttatgccaacaatatccaattaaaaatatgaataagaaataagataccaatcacaataggaacagaaacaacaaaatattgacaagtaactccaatgaaaaaaatacaatcatatttcaagaaaattataaaactaaagtatatctgaatgaaatgtttcaatactgtaaagtttcagctttctccaaattaaactacatgtttaattcaatgttatataagatgtcatttgggagaggaagggatgttaatgcaattatagacttcacagcaaaaaaaaaaagtctgaatgctttgaataataatgaaagcatacttgctctgacaaatatcaaaatgtccaataaagaggaagtacatgaaatggtgttttattttcatttttggaagtagaaacacacagctcaatggaacagaaaagaggcttcaaaataagacgaatatattctggcaatttagctacatagtagttataaatccactagttctggatgcttaggtctaaaaatattcatttttaagaaagcaacaacataaatgaaatatacaccttaactctcacttttctctatgtgtcagatggttctaaggtataatctgtagaaattcctaataaacctctgcattctcttctcttttccagcaccctgagacccctgggagcctccttcttacccctgaagacctttctctaggtcctagttttataatctttttctcttgatgactttttttcccccctctgatctatctcttcatgaaatgcccttctcctacatgtgtaacaactaaagaatgatgtagctttttacccacttactctttttttttttctgagatggagtttcactcttgttgttcagcttggagtgcaatggcacgatctaggctcactgcaacctccacctcccgggttcaagtgattctcctgtctcagccttctaagtagctggaattacacgtgcctgccaccatgcccagctaatcttttgtatttttagtagaaatgggtttttgccatgttggccaggctggtctcaaactcttgacctcaggtgatccacctgcctccaattcccaaagtgctgggaatacaagcatgagccactgcatccagccccacttactcactctatcgagcgagtatttttattcacttgttatttctgtcctaaaaacatgaagaagcaaggaaaaatgcaatatccaaatggtctatagagaggagggttaggaaaaaacctgtaaaataccatatattaatccattattgtctatggcatatatgatttaggggatgaggcatatctaatcagtcaagcaaaaaaagaaagcctcaaagatatatttcaaatttgttatagcaaacatcactgaacttaaccagaccatcatttgtacatattttctgcatttctatgagtgtatattagtttataatcagaacataataacataaatggattcatttgtacagaatctattaacactctttttcaatccacacatatacatctatttgataaaataatgttttcctatattgaaacacagctgtccaaaatttatcaagtaaattttgagagctaaagaagttttgtaatataacaaattgttaattcaaaggaagcttattatggaatatggttaaattctcattatcaaggtaaattgactgtattatacaatatttcagaaaaattacacaatacaaattcatcttttcattagagctatactcaattgaaatctaaattattaaaatggtaaagagacatcaagtcactacttcacaattatttcaatttttattttttaaccttcacatgatagtaaaaatattacttaaaaatgatcagttgctaaatgaatttcatcaatagattttttaattcaaaaaaaatcagctttttaagagtaactaaaatttccccaaaaagaaagattatatctttgtatgttattatttgataagagaatctattttatttcattaatcaaaatgctataaaaacaggcaaaagaataattcagttaaagtggcagttttgtatgtctgtggggaataaaagagaacttcagctagagccatctgacatgcttggtggcctctaaggcacaatccactttagttaaactcactatacacctcaatcttttgaaacactgactgccaagagaggctccagagctttagaccacgcatctctccacgtcctcctcctgtcccctgtcctttcaaatagggccaatacttctaagcctgcttacacagaaattctagataagtcctctgcaactagatcatcagctttttgtggtccaaagacctcactagagggcatgtgaagcttgaactggaaaaaatgaaccctgaaaacaggaagatcaggcacagatcaaaatggaaatgtctacaatgtcgtgctgggctgagaaatagaggaaagttgcagataacttgggtgactcagttgatggtgtcaacattcattacaataagaacatgggaaaagcaagtcgggcttaggagtaaaacttacatctgtttggaatatgttaaactggggtatgttgaatcctctgtgtggtttcaactagttagtaaacagttgaatattctggtctaagtttcagaagaaaggcttttggaagaaaggccttggcaaaaaatcaagaaatctattttatttcttattttcacctgatacattcttaccattggaatactcctatttatttcttttgtatagactttatattaaatttacctattttctcctacttttgaaattcttctagtaaagtgaaaacttggacatatatacatgtacaccatgtactaggaaaaggggaaatgaacattcttttttctttttagttggtgttactctttatttattagactgcccatataaatgtacccaacaatttgagtaacgtcacttggcagaaggagacatttttgagtcatgccatagatttgagccctgctccatcatttacttgctgtgggactttggacctgcatccaccctctcagaacttgtgtcttcattgtgtatcacctattttacagattgttgtgagattaaacaaggtaagatacaaaagggtcctaatacactgactgttaaaactgagcagtgacttagaataatctcttgagcagtccagggcacatattgacctcttaagtctcctttagagttataatattagcataataacactgagctttaagaaaagtctttaagccagtgattcctgtgtatataccctccagagggattccaaatccccaggaactgaatgaaagtcatggttgaatgcactcgtatgcatactttttctgaacaaaggatccatagctttcatcagatttttcaaagaaatctctgaatggaaaaaatgctaagagtccttgctttgggctctttttacttctgcctacaaagaaaatgtctttggaataaaaatataactggtcacgctaatttcaattaccgtcagcctgtgtaagaagatactctttgagctaacaggctcacagaaaataatttcttctgtgtgtgtgtgtgtgtgtgtgtttcctgtcaagttagacagactcagtgtgttaacatttagagtcctgtcaagaagcatgcagttgttaaatgtcttctttcaccttggtaatctttatacctctatagtctatgaaaacaatggccaccataaatatttctgtagctgttaataataaggttgacagtactactgccaagctctatccttagccaaattagattgcacatattatttcctataaaacttctcttgtatttaaatcaaaaaggataacttttaactattcccaatattttaaaatttcaacttatgagaaaaatcaaagaagaatttcacttttaactgcaatctagtgggtattttcttagacatttttcccagcagtgactaccttaagtaaagttataaactaccacttctcaatatgggtgcttcttgtctttcttgtttccatgtgaggatgacaagatcatttgcttaaggagcctgtagttctcaataagcaatcattgattgtccaaagaatgtatagtgctgttcattataagggaagctttccacaatagaatgagattattgaatggctgaaattagagggtacttattctttcattttaccttcacaaaacccaataggaaaaaacaaaacaaaacaaggtcagaaggagctctcctaggatttttcaatttcatttccttatgattctcccagttaactgttttaagtacatgcattttctctgctccttcccaaatcctgctgaaacaagagtgaaggttttaaggtcgtaaaaagatacaaatacaggaacaaagaggatgggataatagcaagtgaaaaaatgacaacagatctcagaaaaatgataagaaatggagacagcaaaatgagaaaagcaaaaagccaagtgcctacaaagagggatgccaataatacaaaagccatttccatcaggaaaaaataggaaaaggtataaaaactaagaaatttagtagcgcagatggtgaagttgaaaggtaggactgaaaacaagaataacaattaaaatccttataaattgctattaaactctgtaaatatctctttattcagagtaccaggtgtaccaggtgactaactccattctggcaaaaaactataaatttttaaatggagaaatgagccaaaaagtcactacatttggggacaccacacacagtggaaaatggggaaggggaggctaactgtaaaaataactttttgtttctttttggttttttttgaatgtccacatggtgagccaaactacttggaatcatctgtaaaaatgctggcagccagatatgtaatttagcagcagacaaactgacagatttctctctggaaagagagaaatcttttgagttaactaaggtgggtaactcaaacaaatggtcacacacctgctcacagtaaagttcaaatcaacagatatttgtgcaaaaactctagctctaaaaacagacccgatttaaacaaacagaaagaaaagaaccctgagggaggagacaattcagggacttgaaaataacatttaagaaattagcatcctaaaacatatgaaaaaatatattgtatctatcaaccaagtatcatgcatttaaagaaaaatgatgacaagaaagatggttttagaaattgaaagtatcatatatggtattatcatatacaataactgcgaaggaaaagtcaagaaaattctcagaaaaagaaaaaacatacacctggaaaatctgagaaaacatactagaaaattagaggatccatttagaaggtccagcatataattagtaagaattccagaaaaaggaacaaaaaaagtgtgaaaaatattatcaaagatgccatgggattgggggtggggacgggaatccccaaactgaaagacataagtttccggattcaaagtttccagattcaaagcatccctcaagagctcagaacaatgaatgaagaaaaaaaaaagccccaactttcattgcttggaaattttggaaataccagacaggagaaaagatccccaaatattgccaagagaaaaacagaaatttggcatccaaatggcattggactgcaataacagcaatactggaagctagaataaattggaaaatatttgcaaaatattgagggaaaagtactatcaactgaatttcatacccaggcaaactatcaaacaagtagggggtatataaaaagtatttttgaatgtgtcaattctgaaagaagacagaaaaacaggaaagatgggaagacaggaaagaagggaggtgggatggagggagggagggaggcaaaagaaaataaatattaccatgtataggaaataaatatcatgtaataagaaagtattgggggtcatataattgtgtcaattatgaattcattacctctcaactataaatatacctttcaatgtgtcctctgtgataaataagtgagttcttttaaacatatcttctttaaagagggcattatgttaagattttaggtagcagtctcaggagggatgctgcaggaagaagaggcttcctgcaatttctggcacaggtttgggagtggagtaggcaggtgttgggtgtaggggggtggtcagcagtttgagtgtgagaacacttggtacagtccatcctagtcacaggcccaggacctgatttgtcctctccgaccttaaagtcttggcctgatgataaccttcccatagttctttgacatgaaaacctgagatttacacgatctgcctgctctccaggcctccttccagtgcaggtgcttggactctgtcagcaagccctcacaccatctgcactcagtggcgtactttgcttgggctctaccagcaagccccctcacaattaagcacccactcccccacagcagcagctgctgatcacttgttcaccagcctgcaatccagaggatgcttactgtttgctcaataaccccagaacaactccaacctggctaaaccagtcaacttttctcctaccccctggccaaaacacaactcaaacaaagtatggaccccttcaagttgacctttcttaggtaatctccctcacccttagggtaccatataaagtatccttacatagtacagttactcttgccatgtttaatgattattcacattaaatgtccccctctttaacccatagtatggattgcattctatctcctgattgggcatagactactacagatatactttcagtgaaatgaaatactaaactaagaaggaggaagatatggtatccccgaactaaaggatctaattcagctgagaagcaaagggggattctgaatgacgagaaagagagaacttagaattacagctgggccaatgacctagatattacccatccagactgcagcatgagagtggaattcttaagaaaggatttctctgtcccggctcagtggctcacgcctgtaattccagcactttgggaggctgaggtgggcggatcactaggtcaagaaatcaagaccatcctggccaaccaagatggtgaaactccatctctactaaaaatacaaaatttagctgggcatagtggcacacacctgtagtcccagctactcgggaggctgaggcaggagaatcgcttgaacccgggaggcggaggttgcagtgagccgagatcgcgtcactgcactgcagcccgggcgacagagcaagactccgtctcaataaataaataaataaataaaggattaaaggatttctcccagataagaaagaaaaaggaaagagtaactgatagatttcctgtaagtatctgacattgggcaaaagagaattcgagtcatacacttcggaagaattagatgtagggatatagaatataaaggaaaaaggtcttaattaaatgattaccaacagtgaacaacacctacatagcaatcatactgaaaaaaaatcatccattacaaaaggtgaataagaaaaaatatatacataagagaaaaatgaggcaatgtagcttgaaataaacatttcttttggtctctggttagactagaagtattaattaagtttttagcagtcacttatcaggttgcctctcaagttcctccctctcccttttattaatcttggtcttcactcaatgtacatgataaaattcctggaccatcagcagccattttgaaaaatgggattatgccctcttcatttgatccagggatgggcacaatcccaaaagaggccaatgagaatcgttttcctaaactctgcttccttgactaggggttaatggaggtacttcacacaagctgggcagaagctgagatacacgaggtctctatagatgcttacagtgttaaatttctagttccaggtcattcctgaggcatagctgtattcctgctatttgggttccaccagctttccatgaattgttcaagtgggcatatttaatttactttcttttgattgaactattacaggataccacatttctaaagaaattctttctaatctctcaaaatattcattagtttatatcattttatgttttttccttgacacactgcagattgagtcttgtagtctaacatataggtcaattgatgttgcaatggcaaattaaaaatgccagttatcaaggatgaaatgtaaatacattattacattctgtaaggtgttatcggtgcaatcaacaccctgagagaaagaaacatgatttgagactcagcttatataaacatagtgggtcacgagatgtccccacatcttgattgagcttctaccaatttttgcgtttgtttcctgtttctttaaacagtgaaactgattttgttcttacttacatttaaatttcaccttgaaattatgccactgttccttatcaaatactgacatattcctaaatttaaacacttgagaaggataaacccaaatgataaatatcacttagtaatcctccaaggtcccttgtccctgaatactttatgctcgactgctgatttgtaagtcaaatagtttaggtgtatgccagtgttcacagtcagtcttatcaacctcatagcacagagaccttgtaatgtaatatctcatcaccaaaacgacagttagataacctaggatcatgcttcaaagaatgtcttagctggcaaatacatatttttcaacagattgtttggttgacttaaatatcagaactgtctttcaccaagtcttgatcgaccgactgttaactttgaaccagcactgccttgttttgaatgcatttcacttaaggtgatgaaaataaaaccctgtagtattaatagaaataccttaaaaccttcatttactatccacaaaataactatttggcatatatataaccctttagaaatcgaaacatcttgtatctatttgaattgctaatgtgaaaaaaagacatgcagagaaaattcctaaataataggaagttcttaaatacaggctttcattttcttattataaaaagttggcactaattatgtaagtctttctgctaacttatagtttaaagctggatgatggtctttggtgctttattaccatgatgaatggaagaaaacgtattcaacacacttggatcacagttaacagactacagaaattgtttctctttttgttcctctgatattgttttatgaagttcaagctaatcaaaatctaaatctaaaagggagaaaataatttattgattagaaatgggcaatggtgcctaagccctgtaatgagatgaatactaaatccaccagaggaacattctgaatgctatttttactcattataggaaatggttattgttaaacctttggaaagaagactatagaaagatgcttggagatgagggtctcttgagacttatcagtaatttcagatggaacatattaagaaaaaacaagagttctcacccactgtgcatctcattgcaacatatgccctgctgcagtcctaatctgaagtcaactaaagtcttggtatatgtcctggaatttatttacccctaagagagcttacagacattgaaactgaattcaccacatctggttcaaaagtgtgtcatcctgaaggtagcattactcaaaagacagtaaataaatagaggctattttcccataatatcccaagttatatcacatgtaatttaacagataatatgtattttcatactatagctactaagtcattattatgtttattagaacatgccagaagtataaaaatagtattttatatttatataacacagaatagataacaagaatcatttttttaacatcctaaacaacctaggagcagttacttattaatttgcctttcaaaaccagattcgctgggctcccattgagctcccaacttgtaggtagcaggagaatttagaccaagatcttttatatcaagattctaaattcagtatttcttttacctaagaggtctcctaattagtacttataaaattctctttaaaagattaaaattgaaaaatggaactgcccacttttaaaaattttactgaattcacccaggagtttaaattaagtaaattttagacacagatgatggtaaatttctctgtacaatagacaaagtattaaataaaagaatgataatctaatgtaacaattctgtttatttcagaagcagtggaaagactttatgcctcattaagggaagtcttttgcttcattttcagttagaaaaccctgctagcggaattatatctgggctatttctaaatatttcattctcatttgtaaacgggaatgttatttccttaatagttacacatgcccatgaagtacatagagagttcctgtacataaaaaagattactaaagagatgtagatattataagagaaaataaccagtggggaaataaaggaaatgtggatttgaaatagaaaaggaatatggatttggaaaatttttttttctataggctgttactttaaatgacaattgaattaccaagtagaagagtgggtttctctctaataaacctattgatattatttatggatctcaaaagtataaagatacactaaaaatgttgttatggtcactatatgtgagataattgtatgtacaagtgaaaagaataacagaacattttcaaaatatattcatacccataaacccagtaaaataagagaattcataaatttacctttttaaaatcaacattatatgaaaaactaaagaatattgtattttgaagcgccgttctgcaaaagaataaaatgtgttttctttcgtaagagtatagtagcacattcattaagtaagtgaatgctgcacattttgaaataaatttattttaaaggcactgggtgcattgttttaatcacaagaggaaaaaccttttctgatgttatactcaaaccccttgtgttcgcaagtctcccaaaaagcttacacatgtttcctatggtgaattttccacatgcttgctagagctgacaatttttaatttactggtcagatttacctattatttgtacgcattatactagacatattcctgattcaccaaaattctttgtagggatagaaggaaattatagtcaatagagctgaggtcaagtgggcccttagatcttaattataacttgtttaaaaaaataagaaaaatgaaaaaataactggctcccttggctattttcttaccaggaaacaaatgaaaaagggaaatttatttctgaccataaatcccaaatgtttcattttcattttccccaagttaactttctcacctagctaagcagcatttttgctattattagcttgtggtccaatattagctgaccagtatccgtcaaactcctcagttcaatgagctcagggactcccaaagaactctgtgtatgcagacttctacttacagcttctaattattttctaacagataatggaatatttaattcagagaggttagattaaatttgtaagtggatcaaaaccctagataaagttgcagcagcaaggatcactgtagaaaactcaaagctttttagttttgagatccaacaccctcactgattgcttattcgtctgtgacgaactggtctcataattgtaatcctcagaggtgctcattttttttctaatcacactatgccatgctatacataaactgtaagcaacaggcaccaaaaagatggcctcttaggagatgcaatagcattttttgggaaaaaaacaagctatatatgtagtatacatagaatactatgattgttttaatagactcaaataagtatagattgtatgataatcacttcatgaaaagcgttaatgattaaaacatttatgcaatatttataaaaactttttcgcatcagatttttttttttttttttttttttagacagggtctcactctgtctcccaggctggagtgtagtggtgcgatctctgctcactgctgtcttgacctccagggctcaaccaatctacccacctaacaagctgggactataggcataagccaccatgctcaggctccagaatctttttttttttaaataaattcagaggatttgtgtgtgtatgtgtgttttaagaaagttatacacagtttgattttctaatctgagagtaagagtgagtaacataaaatgtcatatggagcaataataaataagaagaaaaagatgaggccatcaactggctttgaacagtaagaatacctcttgaacaaagcttgatttccatcgatgcagcgggcagctgaaggaaatcagaagaaaaactcagaagaaacaaaacttttgactgaactgccacaggtattgttacatgtggcccacctgcctctcatttaatgtgatcttttggaggaggcagagtaatggtatgagaagccagttgactttagagctagggaactttcagttcaaatccaggctctgtcttcccttatcggctttgcaatgagaacaatgatttaaatactatctgtaagctttattcttctctcaaaataggcatattaatactggtttgtaggcattcttgtagcccaatatagatacaaagaatcatttaattctttataatttacaattttgatcttaatgctacatgtggttctagaaaatcttcggaaaatatttctgctattaatagtggattcatggtggataatggaaccaaggaatgctaggctgatcctttttcaccctggctttggtgtgcagttgagttaaattattttccactatactccatttccttattgtacagattagctcttgtaattagaaaaggggcaggaggatattagtgcaaataaaaccatacctaaattcacccttgtttacattaatatattcagttaatttggatggaaatcagcccacatgtgatccaggattactgacttctgcccctcaatgtggaatcactttctaaacattaagaagatttctagcaatctggggtcatctctaaccctctacttgagagaaccattttactaactatgaccattcctaagggtgatgatggtatgcagactatacaccagaatgaaggcctcagcagcagcccaagaagcaaaggtttttctctgactttctcctgtcctcctgtcgctcagtcccattttccaccaaggcaagccatagaacctagaatccctctttccccagacagagcatacaaatgagaaccccttttcctgaaagccagccataaaatctgaaaatattctatgtaaaaactggccataaaagaatgatctgacctacctgtttgactgtaggtcattagacccacattccagagagggccctgcccccacacccagtaggaaagaatgcatgctcagagaaatcaacaagaatttagacagacaggccttgctgggtttcctcactcaattaatattagatcacactctttcacactcaatcatatttccataagtctggctatacttttttgaacctaagcataagaatggacaattttccctgtatctttgggtcttcattaaatacattttaaagtcttttaattaggcatttttcttcagaaacaggatcttgctctgtcacccaggctagaatgctgcaccaggatcctagctcatttcagccttgaactgctgcactcaagtgatcttctcacctcagcctcccacagtagctaggactacaggggtaggacaccatgcctggtagagatggggtcttgctacctttcctcctattaatttgcatcatgtcagtgagtttttaagaaaaacctttaggaaaccaagggccttggcccctacactgacaaagttcctgtccatgacttaaggacataaccaggtaaataaaaacagacctattgtccatttctttagtttctgtcagtctatggtttggaaattgtagacataaacctctgactgataacaacagtggtgttaagtaaaatgaggaattctcttgattattttgaggaaacgatcataaaaaattttctaagctatccttgtaaagtagacgcttttgtaataccatttttagcaatgccagccatgtgatcattgtaataagtaattacccaacggtatcattaaacttaaaaaaaaaagatgaagagaatttttatcttttatccacataccatacatgtgtaaagatacatatgtctttttattagatttttagatgtgtctttttattagacttattagattttattagatacatatgtgcctattgcaattatcacagcatagtaagccttttttcccttaaccaaattactgccctatgaataactaattacttcatgccatataatgcaaaccaggactttatgcagatagtcccttcctcctgcaggaacagtattttgtatccttaactctggaaacagatcattaacaaaaccattgaggtttgacatattggaaattgctgatattttggaaattctattttctggtgtttgcttgtcctttgggcaaaagatttctacctgcattttatgaacagctgaatattagaaactgttcctcctagtgatacagtcaaactgagtggggatttttcctaagtcatcataagtatcggttgctgttcagattggaataagaaattgcacatgattagtttaattctctttcagccctatgtggcatcataacacatcctctagtcatgtacaaaattcacaaactgtaggttagagagctggaaaatacctacaatatggaaaacgatgtcttcaacagacaactgatttccatttactaaatgcaaatattggtgcagtagactatgtgctcttgagaaatgtcctttcattcacacaaattcaagaaatgcttcggagaaacagaggcagacaaaaagttaattaagttacaggttgaggcttacggagagcaacctgtattggatctggatagtctcttttaggtacttcaatggagaaattaagcctgttggaatgcaaaacttgtcaagcactttgtcttagtatcccctaaggcagtatttaaagctcaaattttaggatcactactaaattctgttaactctcaactggaaatgcctgcagtcaactgagggactaagtggctatgttggctggacttcctgggtcaatagggacttccctaaggggactttcccctaagccaaaatgagccacagctgcaagctaagggattgaaacttcaaccaatcatatagggagtttaagctacagctgcagcctgatgtttttaaccaatcgggcccgccaacccacaagcagatagaaaataagctaattctgtaggacagaaaaaggaaaaggggaggggtcataaggggatataagcataagacacccaagccagaaaggcaacccttctgggtccaaagtaaggtgtggaagctttacttttgctttcgctttacttttgctttcgctttaatgagtcttgctgccacacactctttaggtccgcacgttgctctaatccagctgtaacacttgctgctgtggttcacggcttcattccttgaaacccgtgagaccacgaacccttcgatgaagaaaaaccttcaatcgaaagaagaatttcatctcacgactgctttcatttatttatttttgccaaaatctgtgataaaatcaactttatttttcttttcatccttgtattctcactcttactgaaacagaaaataaaatagagaggtcaaaaggagaagagatcctgatgcacgttttagctggagaagcaaacagtatcccaaattactacacaagtcaccaagaactcagaagtaagaagctaaaaatgaaacctaatactaccctcccatgtataatggaaacactaacaggcaagcactcacaagattcccttaaaacaggttcccctaatagaaactaaggaaagttattggcctattgcatgcataggaaaaaatcttccaagggtcttcctcctcaaagggttttcagagggtacatgaataccatgtcaaaacggaaggtctagttctctgtgtttcatctggcactctaaattcaagacagatcttaaattgagtttgtagaaatgaatcatatatgagcactataaatacctaagaaaaattattccaactacaatatgctaaataaagatagaacaattgggaaaaatatcacagaaattaattgggctggtatagagaggatgtaaaggagaataataagtctttaaaacatggaaaaaaaaatcaattcagacaattaaccaagtagttattctgtctcctatgtgctgatattgtgcttgctcatagatatgcagtgatggagtcagcagacatatttgctgtcatcaaggatcttgtagtctagtggtggagagtggaattctacaattaaaaactaagataaataatattaatatataataacttattaaaatttctgagtactattagtaagttataactttagaaatcaggaaagggctctttgagaaagcacacttaagctgagaaaataaggataactaggagttcattaggtatgattggaagatgaaaactccaggtgaaggcactgactggcttggcttataaggggagtggaaagaaagtcagtgaagagaaagactattggaaaagaaatcaggagctctgtaagctaagaatctgatattttactttagtaaagccactaaaggtctcatgcagaggacctgcacaattcaagctttgtattaaaaagtagggagatcaaatctagtctcataacttaagctgaagaagttgagggctgagattaagatgacgacaaaagagtataaaaagaagaggaaattgtccagatgtgtttttggcatagaatcaaagcatttactctcgaattggaggttggttgtttgtggggttgtgacattcaaggataaatttcaaatttctggtagggacaatagggtggatacagatacaaaatatataaatgggtgaaatcgaaggcagaagagattgagaagagtggatgaaggcatctattcaaggtgtgctagacttgggacgtccctgagatttccatgtggcaatattaaggatggagacaaggtcagattcacaaaacagactagagatggaacttggtagtctagtgagatgatctaggaaaaatttatagattgaaaagaagtctagaactttgcattgagatatttcaatatttctgatattgcttactgcctgtatgattttaagaagcaggaaagttgaagattttttgtaagaacatggttacaatgatggtccatgaatctaagcgggctgcagagagatgtgagataggaagcactgagggatcgtgagacaaaggagagtcagtgaaaggaaaatgaactagaaaggcaggagaatgtagctgaagatggagatatttgaaatagtaatttcaaatgtgaggctcctgctgattgcttactagttctagagacaacctacaaaatgggagaaaatatttgcaaactagccatctgacaagggtttaataaccagaatatataaggagctcaaacaattctatacgaaaaaaatctaataatctgaccaaaatgtgggcagaagacttgaatagacatttctcataggaagacatataaatgtcaaataggcatatgaaaaggtgctcaatatcactgatcatcagagagctgcaaatcaaaactaccatgggatatctcaccccagttaaaatggcttaatacttacatccaagacaggcaataacaaatgctggcaagaatgtgaggaaaagggaaccctcatacactgttggtgcaaatgtatattagtataaccactatggagaacactttggaggttcctcaaaaaactaaaaattgagctaccatacgatacagcaattccactgctgggtatatacgcaaaataaaggaaatcaatatatcaaagagatatctgcactcctatgattgttgcagcactacttacaataggttagatttggaagcaacctaagtgtccatcaacagatgtaggaataaagaaaacatggtacaaatacacagtggagcactattcagccgtaaaaaaagaatgcaatcaagtcatttgcaaagcttggatagaaccggagatcattatgttaagtgaaatcagcaaggcagagaaagacaaacatcatctgttctcatttatttgtgagatctaaaaaccaaaacaattgaactcatgaagatagagagtagaaggatggttaccagaggctgggaaaggtagtagggggctggggatggttaaataaaataaaatgtaaaaatataaagaatgaataaggcctactatttgatagcacaacgaggttactatagtcaatggtaacctaattgtgaattttaagatgacttaatgagtgtgattggattgtttgtaactcaaaggataaatgcttgaagggatagataccccattctccacgatgtgcttatttcacattgcatgcctgtatcaaaacttctcatgtaccccataaatatatacacctgctctgtacccacaaaaattaagaataaaaaatccactattagtatggaacaggatatagctaagagttactatgtgaagccatacacatgaaattttataatgtgaaaatgttatagaacaaaataccttttcaaataattttataagcctgttatactctaagagaaaatgtaaactgataaattatattcatttcacttgattaatgtaatatcaattagatttaaaataattcccatcaagatactgcatatcaaatggaaatatggagaagagaaacatacaaagactattcacatgaacatttcttcagaaaataggataacagcagttgtgtaagataaataaaatttcctatggtatatatagagaaaaacaagctattctttttaataagaatattaccatttacataataaagtcagatgacttaaaacacttttccttgcagtatctcactgtggtaaatctggtgtggaaaagttgaaacaaaagccaaaaaaattcatgcgaatgcaaagccatgactgttgagtagtcactagaattgagaataattacataatttctttcattttttttaagaaagcaagtaatttagataaaacatttaaaaacagtcaactgttactaggtttaaatactggggaaaaatacagagtgaagggaactcagaaaaagtgaatagtctgtctgatttcatgagatagtggtgcccaattttaagaatcttgttcaatagcatcatttcttatgtatgtgttctgcaccattttgtggatttaaaaaaaaaagaaaacaaaaaacaacaaaaaagcctgcattttccctgtgaaatggttctgtctgaaacaagaactaggagcaggtgtaaatgcaggtattcttatgaaggtgcgcctttagagtcattttcttaatgttgttcaatatgatctttctttatgggaatgaagaatgtactggtcattcactagcagtgtgttattattgtcattatgaatccattagacatattcgggtgagcagagtaacagccctgggtgaccaaactctccttctcttgcttttagtgtagcatttaatagaacacaaactgccccttatttattttttgcctatggtaaaaattctaagaaaatataaaagtcctctcctttacccttgaatatcaatagaagtttcattgtggtgataaattttgagtattaagttgccacatttgtgttatttattataataaccagtaaagcacagctatgtgtgatgaatagagtagtggttattgaatctagaatattctatttcaagcataaagttagagtggagaaaagggagtctaatgattaataagattgtgcaatttccattgtctttgaaagcttttttcccctgaagaactgtacaaacaagcatacaaatacaaatatgcacatacgctagtttgcagaaacatggttgcagcagatcttatttagcttgaaagttatccttggaacactctaccatagtgttataccagatgacccccacccacctttctttgcttgacagctttctctttccactgagcctattttgccatccttggctggaaggatatgtagggggtgaagtgtggctctttcccagcagctctacaccctcagctcccttaacccttgagtggggtaattttgaggtgtatgtcctacactggctgccagagtctctccagtgaaaagaagctccagtcacttacaacggcagctagctttattagttctcctgtcttatttctaaactcccccattgatgagtccttcacctccaaaataaatgactttcacattcttatttcaagggtagcttctgcatctgtaagaacccaaactaacacaagttaaacttattacttttaaccaagtaactctggaatatttataatttcaactcaacccttagattcaaattacaaataatttttcttgaacctacctcttttttgtggtttgttattcaaatacttttataatgatctacacacataaccaatgagctaaaaatgtaggtatgaaatataggcttatgtttatgttaaaattagagcagcctgcattagatactaaattcaccgttgatgttgccagttaaactgcattttaatcattgtgatgctatccttctaatgttttgaaagaagtctcgaaaatagtaggacatgtttctgcctggtacttattaaactctgctgatagctgtccatcaatctgttaatcttccagcatctatccacaagagaaaaggcacagtcaaaatattttctttaactttttttaacttttaaagagaacagagtcttctgaatctgttggttaccaaatccatcaaccatctaggaaaatgactcctttcatggctcaaccagagcctcatctaaaattcagcagaaatctaagacttcaagctgccatctccactcttgtttccatgggaatatacatcagatcaagaaaaaaaatggatggggttaggagctttcaaataatcattcaaaatcatgatgaggattttagagattttttcttaggtgtgattattttgtaggctcttaacccccttttgccagtctgtttccatggaaatatgacaaaaatgtctgttcaagcctccagcagagattattagcattctcatgaatttcagctttggctgtagtctaggctggcaagattttttctaccagttttataaattaacctatactgtttctactctttgtaattttcctttataacttctactttttaaaaaatttcccttcacaaatttatagttatgatcaagatcaaattgaataattggcatatcactgaaaaaggcttcagttttaaattttaatatatgagccaggacatgtagcagtggcgtgtcagaaactttagagaactggagaaagaaacaatatttagtttttggccttactgttatatagatgccggtagatatgcaacaaggtgatatttaaaatatttagcaactggtaaggcatgaaaccaaccaatccgaaaagctggtttgtacaggctgattatcaacctactatatgagaaccaataataagataggctgaaagtagttttatataaagtagttagcattatacataaataaattattcaaggtcaaagacagctcctgtaaaacttgtaaaggagcttacaagagaaactggatagagatatatagcaattcatcttttaaaaaaatcagagtgcatatgcttgcatcatttttcatatgaaggtcatttgaaaatagaaatcattcttattactcaagacattatgctaaaagatagagaaagaacatatatggtctttgatagaacccctggcaagatgtcttgtattgaatgtgaaaaaataacggcatgataaatacataattttattccatcctactctgaaatttgctgaccggttcaaatctacaatttttgctaggggaaatcttcaagttctgattgaccttaaaaagtacttttttactcatagttggagttttttaacccatagagtcttttcttctgaatttgaattaaaaaaataaatgtcaaggggtaattacttgactcaggtaggttcttaatttaaatttaacagagactaacttgctatagaaactaatcttgattgatgttttcaactaaatagatcataaccataataaaataaaacagtatggttaatttttcaaattatcaattttagcccctgctttccccttaggcaacatctggcctgcagcttatttatgtaaataaaaagttttattggaacagtcacacccatttgcattagtttttgttttgtttggttttgctttaattatctatggctgctttcctaccaaaaagagcagagttgagttgctgccacagagaacacgtagcatataaaagcctgactataatccagccttataaaaaaaaagtttactgatacctactcaagcttggcttcctgaactcaaagtctagacctgccattttctaactttctaaccttggggtaaccttgggttaaccccaggttcttggtctgtcatattttgaggaataagtaaattattatttgtgaattatttgtaacagtgtttagcacttagcaaatactttgtaaatattagtgacttattaccaccaccacatagtctttctaacactcttcagtgcaactaattttaagaaatatacacatgagctttggttattaaatgcaattggttttccgttgaaattatgtattgctctcactggagggctatttggttatatttaacaagaaaatttaagaacattacatgtctgaatcaatgtagataattcaccttggggactgtaaatatcttgaaactctaaaggcaagttctagtgacctatctaggcagacagttgtgaagcaaaagtgatctaaaaagtataatacaatgtgaattggtcttagaaatgtctttaattataagattataatatttccataagagaaatttgtaagttgtggagtttggttttgttttgctttaattatctaagcaggctatttgataatggagaaaaatgtgattgcctgggtgtctgtacttacatccatgaactccacatttgccttgggaccagttgtctcattaagaatcttaatagccacaggaatcttcacagtttctccttcaggtacccaaataccctttggggaaaaaaatttacattaaatatgacatctcaacctattaagttcttacaaagtaacttagaagtttgatattataacattcaatcaacaaatgtttatttagcacctgttacatgttacaagttactctgcaactttgttgtctgctttcattatctgaggatgttgctcatatacatgattacatatatagaatatagaatatatatcctttcaagatgtttacactactgtcaaattctacttgtgtgcatgaaaaaggctttgaatagtgaagacagcatggaaataggatagcaaaagaatatctgatttggatggtatcatcgactttttgagatggttgctctactttttgaagctcagttgtatcatctgtaatttagaagactgggctaaggaatgttagaggttcttctcaggctgaatattatctaaatattcagcagcaagaaaaacaattaaaaaagcatattctcatgttcttcaagttcagattgatttatgaattaattttcaagaatgaatatttaagatttatttttcaaaggcaagtgctaggggatattgagcacatattaatttgtctacattattaaagcatgtgtatatgtgtgtgcgtgaaggaattttattatctctgaagaaatataaaatatttatattggccgttgttagttctcttttcctatcaaaatataattataatatctgaacaggatttatcccttgggaaagtataaagttggtagagtttgagtgaaatacaacattaagctaaataatagcatttctgggtaaagtgaattatagcatttgaatgaggacaatgattttgataagacatacaaggatgcacaggttgtacaagaatacattttaaaaggtgtattttcccaaatgaacgcaaaagcaaatatgagagcatgaggacaaaaaccgaaaaatctcaaattttagcttcttagccctgacatcagaaaatatttcttataagatttttaacattaaaatgaaagaatgaaaaataatagtttgttattcctgaacaaaacatctttacttcctgtctttcttactatcagctagttatagtcataaagaaaaaaaattcaaaaagtttttcactttgaacttttatgctacaacatatgtatttgtgttactcaaagttgcagtatcatcaggagacctgaacacaagaattattttaaaacatagtaacaataataaagaaaataaaagattttaacttttagaaagtgaatttatggttgcattcttcctaggcagaatgaatagggaaatctatgtgccaaatgcaaaataataagccaagttccttgcaaaaaattaaaaagaaaataaagcagaaacagaaaaaagaaaacagcccaatactcaaaggcttcattttctcactgatgttatctagggtggaaaacaggcttattattcattattcaataaagtaaccacagagaagattactttatgaagacatggcatcaatattaaagtatccctaaagtgtagttttaaaataatataggccaggcatggtggctcatcccaccactttgggagactgaggcaggagggtctcttgagctcaggagttcaagaccagcataggcaacatagagacattccaactctactaaaaaataaaaaaatttaaaaatgagctgagtgtgctggcacatgcctgtggtcccagctactcaggaggctgaggtgggaggatggtttgagcccaggaggttgaggctacggtgaactgtgattaaaccactgccctccaccctggcctacagagcaagaccctgtctcaagaataaatacataaataaaattaaataagaatataaattcaatgtaaagtattttatacttctttttaaaataaatatttattaaattattctttttttttcattatttcattcattatttcactattttctgggactgactagttaaaaattttactatctgatacacatgatattggtcctaatctttatacttaaacagagaatatttctaattaggagaaaaaaataatcaaataattggttaagccaatttgcacttctatggtcaagaataatcctttatagtttaagacagtatgtcttcataacaactgatctattgattaaaacttagagtcaaccatagacactttcattacaagtaatttcaattagggtaaaacactcatgcacaatagacaaataaatgctcttaatacaagttaataaagctttattattaaatgcttaaatgggtaacatttttctctgctgaggacattagatagtgtttagtcttgagttatagggtatccaaggtttaaaataaaatttaatttacagaccacattatctttaaaaatataggagtgattatactctaggaacaatgtaagattgagttatcttaaaaatggaagtacgttataatacatttaaatttttccatttatctctttttttctccctatttctgttcttcataaacacataaatttgcctacttgctttaaattttgtcaatgtcacatgcagaattggtaacaggcaggaagccctaatatttttctactgacttgtcctatggttcagcacagaagccttcagttacatctgtgaatacggagatttgtagcatttactagataattcaggtggggaaaaatcctgcaatcaatcattagaatgggaatttatggcatagctaagtgatccagaatgattgtcagtatggatcaaattcacagcagtactttcaatttgtcaatttaaataatcaagactgcaatttaggactctacatttattatccacataattcgttgatattttattgtagaaatgagtacagattaaaattattaaagatgtaaatacaattgcagtaaatagatacaaactttaaggatataaaatgatacagtctgagtctgtttttttctagcacaatctaaattgagaaacagaaacatttgtttctttgaacatatacaaatctgaagatgagaaaaggcatcaagtcagcctagaacagtgcctatgcaaagtaggtactcaaatttttgtcaaattaagatcaaatttaattgaataaaatatgcatactaaaagattagaaaacttctgcattttgaccttagaatacaagttttattttaaggatattagattattttggagcacttggagagaaaaattaaggtttatattctaattattaatattttttgttaaataaatctctgttttaaatagaaaaaaatgaatatttcaaaatgcaacatttctaagatccaattaactttaacagatatgtttgtaaaatgtaggcttacacatagctttaagaaatatattaaatgccagccgggcatggtggctcatgcctctaatcctagcactttgggaagccaaggcgggtagatcacttgtcaggagttcgagaccagcctggccaacatggtgaaacctcatctgtactaaaaatacaaaaattagccaggcatggtggtgagtgcctgtaatcccagctactggggaggttaaggcaggagaatagctggaacctgggaggaggaggttgcagtgagtggagatcacaccattgcactacagcctggccaacagagcgagactccatctcaaaaaaaaaaaaaaaaaaaaaaaaaaaaatatatatatatatatatatatatatatatatatatatatatatatatatatataaaatgccaaagtaacttttgggaattgtagtaatggatattacaagaataattcagcatttgcccagaagagtttcttaatcttgttatttaccattaaaataaatttcaccacaattaatcttgggcctagcctctgaattggtcctgtaattaaggcaaataagtaaacatacacatgccatcatttgagcttttcctttccagaaatatctcttattgaaaacacatgatgtcatcttttcctcctatctgacctcaattttgcatataatgtcacatttttagtttgcttatgatgacaaagacatcaaaaccatggaaattatttacaaaatcataaatgtaaccaagtaggcaaaaaatgatttagaagctagttccaacctattaagacatcagcatatttgaatggattctaaaaagatcagctactaggatcctgatggagaggcgttggataaaaaagcagaagagaaaaagaataaaggattatggtatattgcccaggcatgtctggggttcatggagcactgtgtaggggtaatggcaaatgggttggggcttgatagttggataaaaatagaaatttgccaaaaggaatatgacatacggggctcagaaaggtattaagaaaaaaactatacttggctttgtatcagagtttcttgcttttctctcaagactgtatccgtcccagctcattcaataaaaattaatgaattcatttgtgcagcaacttctcaatattataaaagtcttcctttctgaatattataagaaaattaggttgtctaaagtaataactccattggctattattttctaaacatctaaaacaaaacttaactaacgatatgcgttgttttttacttactttataaaccgttccaaaagcacctgagccaaggacttttaccctcttcagctcagtttctttcaaaatacgaagttgagcttgattgggtgctgtgccactgggagttaatggttccaccaactgcaaagcggaaagaagaaggttatactttcagtccgatagtcagtcctctctctctgtctctctctctctctctctctttggttctctttcttacaaagaaaaacacaccaacttggtttgccttgacaaccaataccttcgtaatatgcaccactcaccattcactgacacatttatgcattctttcagaccctgtcctttctcttctcctgctctttgtcagggcaaacacaagtaacaaatgtgcacctaccttgaggcatactaggctacgagatttgatgcattaaagaaggaaatgctgccttcttagagcttaaaatatacctgggaagccaggacaaatgtgtcagaggagaggggaaaaaaacgcacaatgccaaaaccctaggacagggctgttaaaactttagtgtatatctgaattacctcaacttcttgttaaatataggtcccggttcagcaagtctggagtaggcctgaaatgtttgcatttgcatagaactctaagggatgcctaggtaccatggtgatcctcgaacacatttgaagtaccaaggcccaagtttacctgttaaatcaatagttctaaaattctatgatttgattctgcatcataagtgaatgctatgaaatgcaaggcatcaaacaactactggggagtgaggctcactagttttgccttcctaaagaatgtacactttaaaatcaagtcttgagatgtctaagtcttgacataatgaaaatgggttggtattgggagggccactgtgaaaagctgcttgggcacagcaagagggaggaggaggaagaaatatagcagaatacaacagggagtgggactggtcagaagggtgagagtacggtgggaaacctacataatcacagggggggctgggtgtggccaaagtagtaaaattaggctgatagttttagacgtcatcattgcgttgtgattcagttagggggaatgaatgagaagggggcaagtatgtgcatgcgtgccaatcactggcatatgtgagaaaaaaaaaaagtatgtctaagagaggctctgggtaccaaaaagcctgtatcctatgttaaaattttaggtttttatctatgtatgagtaaaagggcaagtgcaagaaataggagtttctttgtcttttaaaagttaaattaaggaactaaactttacaaatagtctcttttatttttccagcataataatcaaagggtactactactcaaactgtcttgaacccaccacagtaattcaaaatctctatctccaaagctaagtgcactgtggccctgcagcttgggtatgaattaccatgcttctgtgaaaataacggcctacttaattagtggaagattcttgattgaaggtaaatgtagctatagcaagaattttaggaagaacgtaataaaaaattgccaataaacttaggttatcttcaaactcttctttaattgtgagtttgacaactcatcttcaatttcattttcaaatttaagttatataaatgtaaatttgataacatagaactgcattcaagtcacattttaaaaatctcagaaagaatcactaaattatttgttaaatttcaaaatgattgctcaactgagttcccttcatttgaaggcaactcaaccatacaggaattgttgggtagattttgatacatatgctatatgtataatgaataacttatgaatcatttttaaaaatcatatacaaaagttacataaaatcacacaaaatactgggagggggcttcagcattttgggtgagatatacataaaatatacattgtgtatatgccttggcatataccatgcaataattgcatattttgaaaacttcacagttctacctgagcttttcagtcttctttaattttcttgggtatcatttaatatatttcacaaaaacatgtttctgtatcatttaatatattttacagacacatgggtttaaatttggaggtttatatgacagtgttgccactcacaggaagcaatttgcccttcctaaacctttatttcttatctgtgaagtaggtgtagcaataattaccttagaaacttgagaaaggatgaaatgagataacatatgtggaaaattctagaacattgcctggcatattgtaagcactaaatctgttactcttcaagggatgagatcatgtctcattaatatatttttgaatcacaccatctaccaaagcatcaagcttacagtgcatctcagtaagcatgtgtggaaaaaatatgttttatagttttatgcatgtaacataaaaaagacaatctggaacaaaatgatttgaggaacgtgtaccatctttaagtgtatgcaaacaatatatcaagattcaacaaatgttcacttctgaggcagatttctagcttcagtatttaaagatttaaattgactatcttaaaaattccccctttatttagatggtggtagaaaatcatattttcttttactaagaaaaagatagggattctacgattatctaaccaccaaatgtaaaataatttagtcttaaagaataattttctataaaaacagaacctgcttataaaaccagtaagtgggccgggcacagtgactcacgcctgtaattccagcactttgggaggccgaggcaggcggatcacgaggtcaggagatcgagaccatcctggctaacactgtgaaaccctgtctctactaaaaatacaaaaaaatgagccggacgtgttggcgggcgcctgtagtcccaactactcgggaggctgagacaggagaacggcgtgaacccaggaggcggagcttgcagtgagccgagatcgcgccactgcactccagcctgagcgacagagcaagactccatctcaaaaaataaaaataaaaataaataaaaaaaataaaaaaaaaaaagtgtgtgtttatttagtaaggaaatgacggtttgaaggacattcttataaagcactgcattataaaaacaaaccaagataaagcaacacaactcttttcacggcaatgagccttccctgtgtgtggttaaggtaatttctcttccattctgcagtcacctaaatgtacactgctattccaagctttcctttccaactgtagtttacaatacttcatttccagaattctctcaccaactgcctcaagctggccatgaggaagaattctctctgcctccagcatcctagctaaactgcaaacatacatagcacaaagcacatgtgttgtgtccaaactttcattcacatgtgcaagattgaaagtaatcaaattgctcttcaataagcttccagctaaagtaggaatcactattaggttttcccatgtatgtaattgactacctttattttgcttgaacatgtctattcatgagacagctcattccaattgcagataactttattccctagaaagtgttttcctagaagcagctgtaaggtagtttccagaaactttcacaggatacttctatctagatttgatttctgggtaaaaagagctaaaatttaattcattatcggtatgcaaaatgtgtgaatgaattaaaattcccattcctcccattcctgtcagtgttcaaaggagaagtgaaattgtcagactgacaatgagaaaaacaacaaacgttggataagcttatctcagaacagaattactgtgaattgtttagataggcacagatgtgtatatcaggagaaaggtaagatggaagttgagaagggtctggtaattcatagtcttctgtaattgtttcttccctgtatcctgtaccatgaacactatctgcttttatgctagagaactcagtgtagcaatataaaagacattataatcattcatgagtaatttacatactcacaataactaccatgcataatattaaatgcatcccataaattgtgtagtaaggtctgtgtgattacaacactaagttttatcctgtaagcttagtctttcactgctggtataatgagatcattgactactaatttaatgatcctaattaaaacatgcattccttgtctgttagttttgttttgaaacagaaagactctctctctttctaacatttttctaaatctgccactgagatattcttttttttttttaattattatactttaagttttagggcacatgtgcacaacgtgcaggttagttacatatgtatacatgtgccatgttggtgtgctgcacccattaactcatcatttaacattaggtatatctcctaatgctatccctccccacttgcctcaccccacaacaggccccggtgtgtgatgttccccttcctgtgtccatgtgttctcattgttcaattcccacctatgagtgagaacatgcggtgtttggttttattgtccttgcgatagtttgctgagaatgatggtttccagcttcatccatgtccctacaaagaacatgaactcatcattttttatggctgcatagtattccatggtgtatatgtgccacattttcctaatccagtctatcattgctggacatttggcttggttccaagtctttgctattgtgaatagtgccgcaataaacatacatgtgcatgtgtctttatagcagcatgatttataatcctttgggtatatacccagtaatgggatggctggatcaaatggtatttctagttccagatcgctgaggaatcaccacactgacttccacaatggttgaactagtttacagtcccaccaacagtgtaaaagtgttcctatttctccacatcctctccagcacctgttgtttcctgactttttaatgatcgccattctaactggtgtgaaatggtatctcattgtggttttgatttgcatttctctgatggccagtgatgatgagcattttttcatgtgtcttttggctgcatgaatgtcttcttttgagaaatgtctgttcatatactttgcacactttttgatggggttgtttgttttttttcttctaaatttgtttgagttcattttagattctggatattagccctttgtcagatgagtagattgtaaaaattttgtccctgtttttagatgacatgactgtatatctagaaaacccaatcatatcagcccccaaatctccttcagctgataggcaacttcagcaaagtctcaggatacaaaatcaatgtgcaaaaatcacaagcattcttatacaccaataacagacaaacagagagccaaatcatgagggaactcccattcacaattgcttcaaagagaataaaatacctaggaatccaacttacaagggacgtgaaggacctcttcaaggagatctacaaaccactgctcaatgaaataaaagaggacacaaacaaatggaagaacattccatgctcatgggtaggaagaatcaatatcgtgaaaatggccatcctgcccaaggtaatttatagattcaatgccatccccatcaagctaccaatgactttcttcacagaattggaaaaaactactttaaaattcatatggaaccaaaaaagagcccgcattgccaagtcaatcctaagctaaaagaacaaagctggaggcatcacgctacctgacttcaaactacactacaaggctgcggtaacccaaacagcatggtactggtaccaaaacagagatatagaccaatggaacagaacagagccctcagaaataatgccgcctatctacaactatttgatctttgacaaacctgacaaaaacaagaaatggggaaaggattccctatttaataaatggtgctgggaaaactggctagccatatgtagaaatctgaaactggatgccttccttacaccttatacaaaaattaattcaagatggattaaagatttaaatgttagacctaaaaccataaaaaacctagaagaaaacttaggcaataccattcaggacataggcatgggcaaggacttcatgtctaaaacaccaaaagcaatggcaaccaaagccaaaattgacaaatgggatctaattaaactaaagagcttctgcacagcaaaagaaactaccaacagagtgaacaggcaacctacagaatgagatattttcaatgcagatattttctagatctgctgctattgagatatcctctatccagagcttgctaatgggatcctcccaaccatacaaacaaaatacagatactttccccaatacaataattttcttgaccactcccatctacccccttgaagccttgactatttttacaacataatctgatttttcacaagctttgtttaacggactataaaataaaaaacttaattaggacactgaacagaattttacttggattaaataattgaacatcatctaaaccttctaaacctgatgaaaatccccaaacacatgaagaggagaaagaaatacctcacctctgtttccaagaatcttctcaaggctcttttctttttgatgctcttccttctaacataaacagcaaatgtcagacccacaatgaccagaatgaagagcccaccaattactccagctgcaatcaggggagttctgacaaccagaatgagaaaaaaaaaaataaaaagtatgaagagagagaagacagaggaagagaaaagagcagttgtacaagacattatccacatttcacaaatctagtcatttagatgaaatgcaaatataaaagtgcattaggttttgctctaccaaaacctttctcatggtaaaaactatggttgtttttgtgtgtttaacaaataataaaccatgcatgtacaactaatctttgagatgaacagtcacaacatgccatttgatgaaaaaaatgtaaaacttgctagcagtatgaaaaacatatgccaagacattggtgttggcgcatttaatatttttctattatatatgaataaacaggaaatgcattgtaagaatattgttgtggtttgtaattttatttccagtaatttctctgaagcaggctttcacaacagtggcactattgacatttgaggctgaataccagtttgttgtcgcgaagtgtcctgtgcattttaggatgtttagtagcattcctggcttccatccctgagatgccagtagcacccccatcctctagtcatgacaatgtctccagacattcccaaagatctgtcaacatcacccccagttaggaagcactgctctaatgcaaaaatgagtggtctgaagacatagaaaccccacacctctggagtataagggtaccaataagagagttattattgcccaaagtgctatttgaaactctgattagggcaactctggtagaaaaaaggtcaggagaaagataaagaattggttcagacatgttttcagaataatgacaagagtattagaatcaatagtgtgtctcagcatcatacactcataaaagaggtttgcacatgaagcattacataaaaagtggtaaacagtaccaaaaagggattaagaagagattgattggaaatcttcattcttaaaatgtttttgtaatgtattgttagcaaagatataattttgaaactgatcacttcttagctaattttttccttgcttaaacagtagtagttgtgatttttaacttgttctagagtagagcagtatctctgaagtttccgtggtcagagttcttaatcatatgaattttgtataccataggaaataatcttgagtgaaacacacaggtgttacctaaaaaatatttgaccaggaagccacaatggatatcaaaactaaaaaagaacttcctgcctgctcatgctttccataataaagcattttatatcttatatttatatttttaaaagaacttatactacattttcttaaaaaatactttctcttgctaaataaacttctgctcagagatagatcagaaatagtatggtggatgattctcaataaaatcttgaaattttaaaaagctcataaaaaaaatctgcgtaacttcttctataaatgaaatcatgtcttttagagattatgactgctatattgtcatataaaactgcagaaaaatctaaaaaggtagttcatcctaaaggttgtttcctgacagctcaaagtactatagtatactgaaatgttgctataattcagctagatttttctaaatgggattttctaaagatataaaaatctctgctgagaaaattaaactatagtatggaaaaaaattcttcattgtgatatgtttttgtttgtgtaagatcatatttttgatcatgcaagttaaatatgtatttcaggaaatattttatgtttcaaccaaaggtataatttttagctcaaatgcttaacatatccctgaaaagtcactgttattgaaagggtcatatttttgttttctcagtccaattttttatcgcaaaatatttatgtataattgagactaatgtccaacatttcgttaattgtagattcagaccaaactctaaactttctctgcttatttattttgcaaaataataggtggtatacatatttatgtaaatatatgtaaacgtcaatgtcactgtatatgaaaagaaaacgctctattttgttttttgtttgtttctttgtttgttgttgttgttattttttaagaacaaacttccaggagaagaaactaatacctctcttttttcttattttggtggagattgattgccatataattactatacaggcaagtaatggtaatcaaaataagacattcaaaaactcaagacagtaatttctggttttatagttagaatttactttcagtattttctcacagcaatatttttggtctacttgaatttctttactgttttcttaccactctgcaggaacggtagaggtacaaacaacctgaaggaataaagaactaaaatttctgtacttaaaaatcatatataagtgttttattgaacattataagaggccaaattctgcctattcccacagaatttacgtttgaaacataaatcattaaccacaaacaagcaaccagtaaaatcaagaggagggaatattccataagacaacttgcagtttctttttattaattgagtatcatgaaaaaggtgctgatgtagcttaagaagacttaatagacatagcaactggatataaaatgtactcctgcattagatcctagtttggacaaaccagttatagagtctttttggaaaacttgaaagatctaaatataaattatatagtagatgagaagataatttgctgcaacacaaagacgtgcaccacaaactgaaaagattcggtttccaaacagtagaacttcaatatgaaaaaatacatattcatatatgtctacaaatatatcctcagatgcatagatctggaataatataaaataatatactaaatagtagttgtctctgggtagtgtgaatacagtgctcttatttttactaatttgtattttctaattttttttttttttttttttaaattcactagggtttttctctctttgacatttaaacaagaacacaaagtaaacaggaaatacaatttccaatgtcttttaaagataatgtttttatataagttgtgtgttctcactagttttttcttcttgaggtaatgtattaattaatcacaatctgctcttataattttgacattcactttaaaactccaaagggaagatgtgattaggtattaaaattatcttaaacaatattaaaagatagacatataggaacctctatattccaggccaaactacctaagcaaaagaaagattttgatgttagtagaaaatatttgcaaactatacatctaacaaaggtcaaatatccagaatatgcaagaaacttgaggccgggccagtggctcacgcctgtaatccccacaccttgggaggccaaggcaggtggattgcctgaagtcaggagttctagaccagcctggccaacatggcgaaaccccatctctactaaaaatacaaaaatcagctgggcgtggtggcatgcacctgtaaatccagccactccagaggccgaggcaggagaatcgcctgaacccaggaagtgaaggttgcaatgagtattttctaattttttatgatccatttatattccttttgaaataaaagtttattaaattcaagaaaaatgcagaagaaaaaatcattgtctaaaagtttagctttgtaataatggccttgttctctttttcttgaatgtttactttgcttttttttcaattaagatttcattttgttattccctgtccacttttacaatctaagtacttttgtgtatattttctattcattatagtttgatatgtctgagacatttgattactattatgtttcttacagttaacattatgtaccataaaccaagataatctgaaaagttaatactattttcacatttcttactcctctgaatttttatgattcctagatgtttgtaagtataggatagatatctttttcttgtttgtttttttcctgagaatttatgcttagctccttttatgaggaccctttgggtagagaggaaatagcaacctaagttacttctttaaatggctgtgcatctctccttggtctaatgatgataatggctattaccaaccaacctgtttctgagcgtgaatgtgatttattttatttttattttttagatggagtcttgctctgttgttgcccaggctggagtgcagtggtgtgatcttggctcacagcaacctccacctcccaggttcaagtgattctcctgcctcagcttctggaggagctgggattacaggtgactgccaccatgcccaattaatttttgtaattttagtagagatggggtttcaccatgttggccagtctggtctcctcacctcatgtgatctgcccgccttggcctccaaaagtgctgggattacaggcatgagccaccactccaggccttgaatgtgaatcttgtatgtgaatcagcggaagcgataagaggctcagttgacactatgagatcacaaggttcaaatactaagggatctagaatactctgattccttatctttaacaggagtattgcaatttttttgtcttgtcttttggctgtccattaaaaatggttgagaccccctaaagtataaatttctaagatcaagtccaagcttagactaaaaggatacgatcaattgatagtttaccttattctgtgacttggaaatagtattatgaaactgatatcctcccactactgaagaaactaatctcacagggattctgaatcacaaacgaattttgctaatttatttaaaagcaaatgatttggttttcataatttcatttagaaattcagagacaatgaaatggattaaattctactgacttgaatgcaattgttttataaaagagcagcatctttccaagctatattactcatctaaaatatgtatattcttaattactatatttggaccatgctatttctctcatgcagaatataaaatgtgagaggacacatgaaaccttagttttaaaaacatccggatattttctcccattgatcagtttcttttcagatgtcagaccacaaaaaaaatgtaataaagtcaatataattcatgattaaaactcaaatgttttaaaaaactattttgttatactctttctatttaatgttataaggactggctatcttttaaaaaggaacaatagtattttcttaattggcgaaactggtattttgatgcatattgcaataaatgttaattctatgattctacctttttttaaaggtaagttcgtcaccaaataaaaggtttattaaattttgaatatatgtgtattttctttacttttttgaatacagaataattttcaactaaagataaaacaacctgtagtcctataaaacactgatggtatacttgcaattcatagtattgactatgaatcaaagactttcacttttagaagcttttagattaaactaaataatttgaagaaaggtcttcaggatttgttgcatcagatgtagacctgcttcacttgcttatctatgggcactaaatgttaaactgaaaatgcgtgtgtgtgtttttttaaaaaaaaagtatataagaaggaaaaacaaacaaagacaggctagtcagataaatttaacagggatttttttttgtaaaataaactttgcaaattgcaaaacatggtaaaacagtatctccaacattactactttgtgttaatctttcaaattctgtatgacttttccttattgtggcagaaagatgctttggagccaggcaaatctaagttttaatcatatgtctacttctaaccaattgtgagtttactgcctctatcaaatagcttaaatatacacaaatacattctttacctaagctagtacaaaaaataaatgcagaaggaaattatatagtcatgtttacattcatagtatctaatgaatttgcttcaagatcatttctagcattatcattaaatcaaacaccttgaagtttaggaattattcatcccattttggccaggacggtcttagtttatgccagtctaataatcaataatgccacttttactctccaaagtgcctctatgtgagcaataaatcaaatgtttatcctacatttagcccaatctaaaggaatttaggatacccagagttaataagtatttatctatatctctatattaaaatgtgtatgttggggtatgtgtgtatgtgtatataggatcgaaaaaacttcagtttacctctatgaaagggaataattctatgaaatctgacatcttcatttttagtagattatttcccatcaaaaataaatgcattgctaatgacactctgttgtgctataaaacccatgagtatgtgtaggtgtgtgcatatatacacattcacacgaaagtgtcttagttttattttcagcaagttttactttctgggaaagtaaattaattactgcattttatgaatgtatatgtaacttaaatgtatatttcacaaactagggtcaaatgttacaattctctataaagttatatttcattttaaaaatataattaggtaacattggccatcatcctatatcctatctttcttctgaaaatcttacagtggctacagatgaaagcataagtctatcatgacccagaggacaaatgtatgctcaggggtatattctgttttgtaaagtgttcttgctgtaagaaaaatgtagttgatcaaaaacctattgactctctattaaaatcaaattcttataattcattcacaattaccaactgaggcaaggaatatagctttgaaaacaataacgttttcaatattttcttaattatgtatataatttaaacatagcaaaaggtctgtttccataagagaaagacaagatttgacagccatcagattctcacaggttttatagcacacagggtgtcactagcaatgcacttattttcaatgggaaataatctaataaaaatgaaaatgtcatattttcttagaaatcattccctttcatagaggtaaaccaaaggcttttttgatcctatatactacttttaaatttaaatcatttagctccactgaatgtgaactttccattctaataatttccaatacttgtatattttataattagaatttaacttttacatacattgtatagtttcacaataacgatgtaacacatatcttgtaaactccatattaaatacaagaaaatagaaaagatgcctggataacatcaaatataaatagtaatgctaacattttatgtattggagtctcaagtccattaaactttcacctattgtattttttctctttctaaagatgatatatttacacaaatatcattattcaggttttgcttcaatatctatgcttgatagtagagaatacaaaatgcacataaatttatttaggggttttcatagaacttttatatttagttatatcttaatattttacttctctttcgactatcattttatctgtattgctatattcattgtgatttacttttattaaatcctttatatccttgggtgtaaagtttataagtgacattcttcttcttttagcttcattttgttttcaaagtgagaaaacagttaaaatggttttcttttttttttaacttatatgggatttcctttaagaaaggtaaagacgagcagtatctattattacagtgacagtacctattgtactgctactctgttcagccttccccaaaacagttcagatttgaaacaagagaccttgaaacaccaggaaacattgaaattccccagaagacattttaagggttactgcctggggcaaggagagctacattaagggagttctttttctcctacaagtagtgcttattctgacccagaattcaacctgctttataaacatgacacatcttttctttttgagcaaatgaaagtgatcttacagtttttggttgacgagacctggggtattacaataggtctctgtcctttgattaaggctcaagattcctctattacatttcaaatatgaccaaaactgtaagtgctgaagctaatgaatcagaacgtactgtcccccttcctaagcaaatttgaatgttttttgactcggctttatgtgttaaaatcaatctttttttcaatatgtgaatgcaacatttcattcgataacacagtgttgcaaaagtacttcagtagagatattgccattaaatgaatatgtaaatataatctgatccttttatatctagatcagcttctgagaaaaaatttcaagtagtttcagagcaaaccttccttctctttacaggcaacatttacacatatctatgggcttttgtttgttttatcaaattttggggaagtacataaacttatacacttgactttctggcaaacattctcatgttaaggacaccatcctcagaatatatataatctatctaggaatttctacacccaggattttctacaactaaagtgttgaaaacgaattacgccaggaagaactttccttttaacagggtttttaagaggtcagatgaagttttggtgcttttattaattcttccacagtttatacctattatacaatatcatatatctatataccatactaatacagtaactttattattgtttatatactgttatctagatagaatatatataaggacatgttttgtgacacaaacagaatattgtaaatatttaattacagaacaaattaaccgttaagtatcactatgtcctattacttattcattatatggacaaggtaatatgaagcaatagagcaaaagatttaaatgtccaggattcagttcttacaacttcagttacattaggtaccaaaattgttcagcatgctaagtaatttaagtttcataatagagcagaaagtattacataaacactgctctgtgaagaaaagtgggagagggataaatcatggctggcaccattcttgttcccatatttaaaaagttttcttcgccttaaaatctccattcattctatgcactataatttcagataattagttgttaacagagaatatattctatgtataaattgcacctacctttatctatcgaagcattaagcatacacatttctgtcatgcttattgtacacaactacataagacagatacagagcaatctcattttcagagggtttgcaaactttttttttgagaaggagtcttactctgttccccaggcaggagtacagtggcgccatcttggctcactgcaacctccacctccggagttcaagcgactctcctgacttagcctcccaaatagctgagattacaggcacccccccaccatgcccagctaatgtttgtatttttagtagagacagggtttcaccatgttggccaggctggtctcgaactcctgacctcaggtgatctgcccgcctcggccttccaaagtgctgggattatagctgtgagccaccaagtctagccttgaaaacatttttaaagtaatagcctggtttgtttgtttgtttccttgatagtcaattctgtatataaagcatttttgatttttttttaactatactttagattccccaatccttgttttatactgaaagaagatttttttaaaaataaaatgctaacaaagagggattaaggaagtatctttcttgggaagtatcactactctttattcagatgatgtattttctacttacattggcctgctggtagccctttttcctgctgcggagacctacaagtgttcatcggggagttggtggccttgcagcctactgaagatttgaatgaagtgagatgggaaaagactttaagaagtgaatacagttgtgggaaaaataccaggatttttggacatctatctagagtcactggacatttcttgcaggattaatgaacaaagctccttttcctagatattttatatgtgttatgtcaaataactcttccaatataattgattattgatgtatggtgaatctgaagtaggttatacaacttgtccaaggtccgaagcattctaactggatagtcaagcctagactcttagtatatttttctctaaatcctttttccattaaaatataattatgcggttatattaggaaaattattctggtagaaagttgtaagatagataagcaggaaaaagaaaagatatgcaagaaaattagtttagctgactgttttaaaagtcctcatgagtaatagtgaaagacagattaggaaagtttaaaaggagatatggtgagaaaatgtattaacagcagcaaaactgataaaaagtataacctcaacagtggagaaaaagcaggcatcaaaagtgactagactcccatgcctatgggaatataataaggccgatgatgccttaaagggacgtgcagaaatcagcagacagacaattagaagggagaagtttttagttctttttgatctatggatttgaagtgctaaagggtatccaaaatctatatcatttcattcaacttttacaatttctttacatatttgttattcttgtaatttcaagacccatacctgttgattttattaatagcttcacatttttaattaaagtgagtcacagacaacattccattccattccctttaagtttttctagtactttatttattctctaggaacattcaaaatgcaaaggaagaaaaatgtggctaaaggggctttatttcttttctacttcctctccctgtcccttttgttttgctgatagactatatcattttatgcggtttcacttatctcatcaagataaattctactgttccaatctgtttttgttcttatctttttactgaccttttgagatcatcatttgcaagaggaacaaaccttaaaaatatttaatacatttaaaaaacctgttcatagtgctatttgccttgggtaacacatgctagagccagatgccttagtaaggctacatagatctcattgctaattcttgtgccttaatgccatcccccatttggagaatttaaaatttgacattaaatattaaagcttaaagaaaattatttaattgaaaaagacaattaaacatagatactccaaaagagtccccttcatattcttttataatttggtagtttttatagaagaaaccttatgttccagatgcaaagctgtaagtactaataagtggcttcaattttattgtcatctctgtgactgacctcaattcattccattttgctatcgtggtttcaagaatatttgtttttagtacttatgtgtcttagacactactagaccaaacttgatttaggtatttataattatgctttcttggattcttttctatttcaaagtaaattataagccccatgaggttaggaccatcatttctaatttttttttttgttttatcactctaataacattgtctaagaagtttatcaataattattataaagtgaatgaaatagttaagtgggatattttaagtaataatgagttcttaaaaatgcaattcttccacttgatgtgactctttagtatttggaacaattttggaaaaagcagaatattttctttgcatttatctcttaaacagtttgtctaaaactgatcattttatttccattctcttaattcttgaattaactctcatcacatttttagtctctgtctcttcactaaatcggttcttatcaaggtcatccaatggttttcttgctgccaaatcaaaaagtaatttcttagagctaatcttaatcaacctggtggtagattttcatataaatgatcagttcccttttcttgaaacactgtcctcccttgaaagccatcctttccctagtttcttccctgtctggtcagtccttttcactcattttctgctatttgctccgtgttaccctgacctctaaatataggaaagcctcaggactcaatcattggatttctttactttcctacttatgccctagacaggatgtaccatccatctctttatctatgtaatgataagcaagcatattcagagattaaaggtaaaataaaagaatttctatttttataagctcaaacataagtcctttaagtgctagaattttgccacaaacactttcatatgttttagagtctagtttattgtctcatgaaaagaagtactaaatagctgttacatgaagaaataactggatgaaagtttacttccataaatacttacaaactttttatcttaaatcaacccttgaaagcacatatatccaacaacaatctcagagctccctatatgtttttaaacttaacaaaagcataattctaaaatatctttaatggaaagaaaatgagaagagttatttatgtaaggcttctctgaaatgaagctgatacgtgtttaacatttgcttattccagctttcgtagtaattggtaaaataatattttctcctaaaagcagtgaaactaatcctgagacaagttatttttctttgctggttttagtttagtttatccctcaccctcaccacactgcgtccaagtcccaggctgactgaagcaacagttgttcctactccattacccctaacacactagtgatttttaaaacgttaagtaacaacttcctcagtctctctgcatcttggtgtaaacatacaacaaaattcttgccaatgaaatgaaagcaaaggttgaccatagggaattctggaaaagaacaggtagagctgatgaagcctatccctctacttctgtccttggatctaatgcttagagctgtggcactcagtgtactatcaaaacagaaagataataaaatgatatacgttctggtcctgttgttactgatccatgaaacccatggcaacagctatgccatttctagactactgttatgaaatagaataacacctaaaactattgggtgaagccattactttttttacttgtaggcaaggaagatactaactgaaaagttcgtatgaaaagtgactatgtccaaatttttcacttttccttttttcttgcattttaactgtcaaatgcatcatctcaagatatttgcatttttaaaaacataaatgaagtcaatggccctttcctttcttgttaacacttactatctctggtgcttctattacatctgcttcatcatcctactcttctggtcattgactaggctttacgtgtatcagacttttctgaatgcttacattggagggggacaggggtgggaggaagtgcctcacacatttgtaagtaacactaagtagaagcttgtagagcttcctcaaggatgctgtctctgaattgtggaattatatgtgctgtaatagacaggatattatgtgtcatccatttccaagcagtaataaaattcaaaagtagtaaatgtttcctgaacttacacacctcaagcaaatatgtactgaaagatcaataaagagaacatgaagaaacacaggtcttcattagcatttaatttggcaaaacaagaacatccaagttttctaatttctggatccatagtagattggaagtaacccaaggaaaaaatgagagggtgagactgtttctgcctccacaggggacttggcgaaaagacaaacaaaccctcctttcacagaggcttttggtcattgcaccccattttaaattatgtttttaacttagaattgattagtttttatattctaagaggaggtttattgtgactgaattcacaaaaacacatttgaaagcatttaataacaatgtttagtaatataactcctttctaaacttatataaacacccaacccctaattagaacacatttctaattatggggaaacccatttttttcaaaagctattgcctaggcgatgttatgattcggcagatgctctgaatacagattcacagcctccagataatgtaagagaaaaaaaaaatcgaacctaagcatttcaaacaacattgaaataatataatgccaagacaactttatactttgcctgaaaccatttcatttacatgcaaaataaatcattactactaaggaaaaaacccacatctacatgaaacattctcctccaagctagaatattaattttccaatctgttctttactttttattattaaaattgtgtatactattaacaatcagccatatgtaatgctatgtattgtttatggacatccagcagaagatcttttaaaatctctttgttttgtaaatggtcataagaaaataatctaaaagtaatttggaataaacataacgcttcccttttaaatttgctaaatgaagtatatctatagactttcttcttttcagtctttaaagctttcagattgcatatctttatttttgcatttagaaaattatctaagcaaatgacttatctttacttacaatcatgccaattgagtttatgcaaaatctaagtttttcttagagccacgggggaggagagtaagagatagcagttattgggtcctaaattcaccctctggcactgagttagttgctggaaaacactaacatctcttcttgagtatttattgggatcactaagtaagtatgttagtatttagctatttgcaaacagtcaaaaacaaacgactctagagaacaaaagtgtaaatttaagatgctatgcaatgggtactttctcataaaattcatgccagttatcctttattatcaagtaaggacatctgcagtaacttaaagagaaaaagagagacagagacagagagagagaaagacagagagggagaagccctcacaatctattcttagtgttttataaaaggattaggcattgctatgactaagttattctataaatattatttataatttcaaaactatataggatcaaagccatcctgtgaattgtttatatatatatattcttattcctccataaaaataaatgatgttgaaatattacagatacatatatctatagctgaccatctaggattacttgaaaccaattaataaatcaacagactttggaaaagttaattaaacttctttatccatcaagatctctgtataacatgattaatggcatcataaatgaaactataaactcattagaagaaatttctaagttattcagtctttggcaacttttggtgaaaaacttgcagccgtactttgatggaacctgtctaattttagaaaggtatgaaagataatgatctgttacaaatttatgtattttataatgacactataattcaaatgtttttaaactcacattgtaacttctgtaatatttaatgtgttttctatttgactttttgaatagcaattcacatatatgaataagaaacttgaatattttcatgtattttaattaatccctagctaaacatacttttttaatgccagatacacacacatatatatgttatttattttataatttgtaaaaggcaaaaacgtaggaatagcctatctttcaatagggagttggtggtaaactgatactagggaatactaggcaatcataaaaaaggggtaatgtctgttgatctggaaggctgtccataaagtactattaagtgagtaaagtaagttattgaataatgtgtagagtatgctccctaatctgtaaagaaaaacccttattatcgtatatatgtattagtatgtagagaaatgtgtggaaggactaatacatagacataacatatacatttctatttaatactctaagcatgtattacttttgtaattttaaattttattaaaaatatattttaaaaaagaattaatcttaaaaaacagaaagagggaaaaaagaaaaatacctaaaatatgatgagctggtgagctttaactatcaggatgatgaattctacatttacttgctttggatttaaaagaaaggcatatgggacaaatcactaagaccagaaccattgcttgaagataaatttagttacataagtacattcagaagccaaagaaattttatttgtaagggaattccatcataatttcttatttgaaagcatataaaaactgaaataggaaaaatatttcatgatgtactgatttactagtaatctgtacttgcacagctgcataactgctgatgtttgtagtaatgatgtgatttggagtaattgttatatatcagcattttgcaattaacgcaacaggtattgaaatttgttaatgtctcagaacacatacaggatgctgttagattctgattatgtatttaacagtcttctaatttaatgagtctagagtcactgagagcaaaccacaacctgctattttccatgcaaaagcaaaatagggtgaccttcaagttagaaacatgtaaagcaacacattgcaaattattgatgatttgtggattaatgtcagaatattttaaatgcaaaaattagcccagtttatatttggatttaatattccagaccatctgtctcctcatacctgtacgtctcctccctttgggcaaaatgatttcatctacaatctcaaagagaatttagaattttacataaactcaaccttttcttaccaaagttatacatttatctgtatctttatcctgtaattattttctctcaataaaataatgaaggagggagacttctctaagactaatcctttcatatgttcttttcctcttaactcttcttttttttcaggaaactgttataattaataatctcttctctctcctgtatctccaacctctcacactctataaaatcttccaaaacagactcaaaatttcacccattctcaaaatatctttctcttgatattattcccagtccaactatttcccagtctctctctcttctctctcatctacatttctcaaaagatatcaacacttggagaaacttccatatctgtatattaaatttcccatttagcatcactgaatatgtcaaagtcactgcaaattcaacacatccgaaactaaacacaggatgactaatttagcacccttctactgtgagaaatctcagttaatgttacccccatccatccaactttgcaagccagaagcctagaaaaaaatgattaacagtttcttatcccaattccttcatatccagttaatcactaagtatggtattacattttaagttctaaatattttttgaatcttaacacttctctccattcactcgaatttctggctccccaattccctgattacttattccaatagttttagccagccattcacattgataatactaaatatttacattaccaacaaacgattaagttagaaggtcaatacttgcttcccaatcagcatatggactcactcccttctagaacattttctttacttggcgtccagggcttcaccttacctgatttcctcctacctccattcagtctgtctcaatttcctttgccgtactatacctttctcttctgttctgctcatacaaattatggagtattctaaggcttgtgcagttttccatctacactttctacatatggaatctcatttaatgtaatgaatttaaatatgcttgatgacccagactcctcccttgagctccacagtattatatttatttgcctatgcaaaatcttcactcaaatatcaaataaacgtctccaatttgttataccttaacagaattttttattttcctcataaaatttgttccattttcttttgagtcttctccatctcagtttatgacatcattcttagccagttactcaggacaaaaacccaggtgtcattggttgtatttttcttttcttaccatctgcatatcacatactcatttataatttccctcataataaataatcatgcatgtaaataatattaatgtaaatgcatgtaaataatattaaataatattttctctttccctacacaatggattttatgatattaggaattacgttaacttttctctctattctttcctcagtatcttagccaacatttgacatgtagtaaatacaatgaatatttactggctgcatattgtgaaataacatatatggaggagggtttgtgttttgttctgttttctcctgttaaaaacaaataaaatatggtatgtttgactgtatcaacagtgggaagaatttttcttgggagaaatcactttttaccgaaacaaccagagccagatgatacacaatctaagattcataacctatcacctaaaatcgttactacttccaatcaatttttcccaatcccataaatcctacagtatgatctagtgacaacaaggaagtggctgccaaagtccagcactatattgtcttttattttattttagtgtccatgaaatttgaattcttacttgtacttttgatgagggaggctggggatggtagcattaatgcaattaggaacaggtgaaagttgttctcatacgaaaccacaactttgtttttcaaatctctgcagaattttaaaataactctcacttaagaaaatattttttaaaactgtgcctatgtttgttcatatatgtcttagattagtttatctgatgtatttaaaaagttacattatctacaattataggagtacacgcttagatcatggaatttattggtccaggataaaatactctgtgtgagaactgcattataaaatcctacacagaagtaggcttaatagctaaaaattaaaactaagagaaagacattgagcgatttttttgtaaattgctgaatgactctaagtctgtttcatcatttatgaatggcaatagtgactactgtttttatatgcttgtcataaatattcaatgtcacagtgtagcatacctgatatagatacatattaggattttctaaaggtggcaaaaacaagctcctagctaaatataagattttggaaaagacatcagtactctgagaaagaaataaaaaactgatgttttggttttccctttggtcctttctttcctggtgtgtagaacaatatagctattctctctgggatttgaactctcggatttcggggtcagagattgaacaaaggagttgctttgtaaatttatcttgctctgttcaggaaaaaacatggtgtttttccctcaacaagtaaattttttatggtaaaaggtttttgttgttattttatttttactctactaaaagtaactataattattccataaatgactcaagcatatggaacactttactctgagcagaagaacagaatgctataaaacttacatggctacaagcattcagagtttattagaggtgaggttccctttccttatcattcattctttagtactgagttactgcaaaattacaatgaaattacacctctttgggtttaagggtagatgatggcagagaaggaaatcactgtaatggaattttgttgataaatcaaagcactctctgctaattagctcctgcctatatacatagtacagaagaataattgtatgtttatgaaaaaatgattaattagggaatgtgctgaggtaataagaaaaaggcatgaagagagcaatttgaattaatatctacacatcattttatgtaaccacatcacagaagggggtctcagttaattatattcccctagttagatagaaaatatgaaaaaaggtacttacttaggatctaatacaatatatgcctaaattacatggtgaaataaattcaactcttttctaaatatatggcaggcataaaaacagaaactttgatctctacttaagaaatctttttggttaagtattgttcatttataaaaactgaaacaatgttttaattaaaatatgggctataaaacaaatttaagatctatgaaatataattccaaccctttgagtaattttcaattttaaaagtaggtcatactgggaattctaaatgcagactcaaattatcataatttagtcttctcctatagaagtttataagatctgtgtgcacatataaatatacaggtatatgcaatgggttcaggcaaacagatgtttttcctcgaatctgtctaactcatcccatctgtaacccattgaagctgatgaaataaacacccttctgtgaatatgcaatatcattccctctactattcttattttgtgtaaaactattaccaaaattgaatattaaatcaaagtttcatgatgactgggctggagcagtgcagtccaatagatctataatacaagctaaataagtgattgaaagtattctagcagacatatttaagaagatgaaattaattgtatttatttacccaatatacccatattattaacatttcaacgtgtcactgatataacacattattaataagatattttatattccctttttcatactagtcttcacaatccagtgtactttttacaattacatagaatctcaatttgctttaactgcactgaaagtgcttaatggccatacgtgactagtggttaccatattggacagtgcaggtctagagcaatcttgagagagacttacaggtctgatgacttaatgaaaaggccacaaattttatattaaccagggagtactttaatcaggattctgtttgtgaggtactgcacaataatgcagcatgagcacctggaaccaacatggacactgagaccttaccttacagtatataaatgtacaaagagaaccctggttttagttccaagataataccttattgcttgctctagggcctttgaggacaagaatatgataatacattatttgaagatagtttaaccaattgatctctcatacatagatgtgcctttatatggcaaagttgcatgacacacagaataataatcaagtttccttcaggacaagaaaaaataagaatggcaccgtcggaaatattatatgctcaagtacccagggtaggcagatgtgctagacagaaatcaaaaattgctcccaggattacagccactgaaatatacacatacctttcccacttatttaaattctaacccaggtgctgatgtgaaaggattttgcagatgtaattaaggtcccaaatttcttgacctgaagatagaaagacaatcagcaagggcctgacttaattccatgagccttcatatctgggtctattggtcagagagacaaaatctaggagattcaaagaataagacggatctgaaacactgttgctgggttttgaagatggtgggggtggggtgggaagggctggttcatgacaaggaatacacatggctggctaagagtcagcaataacttgggagcctcagttctacaacttcaaggaacttggttctgccaacaacctgaatgaacttggtagtggactccaagctctagatgagaacacaggtcagacagcaccttgatttcagcctggtgagaagataaggaaaaaacccagctatgccatgcctgtaattttacctgtggaactgtgttttgttttgtttgtttattatacttcaagttctattttattatactgtaagtcactcagtgagtttgagtataatattaacattttagggtctctagaagctttggtaacaatgtctgagcattttgctatcaaggtaaaagccacttttgcaactttgtgacgctaaatacttctgttaaagtaaccactttaactgtatgaacagtaattaacaactgagctgagacgttttgctcttcccctataattctgtgataaccttggtattttatggctactgggaagttgggacaaaagtcatgtggaaaagaagagattcacacactctccttcacctcttcaaactctctttaattccaaagtaaatttaatataaagaacttagtggactgaggatagacttataataaagggctgtgtgcttttatttattggacttaaggatcataatacaactgccactcatctaaggtaacgatctatggatgattttgactgtttgatttggacatgagttatgaacttaagttccttgggggcaaaacaaacaaggaaaaaaaaatgtgccaattgtgaaagtggtgccaagaatatcatatcatctctctcatatatcacacatgggtcacactgctaaaggattaaactgttatgtgacctgttacttaataaccactataccataaagtaaaagtatgacacaggcattaaaatgtgacaagaatataaaatgtttcaaatagctgcccaaaggagatttagatagttaaactgagtcaaattactttactttatattgtgaagcacctagaataattgaattggagcaagtaactagataaaaatgcttgatatctagctgttttaatgatttcacaaatttgaagagttattagtcagttaacacatggactgctaactaacacaaagaaatgttttgccaatggaaacttgacttattgagattaacaaatttcagccctaatagaataggagactgagattaaaagaaataaacaaacaaacaaaaaaaaatctttggatatatatttgacaaagaatctaaaatggattagaatcaaatattctattctatcagaatctatatgaaaatagcatgtatgcaagctaaaataaataatatacagaaaagaatgaaaaagtcttgctaaacatattttttataggattcttgatggaaaagaaaaaccaccaaaggcaaatactatttttaaggcacttaattcaaataaggtaagtagggagaggttctaaaatatcaagtattattttcattataagcagcatattctaggagactaaaggtaaaaaaagaaattctattctatcttatccaatcttcctgaaagaaattccagcagcagcctataatgtaaatgaagtgtggaaaccaactaatacattgtaggcttgggaaagaataacattgcttagaaaatgaaagttgatcaagactggaaacatttcacctgctttcatttaaatcttcccccccgccccccgcacccgcccccccccacgcccgccccgctggtttgggaaacagaatacaatataatggggtggaaggactatgaacactaaatattttgaaatggccacattgacatgctcaatgtaattttctgtgactaaaaataaactaggcatttggataatccgccagttaaaatatggtttaagaaactcaaaacaattattttcttttttgggggggtttgagggggacagtgtcttgctctatcccccaggctggagtgtagtgacacgacctcggctcactgtaacctctgcctcccaggttcaagagattctcctgcctcagcctcttgagtagctgggactacaggcatgttccaccacgcccggctaattttttgtatttttagtagagatggggtttcaccgtgttagccaggcttgtctcgttcgcctgaccttgtgatctgcccgcctcggcctcccaaagtgctgggattacaggtatgagccaccgcgccctgcccaaaacaactattttcatttgtagtttttgtcctcctattatgtaagattcacttcaatcaattgacagatgctttgaaaaactatgatgacatttaaaaatattattaaattagcgctctgctttcagtgaaatacacacccacctcatctcagagaggtaagcatttgttgcaatactgaagacctgaaaaagcagacacttgttactttcacatcttacccaatctgcatcaaaatgttccatgatcatacacacttttgcaaagcatccaggctaaatccttcatgtaaatgtcaaactttctcataaacatcccctcacaagtcaattgattctgacaagtcaatgcaagtgaagaatggagtcacactgcattatatttaagttctaaataggcgttaatgaaagatatctagagtttcctaaaaggaacaattaactattgctatgaattattttaaattattgtacttagaagtttggtataacattgaaatgcttaaaacctgagtaattttgatatatcaatcctgtagtcactaacctactggattaacgccctgttgatatgtaaattactaacttcgtgaggttttcaaagtgattattatgccaacatttcaactggagcagtaagtaccaccaataaacataagctgtatgctggctattgtgcattatttaatcttcacaccaatcttaagggttataagaattctcagtttcaaaatgaccattataattcccattttacagataaaaaacatcatggagccaatatttgaacctagacattcaagaacccctgctttttacctatattgtgggctacaggtgattcttcttaagaatgatgggctgtactttctgtattatctacaaacagtgactggccatggtcacctatttatgataaggctaatctgaattaggtgttttagtctgagattactggaatctcagagtgaatatgtcctggaaaccgaagcaggcaaaaggattgagaattccaatcatgcttttgtttaaattttgaaaatattaaatctataacaagatacactatgattttgagttaaataacctcaattacaagcattaaggactataagtgatctatcagtgtggttttaacctttctctgcctctacatatcagccaatgacctaccataattagtatcagtggccaacattgtaattgagattctcaaggtgaagagagagaaatgctctctcttccttcaaggggcccatcaaaagggctttaggtacagatcaaagctcctggtgtggctttaaagacctctctccttcccccgggaagcacgttctctcaccctcaaggtttgagaatttttgatgtacagaaagataataaataataacacttattgagtgatttctaagccaggcactgttctaaggacacactcaatcttacaatttatgaactatattagtattcccattttatgcatgaagaaagtgaggctcagataatttaaggaacttacccacagtcacacatctaaaaatggtagagcctggctctgaactcagaaaatctgattctaaagacggaacacttaaccactgtactatattacccctaactagtccactggaataactacataattataagaaaatcatcaaagcaaatgtgaaaactgttctagctgataatgcagttgctctgccagggtctcaagaaggaaaatttctttcataaatataggaacaatctaagatgaaccctggcttataaaactatagtttaggccttcggcactctctccctctctctaattttttcataattttaccttgctcgaaataactagactaactagtcttgattgtgcccaagtgtcacagtgccactgttgtagaaatcaatttactctagcacatgcttcgctttctttttagaatttaatttttctattcattaaaaatgatatattaagatgacatatttattttaaaaacatgtaaaggcaataacatatgaatgaagaaattatgactaaattcagtgacacagatttgaatctcataaatataatatttcacaaaagaagccagatgcatagaatacaaactgtatgactaaatttatataaagtgaaaaaccaggcaatctgacctatggtattaccatttaggacagtggctacccttggaatgaggtacaaggtagcttccagggctctgttgccatcttgtttcttgatctggtaaatggcaacacaaatgtttcatttttggaaattcactgagctttacaattatgttttgtgtactttcacactatatacgcttcaatacaagagtttacattaaaagcaagtattcttcatccaaaattcccattttgttaactttagtactaccttctctctcctaaaaggatgagatttattatttcataaataaagctaacaatatctctacataagatggtaatgttatataggaaatattttatgagatattttaaaagtcaggttgattgaagtataatttatatacagtaaaacatacagttctataatttttgataagcacatgcttttgtacaaccatcgccatgatcaagatagaagaatagttccattatctcctcaaattatctccttcccttttccagtcaaccttatcctccgatctccagctcttggcaacatttctgtcctgatggtttcaccttttccagaatgccatgtgaatggaatcatgcagtatgtattttttttaagtctggtttctttcacttggtgtaatatatttgagatccatccatggtgttgggtgtatcagcagtttgttcctttttattctattgctcagtagtgttacaatatatagatatgccacaactgaagaacatttgagtagtttccaattttgggtgattatgaaaaagccactacaaacattagtacataggtttttgtgtgggaatgagtcttacgttttgtttttaaattccaagttatacttttacctgcacaaaatattttctatattgcctttatgttaattcttatacctagagaatatgccaaccacttaaaaataatataaaatcagaaattgaattaaattaaataataaacttctgcaaattccttacttataaatatttttgtaatcatctattgaattaagagcaaaaaatattctattaaaggtatatattaataactcaaaatcctgtttagactacacaaattaaaaatcgaggccgggcacagtggctcacacttgtaatcccagtactttgggaggccgaggcaggcagattgcctgaggtcaggagtttgagaccagcctggccaacatggtgaaaacccatctctactaaaaatacaaaaattagccaggcatggtggtgggcacttgtaatcccagctactcgggaggctgaggcaggagaatcacttgaacccaggaggtggaggttgcagtgagccaagatcatgccattgcactccagcctgggcaacagagtgagactcggtctccaaaaaaaaaaaaaagaaatcgatggtgttactaactgggactcttgtatcacaatgaatgaaggaaaaagaagtaagaaagttggcttgagaaggaaagtgttttatgcctctttcaaaactttccaatttgatatattatgagttacaatatattataaatttaacccaactggttagtactttttgttcatgataactaggaaaggatttgagcgacaaaatggaaacatggtagatgttacctagcatgttgtggtaaagtggaatggcccgtccatgggtagtaaatgcagtcatgactagtgggaccgttacacctgcaggcaattacagaacagaaaacatcattctccatccacagtgacatgcacacacatgcaccagtgctcacacatggagccttggaggaagaacatgggaagcaagcacaccaagtacctatccatcaggccgatgcagtcttcaatacttgagcctatgcacctgcagaaaatgcaaatttaaaaaaatacaaggggaaaaaattagtcatttaaaaaatcagtaaaataaatattgattgtctcgaattcttataactattagactattttggaacacaatgaatttcaagccaggaagatttttgcttgatgaatacacagaaatgaattgccattatcaactaagtgggatgcaaagaaatgtccaaagtaaaaggaaattttacactggttctgtgaataacttccaaacgcacagctcacttctaatactttgaactgatatgcatcatacatgattacatgtctcaacaaatatgttgatatttcaatgactataattgttttcttgtgtatggtttcttcttaaaggccttaagtttaaataaaaaaaaaacaataagaaaaccatgagcaatccaatatcatataataacctgatgctcaatgctcattaaaggttgattttggcagaaaatgagtcaacatgctttaatgctattctcatggatactttacataatcacattattctgattcttggttgtgcctgtctttaaaagatacttatcttaaacatgaatttattttaaaagaaaattaactggtttcaccatactgcagtttctcttgacactgtcttttaaaatagcaatgccataacaggtaaacaaaaacaagtttttaaactaccataataatgaacgcaaacaataacagataaatatatactatgtaaggaaatgaattacctttgagacccagttaagtaaagaatacagtgagactaacatttaaatggaattacataagtacacagaattctaatgtgcagtccctagaatttcattttgaaccaatatagaattattatttctttcatcttccaatatactcgaactctttatcttttccttttctcccatcaaagacatacagctccagaacattatcaagatcctttttatagttaggatttatagaagtgccttatttcgctggtaataaagattacatatatttccaaacttttaattttcaaatttgaaaaagcagcttaagataggatcatcatacaatgatgtaaaaaggtgccaatgtataaggccagtctatccattatatatttaaataactctaaacattggtgaactaatataatatacctataataccaattaagtcacttatctctctgtctcataaacatttgttataacattcctgctagcttaaaaattgatttttgtttttgtttggagtagcgcagacaaattttaatctatagaaatagagagaatacacctgtatgaaaagtcttttaaaaagcaactaaaaaggaaaaaaactagagtacatagcattaaattagtattatatataatctatagtcaaaatcatttctaaaaatggaaaattaactactaaaaaagcttccaatttgtcttatatagttttcttttcattatattccaaataacttgttttttcctaagttcctgctctatcttcttgaaaattatttttatgccatattatcattttgtaaaattaaaagtctgcttatcagttccaagtgagaatctaaaaagctatggctagtttgcaatccatctttataacaacccttgaaagattaaaaaaaattcaaaactaaaatttaacttgagggaaaagtgtgaatatgaaagatactcattcattaaaaaaagcactgtgttacatgtctactaagtgttcctagtattctaggagctagagggagaaaaaaagatgaattagacatttttctgttctcaatgagctatgaatttaatgaaggagacagatgcataaacagatgtgtattgaataatgtgataaatgtaataagaaacatgaaaaagtggttcatggtagtgtggagggcagacacctagagccaacctagaagggcatgataaccctcttaggggaggtaagaagctgaaatttagagttctgcaaactggggttggggtggcggtggcttctgcaggagcaaaagcacagacctgaagaaatgtattgtatatacaaaacaactacaaataattcttagtagttggagagcaaaacatgaggcaataggaagaggggaaaaaagaagttagaacattaggtgggagccagattttgagaaatatttgcttagtaacaatcaataaaaaatcactgtagggctttaaagaagtagtgaagttgctagattagtattttcagtaaatctcctagctctgtggatactagtcagctggcagccaggccgactcatttggcacaaagactattttagtccacgtaagagatgatggaccaaactagggaaatggtaactgtgttggaggcagaagaacagattcaagaaatacctcaaaagatagagggaataaaaaagagcagttgattcatgaaagtgaaatgatcaaaggagttaaagaagacttacatttctagctttgctaatagtggtactatccttgagagaatccaagaagatgaatatgtttcttcctgtatgtgttaggggatgaggagttgataatttcagttttgtgtatctagaatttagtatggctgtcctacatctaggtagaaatgtttatcagcagttggaaagatgagtggttaacggggaaagaaggcatgagtataatgatcaatcttgaaatagcatgtaggagaaagttgaaaccatgtaagtgaatagatggctaaagaagatataaaaagtaagaaaagcagaggctgaagatggaaacccaaggaaccccaacagtatatgacataagatgagttctttgtgccagaagcatgggaaaatataattgagtaaaaccaattaactgtagtctcatggaagtcaaatcagaaaagaacttcaagaaagaggcggtgatcatcagtgtgaaaggcagagaagtctggtaaaataactcttaagataattttacttgtcattgtcatggtcactagaatttaggtttttgtgagttgagaagcaaattggagatagaaaaatagaggctggggaaagagcggggagggactgagggagcaggatgtagggtcaagaaaagttgttgaggggattgtgtaggatatttgagattcaaacctatttttaaactgagaatgaaagaaaaaaatgaaagacaaagaaaaataagagtatgactgaagtggcaccattctttctaaatacaagccgctgaaaactaaaatatgtatattgtttttcaactctttgtattttctgtaagcaactaattagtatatgcaatttgcatccattcagccagatcacagaacaacagaaacacaaaacttttgaagagccaaaatcacaaataaataactgaatcaaaatctagaatagtagaattataaaaaaaagtgtttcaaagtggaatacttatagaaaattagaaaaataaaacacatgtctaattaacaaattccaaaacaatatctaaagttctgaatattaaactgtgtttaacctttgttagtactaatgacttataagttccttgatgtactcatttaaccaacatagtttagatattttgataaaatctttaaattttgaaataaaaatgaaggaaatttttaaaaattctccattaaaagattatagacaaaacttccacaagcagcccttctttccctctcttgatgtataaaaattatttcattatatcagtttaagaatattttaaaaatggataaaaagattaaggtacggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgggactccgtctcaaaaaaaaaaaaaaaaaaaaaaaaaaaaaaaaaaaaaaaaaaaagattaaggtacatgtgacatttaataatataaaatcattattctaatatcaacaaaaacatgcaatgagatttttaaaaagatgttccataaaataaccatttcattccaagtctaaaatgcaggtttggtttgatacaaaaccaaagttaaacggacattaaatgagcacatactcaagtgatattagtgaggaaaaaaatcatccttgccctccccacaatttaattacattggttaagtttacaaatctttaaaaaaattctatcttgctaatttcaaatctgaacatcattcctaagttttaaattcttgcttatcatttcaaaatactgtggagaagggtctggtctctaacagaggatataaattaaataatataaatttactggactgtgagttcattgaggtcagaagctgtgtcttgttcatttctgaattttcctatcactgtatgtgatgcagagcagatatccaatatacaaagctgaagagtgaataaactaagaaaaggctgttaaaataaaaattatctagtcaaggtaagaagagacaaacttgttgttttcatggatattagtgagaatcttctgataaggagtaaatagatgacctattttaaaagtgtctagagagcttgttagagccattatatttaatgtacttttagagtagtaaaagtgcttttaaagtatgacacaggtaactttattttcagaaaaatcattaaacagtattcaaagtaagaactttaattctaaaaaatgtggtttgaaagactattttcattaatgtggttcttgaattatctgacatcatataggcatataaaagaaaaggtgttttccaaagtagaactggcctggtgagctcacacttactgataggtcgattattacatgtgtttaggaataaaaatagttacttgctccatcatcctcactgcccctgtggttttcccaggaaaatatcatatctctatatgctcaatttggaaagaagggactgactgcacagaacaccttattgcttcagtaaaatatctcaaagcataatgttgaactgcaatagaatttatatgaggatttaggaatttaggaatcacatccttcaggaattcctgggactagaatactctgggactagaaccacagcatttttatgaagtgagtgaatctggacaatatgaaggtgttttaaaaacaggatggcagaaagctaaatgaaaacagagacaaaaatccttcaggattaagtcagtcattagagaatgcatttaccttggaagatgccagggagtacaatattcaaattctgtctcaacttaattctgcggctgcaaattgctaaaggtgtcttttttctgttcacttggagttcccaaatgctctggtgagatttcttccccattacaccttcatccttccttttgactgagatccagattttgttgctaccataaactaatctcttttcattgcctcatatttctacttcccccactatatatgtttattattattatataataatgatttaaaagggcagagaggaagacacaccagccatgcatccagactatggctctgtgatctcactttcatttctctaatggcctcattgtaattagatttgcaaaaacagcaaaaggtctcattttgaatggcaacagctgttgacatcaacattatattgaataatttactggtttaattttagctgcaaaacaataaaattctcttgtggatgattttagcaggcaaagttttctctttctgttgctgactctttcttctgctccagcagaaccagttgtttttttttgtgaaatactcttaactcaagtatgccaaaaactcacaaggggagcagtttattacctctagtttccttgaagcaaagtgtctatgtgactatttcagtaccctaaatgtatacgtgcttatatgtgaaccaatgaattggcaattaccacttccaaggtgaatttgaatttgaatggcagaatattactttaccttttgaggatctgtcacttcacagagtgagttaagcttatttcttgacctgcaggaaattgtagcaacatctgcaaattgatgttttcttggcaggaaatgatgtcgcttgcttaatttcttcagtatcccccaacagctatcccttaatctgacagaaaatctgtttatggaatctcacactttcctgccagatataaagtacccaagctgattctcaactacaaatgtgtgtgtgtgtgtgtgtgtgtgtgtgtctgtatgcgtctgtgtgtgtgtgtttatatgtgtatgtgcacatgcctataggcattcacaatggagaaaaggctttatgggcagtaggaggatggcaaatgtaacactgctttcaattacaaattattcaccttccggaggaatgaaaaggaaaaatccttactaaaatagacttgttgtctcttaagaaatacttgttggaatttgttagatgaatgacattatttcttttacagttcagtgcttttcttctttctgtaatgtgtctttgttattcaactgttatcaatatcaaaggtaatctaattattattcattgcacaatgtattcttttgaaaaagagaaaaaaaatttaccaagcttcagattgccctatatcagtcaaagaaattcaaggctaaaggattacctgtaacaaggttactttcacaaaatgtactcattttttaaatatacatatcactaggttccctttttccctgccattgttacctttgttcatattttttgaaggagtaatttaaggtagtatttatcaaagagaaatatcctcaccttaagcttattgtgacaacaaagaaacagaaatagaaaacttcctttaaagatttgataaacacaaacctcaaaagcatgattactgtcctatcttttctgagatcttgaatctccaatataatttcgaagaatttctaaactgcatccaaagtatacctgacactagctagcttcatgaaggtgttaatagaatggttataggtaaaatctaagcagaaatatttaagggtgtacaaagttgattccataaatcattctctcagtatttctcttaaaatcagcattttaaatataaggattagtagagttctatgagaatggtatacatttcagagatggtaccagggataaagatacatgtggataacacataccaggtgagcccttggccagcaagaatgcttacccttgggtgcagtttggatggcatgggtggcactcccgatctggatcagcatacttgaaaatgaaactgtttgccccctgtaagccatctggacatttttccacacagtttgggccatctttaaaatgagagcactttgtacagttgtcaggaccctgaaatgtgaaaacgaaaaaaaaagaaaaaagaaaagtggtgtcatttcctctggaatgtattcatgtggtttagttactgagacttcagtaggtggcaaatcttcctctaagagaattggagaacattttcagcagtgcaaatgtggatgtaatttttgtagtacaaacagtgcaaagaagatccatcaagttcagttttgatatcctgtatgtgtgaaaacactataataatgtatttgtgcttgaaatattttccttttcgacataagcagttcctgggccaactgatttccatgtcatgactctaatgtgacttaatttgatcagcaaaactgtccaatgactttctcaaaaggatgtcagtattttcttcttgtgatttatttctggcaatattatagtgcagcaatttttagtaaaacacattttccctagaggtatttcatcaccaccactgggaatatgtgaatacttttactaaatagttaatgagaaaagggatataatagaaattaactaaaactgaatttcatataagagtaggatgtaaactttcctttggttgtacaatgactttatttataaaatgaattttaaaatttgttatgataacattatcaggaattaggccgtttaggtgaataaaaataattcctagatttttctttatttcatatccactgtgaaaacactaaaagtcatattatgtctatttatagggattttagtaaatcacagaacaatactgaaagccatataaatgcacattttgatgagcaaaatagtccataataataaagcaaatacatacaaacaaaggcttcatgaagaaacttatccaaggatgaagataatataaatatgagtataataaatgcaaatagaacaaactcattctatatatttatgtttataatacacattaactttctaatatgtggaatgttaataagtgataatgatatgaaaatatatctaaaagtcatgacaatattaagatgttcaaactaaaacatatatgaattttacagaatacaaactgatttggatctggtataatggatggaaagcatactagaaatgggtatatcgtcagagcaaagaaaatttagaacactttggtaaatgctatctttcttaaaagacttccccgatgctttcatacattcagctgttctggacaacagctacctgaaatgtacttttacatctcctttttggacaccatattgtcttaaaattcctctcctctttgaccactcccctttggaacttcttcccctgacccatttctccctaaaatctggctatgtccatagggttcaacaatcattatagttcacatggaaaacaacttaaataaataagatatagtaagcatacagagagacaattctatcacatttgtagttataaacaatgagaatttggcagtcaggagttaacactaagttataaagaactagatattaggtagggattgtaaagataatgggagtaccttatatcctaaaccaggagtgtccagtgttttggcttccctgggtcacattggaagaagaattgtcttgggccacacataaaatacactaacactaatgacacctgatgagccaaaaaaaaaaaaattgcaaaaaaactcatagtgttttaagaaagtttacgaatttgtggtgggccacactcaaagctgtcctgggtgcatgtggccaatgggctgcaggttgggaaagcttgtcctacacaaatgttaatccaagagcagctagatattacaaattggttacttaaggcatcagaaaatcgagaaatacaatattttaaaatttaaaaatggaggcgtgtgaatagaagtataaagaagaaaaagtaatcaggaagagctttcaggaaatcctgagactggtggggctcaatcaagcccttgtctatttcactattttgctgtgaggctcagagctcgaaaaaaaaaaaaaaagcctataaaacctaatcctgattctacctgaggagtttgctaatggtaacttcttatttcttcccaaaaaagaatacttcacatccttccaattttaacacctgcttatgggtacttaggcacgtaatattgtctattacacagaatcatttactgtgcaagtatgctcagtaccatgacttattgtacaagacaagagacatgctgatgtcttcttgcagcacacagaataaaacctacaatgagtaaattaggcagagtctgaattaagaattaggaattattcttctaagtaatgtaaatgtatttttcttataatgtaaaatcatgtctgggtgaagtcaaaagatataaagttgtaaaagtaaaatcaagttcatatttaatatttaagtatactgtaataagataaataactttttgttctttgttttttaagcatctcttaactatagtcatgtgacacttaatgaccgggatatattctgagcaatgcatcattaggtgatttcatcattgcgcagatatcacatagtgtacctacacaaacctgtatggtgtagcctactttatacctaggccatatggtatagccttttgctcctggactacaaactgcacagcatattactgtactgaatattttaggcagtagtaatacaataataagcatgtgtgtatctaaacatatctaaatgtagaaagggtacagtaaaggcagatattataattttatggtaacaccattgcatatgtccatcactaactgaaatgttgttatgaagtgcatgactgtatttgattgtattatcatgatagaaaacctaatgtcccaggctgacataactaaaaatgtcctggcaaatctcagaaaaagaaacatactgattccccatctcatttccataataaagagacttaaagaaatatacctgtgtctaatgtttactcttctttcattatattcccaaaggctttaagaaccgaggcacaataaatgaattgatcagtgcaataatagaaaatgaaggtcaaggcaatattcttccttatccctatttctaaactacctctggagtcaataatctagacagacaactaaaggataggctgaatccttatagaagcatgacttttttttttgagtcgtcattgatgtttttctctggtagctactgtaaaagacatatttattattcaccagtgaccaattatcttctattccagtcacatgagaacattataattctcctcccaccagagataagatatggcttaatttgcacaatggaatataactagaggtgactatgagataactagtgcttaagtctccagccttctctctctggtgccatgactcacagaccccatgtagaagtggaagtgccataaattaaaagcatccctgaatggtagaccataacagggaggctcgctgccttagaacatttcccagatttccagtgtactttacaagatggatgggtgtggtggctcacatctttaatcccagcactttgggaggcctaggtgggcagatcacttgaggccagcagttcaagaccaacctgggcaacatggtgaaaccccatctctacaaaaaatataaaaattagccaggcatggtgacacatgtctgtaaacccagctactcaggaggctgaggcatgagactcgtttgtgcccaggaagcagaggttgccgtgagctgagatcacgccactgcactacagtctgggcgacagagtgagtctcaaaaaaaaaaaaaaaaaaaaaagaaaaaagaaaaaagcaaaaaacaactatgtactttacatgaaaaaaaaagaacttaaacttatttatgtaagctactgcaatatggaggttatttgttacagcagcacaacctttattaacctaaatttaacagtgttttcacttttataggaatgtatttcaaaatcagttcccttactattttttctcttcttttgctgcctctctagcctaagttttggtctcctgaaactgtctgatttcccaggcttgtctttcttctcatatttcctcctatacctttctggataggactgcctaaaagtaatgaaagtaaagcagagtgaataaaattataaaaaattaaataaaatatagaagaccaagtgtggacagacaaggacataagcgcaaaggccttcttttatttccaatctatcccttgcaagattaccgtaaatttctgtcatttttaagtaggattatattatctcattttacttatagctatcatagtccctgaaagcattttatccctattgcactgaagacattgtttcctgggggacaaaaaactgagatgtacgagaaatttacagtcagaacttctatagttgagtcacagtttcatatcctactgacgtgctgacttttggagtaactttctaatcattattggttaactttctttatattttaaagggagaaagtgatagcatgcttcagatgtaacagtgtttggtaaacataagtatatatcagtttttgtcattggggaaatattcatagatcaaaaaatgtgatttcaacagaatatatcataagatcaggaatgggatttccaaatggctttgatgacttcttcctcaatttcatcaaaacgccagtctaatggagaagcttccagaacctcttggatatcttaaatgatagatgactgttatctggcacacaaaaccatctctgactctagttgtggtcattaacatgtgggcccagaaacaggcaaaaacctaatatgaatcattaagggttgaaagaaaccaaaccatagtgggagcaatgtttgggccactggttgagctcagccatgccagtttttcaggcaccgttactgaaagatgtcgtgttcttacctgcttagcattcaaagattactgattctttaactataaataattttaaaaatcaacttttggagttctaaaaatgtatatttttataaccatctcaagttttttgaggaacaatgagtaaacaaactgcaaaaacccacaaattaggagaaattaatgaatgagttattcactagcacaattttatgcaacaggaggcatcatgaagaagagaaaaagcatggaactgataagcacattgagactggatggtaaaattgtgattccaaaggtctcaatactacagaacaattcatttaagtacattgagcaattcatttaacatctctgagattatttcctcattggaaaaatgggagtaatacctacaagacaataaaataaaatgtaggtgcaaatacctagcacagaactagctcacaaaaggccctcagtaatgtatgttaaatcattaatataaatatgatccaagataatcagattaattctgacttgattcataggtaaagtggtcactgaacttttttctcacctgaaaactaataaaggcatactgaagggacagttgttgaagtctctccttagtgaaggttagactttgctacagatggtaagcgaacatcaagttttcagacatgggattttttttatgaaattagaaaaaaatatggtgtcttactatgcaacatttaagcagattagttttttgtctataggattaggtgaactaaaagtattagttcataaatatatttgatttttctgaaaagtcacaattgcaagaaaggccaaaatattattacttgaatgtattttcattatacagtatacaatagatgaagaaaagataatgtgaaaaaattaaaatatgcaaataatgcaacttcttaatttttgagaaataattttgaatattaatgtttgaattttctaatatttaaaaacctaacaatatgtatactcatgaagcctggcacaaactaggtactaaataatatttgctgaataaatgaataagatgtttcttaaagccttgctcaaactaaaaaggttaagagaaagaaataggaaattacatgtgtgaagaaaaaaaactaatctagaaaattgtaataagatatttataggaaatatcagtgcagtggcacctgtagtgattcacaaatgaaacattaggcaagttttggcagttgctcataattttttgaaaagtgtttctgtaaatctatgtctaatatatattatgattggatctagagggcctatgatgattcccagcctattcagatgagagggccaaatccttgattattttaattatacattttgaaaagtttcagtctctcagaaagagattttttcattccatgattaatagtcaagaagttacctaaatatgttcttttttaaagactcatacagatatcccaacctgccttaacaagccattacagaaatgcacttccctgtgtttcatgacattctttacagaattcatatttctcacactgttagttaattgtatttttcatgactgtccataatggagaaagaaaatagctgcaaatgccctttgcatagttacttggagatcattacatattaaattgccttttacactttggttcttcacaccaagcaacaccacttctttttctcagaggtctaattttccaagctaatcatccttgtggtcgtcctctgaactggccaatttttccacatctttctttagataaagttccagagcagctcactggggcctaatggaagtctggagggctcaatgatatatatattttttctaagctaattaagtgctgaataagcattctggtataaaaattaatactatttaaattttcaatgaaattgtacagagcaatgtgaagctcttgtctacattcaaatgttggtctcaaattatccattgagagaggattcaataacacagataaactggaaatttgtctaaagaaggatgaaaatgatacttaggaatgaaaaatttatactgatctcattattaagaaaaactcaaatgatggaaaccaaagagaggtctaaaaaataattataattttctctctgaggctaacttcaaactatgtaaatgagacctcatccatgagaactttcctaatcctataacccctccttggattctcatagctcaattcttccctctgccatagtatttattgcactgctttagattttagtttatgagtacttgtctccttctttccactgtctttcacagtgccacaacagttaaaggattaaatgcatataaaaatgtgtgatagctttcctcaaatacaacatgaacttttacatttgcatatgtttatatgtttcttctttccagattattcttcaaagcatagctccagcatcacttctctatagcctatcttgatgtctcaatttccatcccaaagacagaattagtttttccttcatttgtgtttctataacaatttataaatatttttattatgttagtgattatgcttcaatctaattattcttttctatactgtgcaatagtccaggactactctatatcttataattccatttaactattttatattttatctggagaataaatatgtatgacatcgactttttaactattttatctctactactaaactttaagcctcttgtaggcagataaacatgtttccccatggcatcctgtaagtagctattgaatggatgaataaatgataaaataataacaaacattcatacatgatactaaataagccaacacaccacagatgtcttcaggcttaccggtccatggcatgtgaggaggccatcttccatcttctcacactgggggtcacactccacacagatggagccattctcaaactcccgaaattcactgtgaaaacatcagccacatgaggaggtgtaagcaaacaagcgtcaacttaacaaatgaagtaacatctgctaaaagtcctattggcagagtaaattctaaagtttgtttctctatgtgccaggagcatcagaaacattaagttttccattaggagaaaagataaactgcagccagatggctctccctgtcctccattgagttcaatgttagactcattctggaaacctctctcctgcaagacatattccagcaatctcaaaaaaaaaaaaagctacaaagtataactcttctgatgacacagtaaaaccatttttacctttttaaatagggctgtgcctgttttgtctttatatacaattttactcttggagaagcttttatttctaaactctgaaagaactattgtatttttcttgttgctaagttacatgaatgttcccaatccttgtccttcaaatcccaagactcttcaatttatttttggtgaaatttcaaaaactactttgattcctcttctccttttaaaatatctgccttggagaattagagaaaacatctttttatggtagatttcattttcttatattattgatctaatatcacaacatctttttgtagtctaaattctttttgaagtaattctataggtatacaataaaagacacagtttaatggtaacatcctaaaactttctaattgaaatctcctgggatggtggtcatcccttcctatatccttacatttttgtggctatttgtatattacatgttatcaacttatgaattttacaatcaatgtctatggcaaaattattatatcaataattagatatcagtcatctataatatgttaaaccaccccatcccactaaaatacaggaggataaagtactgagtacagacaatttaaaatgccatttacaaatcattaataaaatttgacgatgtttagctattttattattttgtgcttttgtgtcctgtgttactactccacaccaatagcattacagagatggcaatttttgattcattaagtgatacattaaaatatatttttacctaaagtgaagcattcacttttttctcatttgaatactgtaaagccttaataaatgaaagaagtacaatgatgagctatcttttctgccggttagtttaagactacatctattccaaggcaaaataattaagtttggttttccaaatgaatagcataaatagatggcttaattatgtatgaaatgcacatatattgagttacatggattatgcattttataaagtgagatagcagtttgttatggatcaaaccttttataaattttcttaattttaaaatcacaattacataaagacaggtgatcttttgcatgcttcactgacataaagcatacaaagtactcaacaaaggaaaccttcagaatataaaagtccaaatgaattggtatgggagggtagtaaaattataaaaataatcaaaagcattgtttgcataacaaaattatgacaattatagcacacttgagattatccactggttttggataatagtttcttgggtgattaaaagtttatggtactaaatgagggttgtagttttcatattactagaacaaaggtcacgtttttcttattcttcttctccaaaacccacttccccacacgcagagttgaggaataaaatgtatgtcataaaacaatcatggagatggcctattgcccttttcttccatagatttccatttgacaggcttctgatttttcctgctctcagaaaagatcctcctggcaatctctattacttcttctgccctttattgtgactttctccataatttctctttttctttcctgtcctctagtgattctattgtgactttgccagagtcaccctttcacttgaatcagatttaacaatttatagtctattaagtatgagctttggatagggagctttgttcccttggttttgctatgaaacatttctcacagttttgttgtatgtgttaacttagcaagtcctgtgatcaagagtgaatactctgggatctagtttttccaaatctaaaccccaggactgacactactatttctaggccttaaatacttcaacttccttaagcctcattttttaaaatatcctctgtaaaaggaaaaaataagatttcattgagaagctgcaattataaaatgtaaaaagacttagaaggagcttagtctggttccctctttgatgtttctgtgttgttcttaaactttcacaagagtttaagcatgttgacagatatgggaagttctaaagttccattgcagttacctatctttttcatttttattgcttgagcattgtagttaagagttgttgaaatacagtgatttatatgacatggatttgaatgctaatcagccagtaattgactgattttcatttttcccttcaaaaagtcctctttttaggatttcttctcttctggagccacattttttaacatatatatatttaatataatatatatataaaatataatattatatatatatatatataacaaataggctccctggattttggtaaatgtcatatttatatttgattactttcagtagtttcaaaaatggccattctatttaaccatttaatcaactcagataaatagacgaaaaagaaaataatgataacatttatggtagaaactccaacaagatcttacgcattttctcatttgataatcacaactgtcctataaagttaacaccactattattcccaattttcacataagaaaaccaatttagaatgatgagatcgtttgcccaagtttggatgtttcaactaggaagcaatgaagttgggatataaactggttcttcctcaaaggctatcataaccatcagccaatgttgaaagaaactagcccataccacaagatggaaggtgggcaatccatcactgggcaggcaagaattgcaccagtcttttacaagatacgtaagttgatcatctttcaaactagccccatgcttatggtttcctggggtgccataattactgcaaaatacattaaaaactaagttaatttaacagatttgattttataatgtaaatatgaaatatgctaaatataaaaaacagtgtggtaatcagtgtttcctcaggaaacctgtatttttcttttggttagctttcattgtttttgtagaaatgagatagaaactggtgtatacatacacatgtttataaatttcatatttctgaaaagctaaaaactgtaatattaaataaaaacaatggtgttctgggaaaaaaacaaacaaacaaaaaatcaagatgaaaaatcagataccttacgttctagcattggcttgagtcctatatagtgttgcgagttcagcccatacttaattaaaccagttccctatatttataagatgctgctattacacaaaatgatttctataatttcctctttagtattgcacatatatattcaataaacttttaatgtaatattcacttaatgaaattagtctattgtgtttcattttaatttattagtctattgtgttttgtttcatttatcaattgctgaatgcaaaagcaagcatattttgatctgaggtattttatgttcataatattgggaacaagcataaatatgattcaatgagacaagcagcaaataatttccaattcatttccaaattacaagccaaagttacctcacaaaattaaatgctaaaattttcctgaaaaatgattaaattcttatttaaaattttttatacttatgcttctaatattaatattttcccttatattttatggatggaattggttttggacatcttgcaaagaagagacatgtcaatatcattatgatctatatatttttatttttctcgtgtaaaatgcaaaattccaatgttatttattggatccagtgggataattcatgaggcacatgaggaaatgaaagaacttcaaaactatactttccaaaactattgaaaatactttcaggccgggtgcagtggctcatacctgtaatcccagcactttgggaggccgaggcaggcagatcacctgaggtcaggagttcgagactagcctgaccaacatggagaaaccctgtctctactaaaaatacaaaattagcccggcatggtggcgggcacctgtaatcccagctacttggaggctgaggcacgagaattgcttgaacctgggaggtggaggttgtggtgagctgagatcaggccattgcactccagcctgggcaacaggagcaaaacttagactcaaaaaaaataaattaaaaaaaaaaaaagaggccaggcgcagtggcttacgcctgtaatcccagcactttgggaggctgaggcaggtggatcacgaggtcaggagatcgagaccatcctggctaacacagtgaaaccccgtctctaccaaaaatacaaaaaattagccgggcgtggtggcgggcgcctgtagtcccagctactcgggaggctgaggcaggagaatggcatgaacctgggtggtggagcttgcagtgagtcgagatcgcaccactgcgctctagccaggcaacagagccagactccgtttcaaaataaaaataaaagtaaaaataaaaataaaaataaagaaagaaaatactttcagtgagcaacataagaaaatttgacttaggagcagtactaaaaatacattataacattgatgaaggacaagaatgatgcatcaaatagtatgttatgataaagtgattttatgaatatatgaaatattatgcaaccaggtacttactagcttctactactggtaatgttattattgaaataccagataaaattaaaaatacttaatttaaaatactgcttagattatctaaaacctggcagaacactttcaaaaccacttcaaatagaaactacagtggtagtttttctattgggctaagcacttgtcaaagacagaaacaagccattcctatatacaaatagacataaaagtgagtagaaaaaacaaacaaacaaaaaaaaacaaacaaacaaaaaaaaaaaaacaagaaaacttgcactccagatgaaatttatagagaagtatgagaggaaaataaaaaatattattgggatacatggagaggaagattacttataacaatccccttcataaagaaaactggaatatatttctcaattttgcttaactgtaaattgctataataagaattgtctgagtatgtttttaaaaatgcatacaatagtaaactatgtatttgaactcataatttcaaataaaattatttttccttaaaagaattcgtctatgtgttgtctcctttatgcaacaagagctctccttaaaaatcctggcctgcattttaccattttcttataattttaaaaatcagagctaggccaggtgcagtggctcacgcctgtaatcccagcactttgggaggccaaggcaggcggatcactaggttaggagttcgagaccatcctggctaacacggtgaaaccccgtctctactaaaaaatacaaaaaattagccgggcatggtggcgggcgcctgtaatcccagctacttgggaggccaaggcaggagaatggcgtgaacccaggaggcggagcttgcagtgagccgagatcgtgccgctgcactccagccagggcgacagagcgagactccgtctcaaaaaaaaaaaaaaaaaaaaaaaaatcagaactaatcagtccttcaaagctcatgaggtgaaggcaaccctagaagaagccttacccatcatagaggttacaagactctatgcagatccttcctctactgaagcggcgacacgacagacattggtctggcccaggtccccaacagccatcactggaacacagatggttgcacaccattccttcagcagctgtgaaacaccaaaatcaaggggaaataaaacagaggattgtgtcaaaacttaaaatcttcctaggtaatgctatttctaaaggagttcacttaaaagagatatatggcaaatgactttggtggcctatcccatcgtcatgtcccatcctacccacaacttcttctatattgcagagtcctagtagctgtgtttgtacagcaatcttgcatttttcataaggttaaacaaaagtgaattgcctatataaaaactattgggaggacaggtgatataaattatctgtccaagctaaagaataaaccacacttctctcaagccaatgctttgctccactaataaataaaatattttggcttctcagtttgagagcttcatgaagaaatagaaaacaatattgtcctgaaacaaaaaaagtattaaaagaggaagagaaagaaaaagaataatttatagagggtaagaaggggagaaaggaatagaaataaaacacaagttttctcgtttgtttttttgagacagtcttgctttgtcacccagatccaagtgcagtggcatgatcttggctcactgcaacctccacctcccgggtttaagcaattctcctgcctcagcctcctgagtagctgggattacaggctcacactaccacgcccagataatttttgtatttttagtagaaacagggtttcaccatgttggccaggctggtcttaaactcctgacctcaagtgatccactcacctcagcctcccaaagtgctgggattacagtcgtgaggcactgcgccaaccaaaatataagttttctacaggaccctgctgtattctggctaggtctaccttgctattagtcaagtcatcacatgtaaggaagaagttttgaaagaatattcagcaaattacagtgattatttatgcagaagtgtagagattaaagcagtaacaatagtctttagtgttatctctatgttatctctattttttgttgttgttgatggcagaagggccaaataatttttaaatttccacttaaggctaaccatctttgtttccctttatactgaatatcttttattcaggatattattatttatactgcatgacattattttagtgacgggagatttgatattgataagaagagccataaatacttcaaatgttatcctgagtgtctgaaagtgatttgaggtatttgaaacacaacttcatgtggttttcatgaaataataattctaaagaagattaaaacatcaaaatcaactttatctttccattagttaccaactttacttattatgagatgtaaaattttatggcaagaacatttgcgaggtgggttgggatggcactgaatatggtagtgtaatataagcagggaagtctatctgtgaaatctgtgaaagttaacttctctaacatatgcttgacagagcaaatcgcccacacctgtgatcctgactagttctgaaacagcgaaacaaatattccaattcatattttctttgttctatatcctggggttattaaaaaggcccctatggtaaactgtgtaaaaattttttaaagcagacttagatctatcaacaaatcttgctacttcttgaataatctctttcagcatagtttaagagagaaatgtgtgtgtatctgtgtctgtgtgcagcagttttattgaagtatacatagcatacaatatactgctcatacataaagtataccatttgataagtgctgacatcatgaaccacatctacaatcaagataattaatgtattcattatctccaaatgattcctcatgaccttatgtaatccttgcctcctgcaccatcctccttagacaattattggtctgctttctgttactcactgtacattagtttgcattttctataatttttaataaatgaaattatacagtatattttctgtttttatatagtttctttcatttatataattatgttgagtttcatctatgttactgcatgtatcaatagtttattcacttttattactgagtatattctattgtatggatatatgaaatttataatccattcacctattgacagacatttagactgttccattttggatgttaaaaatagtagtagtagattactatgaatatatgtgtaaaagtctttgtatgggcatacactttcttgtcctttagataaatacccaggagaggagtggctggacaatatggtaggtatatgattaactttttaagaaactgtcaaattgtttttcaaagtagttgtaccattttacattcctaccatcaatgaacacaactcaaaatttagtttccctacatcttcaccaacactgatgtggtcagtttgttcaatttcaaactatctaatttgaatgtagtagttcctgattgtggttttgattcacattttcctaatgattaaaaatgttgaatatcttttaatgtgtttatttttacatatctcgtttggtcaagtgccaccaaatcttttgcccattttaaattgtattgattgtttcttattaatgagtattgagagtcttttatatattctgcaactattttctcccaattttagccatgtctttccattcttttaatactgtcttttgaaagtagaagtttttcattttgataacttatcaaccttttttttgaatcatacttttgacatcatatctaaaaagtttttggtgtgtccaacccaggttcacaaaggtttcctctggtattttctaagttttataggtttcacaattatccatatgattcatttagagttaatttgcacatatggtactgtattagtcatggttctccagaaaaccagaaccattaagacattttatacacatcacacacacacacacacacacacacacacacacacacacacaattggctcacacaagcaggaaaactgagaagtttcaccatcttccacctgaaagctggagacctatggaagccagtggtgcagtccccatctgagtctaaaggcctgagatctgagaggactgatgataaaaattctggtccaagtccaaaggcctaagaaccagaagcatcaatgatgtaagttccattccaagagtaggagaaagatcaatgttctagctcaagtagccaagcagagagagtgaattctcccttctttcaactttttattttatttggaccctcagtgtaccagatgatgcccacccacactggtgagggcaatctgtttcacttagtataccaattcaaatgctaacctcatttagaaacatcctcacagacatgtccagaaatgatatttaaaaaaatatctggtcaacccactccccagttaggttgatatataaaatgaacaatcacaggtactatgtaaggatctattcagtttttgtatatggatattcaatatttccagtatcatttgttgaaaagatatcctttctgtatgaaatttgcatatttataagaaataagttgttcatacatttctggttctctactctcttccatctatttctctctcatagtatttttccataattttacttttaatgtacttgtgcttttatatttgaagtccatgtcttgtaagcagcaatcattgaggcttgtttttctttattccaatctgataatctctgccctttaattagggtgtttaaaccatttacatttaatgtaataattgaaataattaagttgaaataatttatcttagttttttttttcctgttggtccattctgttctcttcctccttttcttcttttctcttatgttttggataaattgattattaaaatgattttattttatttctatttatgtttttctgcatatgtggcttatgagctctacaacttttgattcactattttatcttttgggtttataatataaatattttaaatttaatattttattctgaaataattgtatattaatgtgtagttgtaagtaatgatacagagagataccgtgttatagatacccagttttatctcataagatcttaaaaagtttatagtacagtaacacaaccggacattggcattgatataggcaaaatacagatttcctcatagcaagaatccttaattttgtacttgtatcttcacactgacttgtctcccaccttccctttaaacttacccattagagctccattgctgcaacctctaatctcttctccattactataatttggtaattttaaaatttatataaatggaattgtacagtatgtaatttttcataattggcatttttgtcaattagaatacatatgcagagattcatccaggttgttgtgtttattgtttgtttctttttattgaccatagtatttcatagtatgggttactacaatttgtttatctatttacccatgaaaggatatttgggttgtttccagtttggagctactacaattagggctactataaacatttgtgtatatgattttgcataaatataattttcatttttctgtaataaattctcgggagttaattgctgggttatatggtagtaacactttagtcagggtttttttttttttaagaaagtagcaaactattttctagagtgattgtaccattttacactctcaccaaccatgtattcattattacatttctctgcatcttctcccacatttgatttcattactctttttattttagccattctgataggtgtagtaatatctcattgtgttttaaatttagatttccataaaatggctaataatgtcaaacatttttaatatgcttatttttcatttatatactctccagagaaatgtttcttcgtatttttgaccactgtaattagatttcgtttatttatttatttgctatttagtgctactttttgttctttatatattccatctatctatgaaaccattcctataaactttataatactaataagggaagatgggagggggagaaatgaaaataaaccaagtggccggacacggtggctcatgcctataatcccagcattttgagaggccaaagctggtggatcatctgaagtcaggagtttgagaccagcatggccaacatgatgaaacccgatctctactaaaaatacaaaattagctgggcatggtgttgcatgcctctaatcccagttactcagaaggctgaagagggagaatcgcttgaaaccgggaggtggaggtttcagtgagccaagattgcaccattgcactccagcctgggcaacaagagtgaaactcaatctcaaaataaaataaaaaaagaaaagaaaagaaaagaagaaaagaaaagaaaccaagcttgcaggacacacatcattagtaattaatgtagctttctattggacctgcttcctcatagttgtttgcttttgtctcagagtcatgcagaccctgttacaagattatagttctccttaactgctctatagctaactatttgaacattatgaaacattaggttttgccttaagatgttctttcatgtcctgcatgccagagaaatcactgatgccagctggtctgaaggaccccactgatgccaactggtctgaaggaccctatgaggagatgactcaccaaagaatggagtttccacatcctgatgacttcatccttcttactctgaccaaccagtggtcatagttttccagccccttgctcttaaaaaccccagcccagaattctcagggagacaaatttgagggtttcctcccatctcctcactaggttgccctgcaatcattaaactgtttctctgctgcaaaccctgctgtctcagaatatttgtatattactgtacagcaggcataagaagatatcggttctgtaacaactatctgatttgaatatctcctctcctaatctgtagcttatactttcattcttatcttaggatattttacagagcaaatgtttttaattttgatgaagttgaatttatcattttgttttttatggattgttctttgcatgcaaactctaaattcttttcacctaactctaaatccctaatgatttctccattttttacctcaaaattttatagctttatattttacatttaatctcatgacctgttttgaaagttaatgtttttataagatgtgagatgtagcttagggttcgtttatttgctctatagatgttcatttgctctggcactatttgctttaaaggctacccttcctctaattaattgcttttgcacctttgtaaaaaatatattgggtatatttgtgtcagttatttctgagtttgttttattgatctgtgtattatcctctaccaataacacacagccttaattatggcagctatgtaataattcttgaaaatatgtggactgaatattcccatttcatttgtttcttttccaaaattgttttagttggactaacttgtttgcctttccatacaaattgtataataatcttgtctctatctcaacaaacctttttgatattttgataagaattgtactaaagctgtatatcagtttagggagaattgacatctttatgattttgagctattcaatacaggaacacagtaggcttttgcatttatttacacctgctttgatttctttcatcagtattttgtagttttcagcatacaagtcctgtatatgttttgttaaatttacaccaaagtatttcatcttttaagtaattataaatagtattatagttttaatttctatgtccccatgttaattacatgtattcagatacaattaaactttgtaagttttatcttctatcctataatcatgctgaatttgcttatttattttaggaggtttttgtagattttttgaaattttttatgtacataatcatgccatctgtgaatagagagattttttttccttttcaatctatatgctttttcatttcttgccttatttgctaggtagaactttcaatactatgttaaatgagtgataagagaggtctttcttttcttgttcccaatctagtgcaaaagccttcagcttttcaccattaagcataatgttagctgtaggatttttgtagatggtcttcatgaaggggagaaacttactctgaatttctatttttttctgagatttttaaacagaaacaagtgttaaaattttcaaatgctttttctgtatcaattgacatgataatgaattttttcttccttgggctgttaatatattacatttttgattatcaaatattgtgccaatcgtatatccctggaataaactcatttggttatgttgtataattctttgtatatattgctgactgctatttgctactactttgctaaggagttttgcctctagattcttttttttttttttttttttttttttttttttgagatggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagcctctagattctttagagatacattggcctttagttttatttctttttggagggggtattctttcttcatttatgaatactaatattcaaagccatcatgaaaaacaggaatgatcatggattttataggtgggcagagtcacagagagtgtaagctgcccaagaccacaagagttgggttaaaacccaatactgggctgggcgtggtggctcatgcctgtaatcccagcactttgggaggccaaggtgggtggatcacgaggtcaggagatcgagaccatcctgggctaacatggtgaaaccccatctctacttaaaaaaaaaaaagtacaaaaagttagccaggcgtggtggtgggcgcctgtagtcccagttacttgggaggctgaggcagaagaatggcgtgaacccaggaggcggagcttgcagtgagccgagatcgcaccactgcactccagcctgggtgacagagcaagactccgtctcaaaaaaaaaaaaaaaaagacaagaaaaaacgaaaaaagaaccctcccacaatattgcctagtatctatcactcagtggagatgaaaatgtgaactccataccctgccttctctgacatcacatggaagggagattggcctggtgagagtagaagtctacactctcctctcttttgcgagcttgactgaagtttgtttgtttgttatttttagcattgtatgtttgtttgttgtttttagcattgtatgtttgtttgttgtttttctgtggtgtttggctggagtggagcaattattgtctaaaaggtttctgtcttgtctacctgcccctttccagattctttgagtagaaagaacaggcttttgttggggcttttttttatctgcatctgttggggattctgagttgccagtttcttcatcttgaaatctgggatatatgcagcaaaaagaaaactcagagaactcacctctgcattgttctttgggttccaagatctcacacctgtctgtctcttctgtccacctttcagagttgtcttataatgtccagggtttttatttgtacttagcgggaggaaaaggtaaaagtatgtttcctccatcttcacagaagcaaaatcccagtatatatctttaatttattacaggctgttttcaagttatactctaccacttcacatctattctaaggatcttaaaatcggatgcttttatttcttcattccttacctttgagctattatcatacatcttactttcccatgttattcactccacattacattgttactattttcgatttagcatgacatcgtatttgaagacaactaaataataagatgaaaattttatatattcatccatgtagttaccatttctggtgctcctcagcctatgtacagatccacatttccatctggtattatttcctcctgtctgaaggacttcctttaatatttcttacagcgcagttgtctctctgtgctgctttcctctctggtattgtctgtcaactctagctgcattattctgcctggactcctagctctgtcttctcaacctggagttcttgggactctgcctgggatctccctcattatactgtggcttaaaatctctctcaaggcacttagccagagcagtcataaggctcacctcatttattttctcactctcaggaatcactttcccttgtgttctgctctccagtctattgcaaactattgtttcatctattttgtcctttttttgattgtttcatgaggcagggtaaattcgatccctcccttttgttatttcatctttgtcagaagtgaacatcttatatttacttttaacaatgcaaagtgggattacttgctgtttcttgtttacagacaaaatttttcacataaaatttctcccaaatgatccaaaaaagctgctaagcacccactaagcttcatttaaaactatatattcttctattctaattaactttgtagttattttaaataacataaagagaatttttaaagataatctgaaagaacagagactaaatggaatgctttcctgtgtagataggattgaccctatgcttaaatatattataaattattttaggtaactcatagtttgcaggttttacttaattgtggttttctccatgtcttaaatatttattaaaatgaaatatcatatattatgacattttatcttcttatcatatctagactctcttcccctgaaaagctgaatgatttgatgttttgcttgggaatggcttatcaacagtttctctgttatattaattttgaaccaatagcaatagtgcttatttctttctgatttagtcataatacagaggaagaggtttctctcattccacaaaagaaatgtcagcataaatggaatctgtttgtttgaaacagtgtttcactctgttgccctggctggagtggagtggtgtgatatgggctcactgtagccttgacctcctgcgctcaagtgatccttccaccttagcctcccaagtagcttggactaaaggtatgcaccatgacacctggctacttttttgttgttgtttttgtagagatggagtttcactacgttgcccaggctggtctcgaactctgggctcaagaaattctcccatctctgtctcccaaagtgctgggattacaggcatgaatgattgcacccagccagaaatataaccttaacataggtcttatatcaccagttcccaaaaagtagaatatgaatgacttcgcactaatttataaagatgtaaagagtaaaaagatagtttaaccaaactgattaaatataaatgggtggtcgaattctatataatagacaaagttataaaagtagcaaagatcaattatatttatgaatattaagttacaatactcattttataaccatttagacatttaaaggttacttatcaagtatctcattttctgacatatatcgttatatacagtgtttacatactcttgctaatgggataaacatgatcttcagaggaaatcctgaagagggaaagttgtattatgagaacaacttgtaaagagaagtagagaatggttaaaattatactgtacggtgtcacgagtctctccgtattgatcacttttgttttctttttttaatatgttttatcaagttctatctcaggccttcaattacagataattttatctatctatctaaaatatatatatacactttatagatatgatatataaatatatatcaatgtaatatatattatgtataatatataatatacatctaatatatattcagtgctaagttaatatagaatatagcagttgtcttaagttagtgttctaacttaactcagtttctttcttgaggacattgacaaggtcacaaacattcccttggcactgtctattttatgatattccataaacttttgggtccatttattttaccatatcacgttatttactttcaggtttgctatcttctccctcttgtcccttccccttacctctgctaaaggtgacagcactttacagtaagtggaagggtaaaggctgactgctttgatctttcgttacatgctttgacataaattggagaggaagcttcagcttcacccaaaatcttacctctcttcggctgtctaatgcctccctaagtctttatcatatgcccaatttcagagcagtttcgggtcagggaaacaatatctattggaagaaatcaataataaacaggaaaccgtcataactattttcttctcattctttccagaccaatagatgatggaagtgaagattggttgatcattttctctagagtgaaaccaaaggaagtatctccacatagcatagaacaaaaggccaaggaagccacttctttgaaattcttaagagaaaagaaattttcgatcagcaccaagaattcaacagccctctgacttcctgcagtgatagtcatgagtgaaggagtggaagggctctgcaatggcttacagttcaaaaggccattataaatctctctaaagaaactttagcaatgtagttattaggcaacctttaacttcttctgtgttttctctggaagctgcaaaatagatttttctttatctcatctgaattccagctgtctgttaaaaatttggagagataataatgtgcttagtattttgacctttaccgagaacactgaacctgctttaactaaactagagggaagctttaagtaatggattttgctacagttttacatgtgaaagtaaacagattatttcaaaaatattgaaatgtatttggacaggtattgttcatcttttttttaaaagctgagaagtactgtttagtggtcatcatagttaaggttttgtgattagacatagatttaaacccttactctgtaattacccaggtagccttgggcaattacttacatgctacttatctttaaagtgaacagtaatatcttctttcaggattgtgatgaagattagacataaaattagtagaatttttaatacagggtctgagacattaagtaaatgctcaatacatgtactcaagagaaatgtgaaggcataaaagcatatccctgtgtttattttgaaaaatatttattgagaaactactttttgctagctctgctaagagctgaggatataactgaaacatgaaatagaatacatattttgttacctcatggagtttacagctaattagaaaaacaggctgcacataaatttatgtatgcatagaaacatatgtgtgtgtgtgtgtgtgtgtgtgtgtgtgtgtgtatatatataacagattgctgagagaacatagaatacagcagttgtcttaacttagtgggcaaatggcattaggtcagcccacagaagaagggacattaaagctgaaataagaagggtaagtaagagttcttaaggcaaaggggtgggggaaaggggcaattgtaactctagccaagagagtctgaggaaggaataaggttagtgctctcagaaaactgacatgggcagcatatgggaaagtggtaccctgtaaactggtgagatggagaagggacagattgtgcaggacctagtggccatttttaggattttgtgttttggtcaaagagctgtcggaatccgttgaaaggttctaagcaggagagtaaaggacctcctatttcaaaaaatgtcacttcaatttctttgatgggattgacttgaaggtatatttgaatagttggtgacaaggagataatagcgataatagagataggcgtttgacccaaatagcgtcaatctgtactgaagagggaaggtagagctttttaatctgtgttcataaactctgtgaatgctcttagcatatgcctgccagggccagtcatctttcatgaagaatgagaatttgcctaagaggaaagcagagtgaagcaaatagaggattgagccctagtgatgttgttcgaacccctggatccaattgtgtccgaaaagctatttcttggacttctcatttctgtgagttaatacagtctctttatgcctaaagtaatctgggttggacttatatcactaaaagaatactgaaataatttcctattcatgctgtaacaaattactacaaacttcattgcttaaaaacacctacatttagtctctcatagttctggagttcagaagtccaaaatgactcttaaggggctagaatcaaggtgtcagcaaggctgattgcttctgaagtctccaggagagaatttgttccttgcctctttcagcttttaaagacccctttggcgttggcttgcagtgacattgctccaacctttgcttccatggtcccatcaccttttcctttacggtagtcaaacctccctctaccttcctcttataaagacacgtgtgattatatttgtaacccactcaaataactttaggataatcattctattttaagatctataacatctgctacgtcctttttaccatataacattcataggttctgaagatttgaatgcagtcatcctcagggggccatcattcagtctttcataagcactaaactgtcaataagctctgtgtgtaggcaaggttagacatgtgtaaagtgtaatgacattatatgacattgtaaaaaattataatgggttaacaaagaagttggggaagcagcagtggagaagtaagtgcagaaacataccccttccccatgttgaataggttaaatagatgctacacaaattgttgttaactcttatataccctagttactctatatctctgatgtgagtgggaccagagcagcaaattctgataggaggaggtgagaggcagtagtgacagcagaaataaaattttagaaagtcttaaggtttgattagaaaactgagcacaatataaaatacctctcagaagagatatgtgtcaaaaaaataaaatgaatccaaaagtattttgttgaaagtctaaagtaaataaaatttgatagtacaatacttattatagtataattacccaattactgtataaactataattaaatattccctttattttattgaatatgttattgttagtaaatgcaaaaaaaccccactatttatagaatgctttttagagttagctctttatctttttctcccaaacctatattattaaatatatggttttaagctattcaattatgaattttcctacaagggaacacagcttcagaagaaaaaaggaattgttaggatcacatgttctcaaatgtctttttgactatagaacgatgggggaataatatggggtgtgacagagtagagtttcccaaaggatttcccacaggcatctgtctcagaatgatctgctttgtattaaaaatgcagaatctaaggtttcccaccccactgtctgtgttagttccatagaaatagtgtaacaaactgccataaactaggcttcttaaaacaacagaaatttattctctcacaattctagagatcagaagtccaaaatccaggtgttcgcaggctagtttcttcttgggctctcagagggagaatgttctatggtcctcccctagcttctggtggttgccagcaatccctggcattctgggctcacctctatatcattccaatagtcgcttctgctgtcacacagctgtctttcctctgagtgggtgtatgtcttcacatggcgttctcatttgtgtgtgtccatctgtgtgtctcttctcttcttcttgtaagtacactagtcatttgatgaaggacctaccctgctccagtataagctcatcttaactttcattttaactacttgtgcaaataccctattcccaaatatggtcacattcatagataccaggggtcaggacttcagcatcttctggaggggacacaatacaactcacaacactgtctaaataagaatctctggagaactggagcctagcttttgcatttttaataattataagttttactttaaaattttgcaaccactgatgtagaggcaagtcaggttaaaatatcacccaccatttgtaataaaaactggagcctgcagtaatcctggcttttattgttgagatatcattctctcagaatttctagattacaaaatagaagggatatcatttctgtagctaattggcaagagtaactgcttattatccttttgataagaacatagtgaacattttctagcattgttagtaattagacagtgtgctgtttcaaatacaataacaaaatcttacttgaatgcttttttttttttacaaagaacagtgtattgatgtattactctagtaattttaaaaggaaaatcttagaagtataattaagattttctattttctgattactcagaagaatagcgacttcactatattcaaagttacacactttatggttcataccaagctatggtttaatgaaatctgtcgcagaattcattgatttcccaggctcccagacccaaaggatgattcttctaacttggtaggctgcattttgtttgtaaaagcacatttactcaagatagcatgggatgggttaggagtgcacaaattaaaggtgaaagtatgggagcaggagaaagtaagaaaatctgccaccttagtaatattttcttaaaataaggtaaatcttaatttataatcaaaattcattttctataatatacaacatattagaaatgacgacgatataaagtctgtttattttatagaaatccaacatttcttatgatgttatagtaagtaaaatgcttgcttctgtattttgttgttttatcacagttaccagagaaaaacaaataaaacaatatattaagcaaacactgttttattctccactgtgtgatataccttccattccctacttattaactctttggcctgcttcaattctggactcactataaagttggatgatgttgtcatccagagagttcagttattagcaattaactatagttctgaaattacctttttctagattcatgtacaatggggtggatttttctactgtcaaatttcagaaacataaaaaccagagataaatataaaaatgtgtatcctttttggcttctttgtgccaaaaaaatatattccccatcaccagatatttttcccctgagccattaatttaaacttgatattttttggaatttttaaaaatactaagtctgttacttatcataaagccaattttaaaatgttttaatttagaagagaaaaaagaaaaataaatatatttcaagggattctcaaacatatactttttatctgcttatgattttgagatcatttctaaattcttcaatgtctagcctcctgttaataacataataactaatattccttccatatctcccaatggttgatgtttttctcacaaatttttaattcaccactttaataaggtaaatttttcttctgcgtaaaaaagaaagctcttgatatttatctttcctttttatcccccaaaaggcattttttcataaagtaaaattaaatattgtatcttcacattacatgtgtatatatgaatgtctaatatataaactatttttaataggaaaataaaatgtttagtagtaacaatatctaatacatgtatagctcgctcttgctctttcttttctttctttttatttcttctttctttttatccttccttccttcctccctccttcccttcccttccttccttctttcctttctcttccttccttccctccttccccttccccccctccctccctccctccttccttccttcctttcttcctctctctctttctttctctttatctctttctttctctttctctctttcctcactttgttgcccaggctgaagtgcaatggtgtgaacttggctcaccacaacctccacctcctggattcaagtgattttcctgcctcagcctcccgagtagctgggactacaggcatgcaccaccacacctggtgaatttttgtatttttagtagagacagggtttcaccatattggccaagatgatcttgaactcctgactgcaggtgatctgcccacctcggcctcccaaagtgctaggattacaggttttagccactgtgcccagctatgtatagcactttctttgagccaggccttcaatgaggtgaatactattatctattccatttttaaaatgataaaactgaggtatagagacaataagtgatctccgtaaaggtcagatagcaaagagttctgctgagattaaaacccaggccatttggctctagagtgtgctcctgaataatatgttatatagggtatacttcagtaaatcatccaattttcttatgaaaattaatcacattttcattatttttatttttatttatatatattttttgagaaggaatcactctctgttgcccaggctggagtacagtggcgtgatcttggctcactgcaacctctgcctcctgggttcaagtaattctcctgcctcagcctccccagtagctgggactacaggcacctgccaccatgtctggctaatttttgtatttttactagagacggggtttcaccatgttggccaggctggtctcaaactcctgacctcaggtgatctgcccacctctgcctcccaaagtgctgggattacaggcgtgagccaccatgcccggccaatattttctttattttgagaggaatcacggtgaaatgaagagcctagactttgaagtcagacaggcattgggttcaaatccttaatcggattttagtagctccaaaactggaaatatcatttaactttcttaatgtatgtatactcatctgcaaatgcagatgattatactttacagggtggttgtaataactaaattaaacaatatagctaggttgagagatagagtctggcaccttttagctgatttgttagctgatcagctaaagtcaaaaaggagagatggcttgtttaataaattattttggatccatattccaatcaggaaattttaaaaatgctatgccaaaatgtcaagatgtgttaaaaatttcaatattgtttttaaagtactagatgaaaagaattgtctaaaaatacaagatcaaacaattaaaaaggaaaagaacaatctagtcacttaactatataaaaatatggtttgataaacattagtttatcaaaagacaaattattcaaattaccagtaagagaggaacttattcccaacacatttaaagaacaaaatttaatgaatttaatttgtaaatagttctttcaaatttaggagaaaaagaacaactcccaaattaaaaatgaaaaaagttcacatataaagcaatttacaagatttaaaaaaagataaattaatcatgtaaatataaaatacttcttttcttctttcagatcactgaaatttaaaaccatagatgatatccagtgatttaaaacagtggtggaaaacgttactatcccacagtgtttggaacaaggttaattgatttagtatttttggaagatgacgtggaaattagtgagaaaatttttatgtagcgtcatttacacagaaattccacatctaagtttttagcctcaggaaataattgtacactacaaaatgtttcataaactagatacacatcatggcagtagtgatgatataaaaatggaaaataatttaaaatacaattaatatggtactagtccagcatacttctataaatagctttaaaaaggaatgaggaaggtcaggcatggtggctcacacctgtaatctcagcactttgggaggccgaggcgggcggatcacctgagatcaggagttcaagaccagcctaactaacatggagaaaccccgtctctactaaaaatacaaaattaggcgtggtggcgcctgcctgtaatctcagctactagggaggctgaggcaggagaattgcttgaaccagggaggcagaggttgtcgtgggccaagatcgtgccattgcactccagcctgggaaacaagagtgagactccgtctcagaaaaaaaaaaaaaaaaaaaggggaataaggaagagctctatgctctatctattgaatgggagatgcttatactatattaagtataagatatagatggctgaatggtatttaaatagaaatggtatgatcctattcatatacgaaaatatatatttcactatccttatccatacatatgaaaaatatattcaccaataattatatataatgtagtttaaaaatatttttatatatttttgattggttttatattgaacaatgagaaaggtactattaaaattgtaaaaataaaaatatttttattttgaaaatcaataatgaatttatctcttattcatgttgggtttaacagtatctgtataaatatttttaagatgagatatataagttcaaatagaactcagattctaaaggattggtgtaatatttatctctacactgcttatatttcagtgttaaaaatttatgcttaaacattttaagaaacttcaaatgcttttataaacctactctaaaacttcttccacctaacactgtaatttggttactatcataaccacgtaaatgatagatgcccaaaatattctagcttttcatgtcccagagtttcccgcaatctcaatctcttcaaaccataaagtcagctttgaaatttttgacttaaaagagtaagattgctctagccactgttaccctttatagatgagttaactttttaaaaaatcgtcattactgttttaaatcatgctgaattccaaaaaacaccattacaaatgaaggattgccttttcattaagttcataagccaactcctagatttagataagtgtatttgatggtgactgcatgtaaatgtaggtgagcatgtaagggtgtgtatgcacggatatgttttctaggtgtgtatatatgcatgtgtgttgtatgtggaactacatacagacatgcacgctgatatgcatatatgtttaggtgttgtagtgaacatgtgcgtatgctcatgtacatcttgtgtgtgtgtgatatagcaagacagaatatctaaaaatgaaacatttacagtgcatttaaaatgaagcaagcatttagacattcccatttacaaagagtactggggattgtaaacatcagcagcatctctgaggtcaagtttacagggtaattatatttctgaaaatggaggcatatggaatttttatggatccggtgtgctgtgagactgaagtccaaattttgataaatgaatttcatgcaaaatacatttattctaagacgttaaaaatgaaaaatgatatgcttgatactatagcaccacaaaactatgtttctcctaactgcttcatttttttccccaaactgcaaagtcaattcttatgcacagaacaaaaaaaaaatatgcctatggtctgaaaagtagctaaactcaatccaagaagcataacactgaaagtttaaacacattttatattttagcttattatcattgtcattattcactctcttttggtcatttgaaatgtttagaagttttaaagaggggtgaaataacattatataatttattgaaatatccctttttcccatcttgcttccctacatttatttttttgcattttcttcttcccatttgctttttaattcaagtatagacagatatatgacatatgaatttttgtaggatttgcaaactgattaagtgcatcaaagaggaagaattttttttctgattcttttatatatttctttacattattttgaattcacagttaaatttttgaaaggtagtggtactaatttttttaaggatgtggaaggaaacgagagtatagccctgatttagggaaacattcatcaattggtattgaagaagattctatcttattgccatgaatcatctactttggggcatgtacacacacatattgtgatatggggtaagaagcttaagtattaaggaaaaagcacaacaaattttcttttaggaatcagtaatgtgtaaaaccaaggaaataacacaggccaaatgaaataatgaatatcattcaatataacatgcatattttgatacacaattagattttacatttcgtgattctatgtggaacatgagaatgagtaagaacttaagttcactcttagcaggaacctcatgttgtaatagatctcctttatttggaaatatttttaaggatcgaaaagagctaaaatataagagaattcctcacaaattataagttatattttatgaagattggtagactgagctgccttaaattatttctggaacaagatggggtcttaataaatcaattaattcactgacaactcaataaacaaattatgttggcctcttaagagtttataactttaaaaaagtcttctatttattcacacacacacacgcacacactcacacgtatacacgcacacacaaactcaatcattatttatgtgtaccctggagagatcaaagaagtaagcaaatactgtgagagcagaattttctagggttctgccttttagaatggattgattttgtgcccacaacaagaatattcatttgcaaacagttcatttgagttcggattctttttattcagtatttaccataatgagtcagatggttgtactcataatagtggcactcataggatgtaggaaagagtagtattcagtagaaaaacagggaagaattaagcataaatcaacggagtatcagtgtattcgataggaatggcatagtcatgtgcctacaaaagcattatttgcttcagagtaaataagaaattattcaatgaatcaataagtagcaaaatagatgaaaaaatgatatacatgtctacataaatgcattaataaaataaactttctttctgaaaaataaaacaccttgaacatatacttcttgaatagtagtttttacatgttagaaaaatacgtcatttttcttaccacctctaaatggcaaaactctgttattctgttatgaaactccctgaaaccaaacaacaaacagagaattcaatagggtcgatctccacaaattgattggatccttgaaatgacctgggatgccgattaaacatgtaaatgcccaggtcttacttagacctaactgaatccaaatctccacaggagggttcttaagatcaggcaagacggccgggcgcggtggctcatgcctgtaatcccagcactttgggaggccaaggtgggcggatcacgaggtcaggaaatcgggaccatcctggctaacacagcgaaaccccatctctactaaaaataccaaaaaaattagccgggcgcggcggcgggcgcctgtagtcccagctaccggaggctgaggcaggagaatggcgtgaacctgggaggcggagcttgcagtgagccgagatctcgccactgcactctagcctggggcaacagagcgagactccgtctcaaaaaaaaaaaaaaaaaaaaaaaaaaaagaaagtcacttattctgattattttataccatgttggtaattgtaacaactaccttcctttttaagggttgggataacagagcaacaattctgaccggatgttatttttaattgtttggtccaaagaagaatgggaaaaaatttaagtttctatgttttaaatgtctgagtaatgtacttactacaattttcagcttttctgttgtcccggattactattctctggttgattgtgctgaagagtgttgtccagttaatggtatgataataacacaggttgctgttgtcagtaatatagatgtttcctgcgctgatttccttcagggactggaactgtagagaggtgatgccctgttgcttgaggataagcaaggacaggccactaaggagggggaagtgagaaaacggaaccatgaaacgcattccggagtaaaataaggctgtcacattttattttaaaaagaatgttaatggtgtataaatggaaactgaatcaataaatctgtgtttagaatattgtttttacatgctatatacagtttttaaagtaataatttgacctcccaaagtaaaatttccattgcttacagttatgcatattggcagtgtatctctatttctgtgtatgtatttaccactgaaatatctgctcactatcttcccaccccaagacttaactttacattgttcaatgatgaaatcctgtattaacactaaagaagtgtttataaaacaattgttcatctactcaaaataagacattaattcctctttatgtaatagatttagacatactttcagagtatgtctaaataatttcagaaaatgattataggtatttagctttaatttatacctcagacaccaaagaactgtaataattgaggaatgtgtaagtaaggttaggagatagtaaaatgtaaagaatcaaactaaactaaaattagaaaaagaaagcaaactcagatgccttgggtatctggggaaaaggtctctaaaagttaaataacaactaccctgtttagaattgctcacatcatgcactccatacttgcaaaatactaatattactttgagtgacagaaaattgaaaaatcgaggaaactacttttattttactatagtccacatttttgtaattatttacttttttacttatttacttttttttacttatttacttttccattctctaaagaataaacatgcttccacatttcgatcagctaatgaatattattttacattttggagatcaaagctttccacttttatttatagttttaaatattctttgctgttaatatttataattattttccatggttgtcagggtgtgtgtgtgtgtttgtgtgtatgtatgctcaatgataaagactaagatgtaactctttctctcaaattttgtccccatcataactatcttgagttgttgattacaatgttagcacaatgtcttgactggcttataatatttattcaacggatagtaaaagttgtttatatacagcactttaatagattgtatctttcaactatcctttcttattaagctcctttctcctttacatttttaaaacctcctataacttttaaattttaatagtgaaattcgatgtactttttataaaacattattagaaaatcaatgatgatattaagtttggagatattttgaacttaaatagacaaatttaaaaaattcttatgcaaattgacttttaattgttcataaataagaacatcatacagatgacatcagagaaatcttttactcttataacgtgaatttaaattattgatgttataattttatcaatgtccttctaaacctgaattttttttgtccatttattaaccagcactacacgtacagtggtggacgagttcctaaaacatcagccctgtgacgtgtagttcaattatagcaccagagacaagaacagaacctcctggcacaacagcatttgtatcctatacacccaagctattaacaagtcacacaactcttatcttttaattgtgataacatctgataaaaatgaaagtttcattggattgttcacatcatgccctccatacttgcaaaatactaatattattttgagtgacagacaattgaaaaatcaaagtatgtattctgtaatacctcacaccatcatcggaggtatttttattgagcttatctttggaaataaggatggaagcatgatttccccagaatcagtaaatcaataagagtgatagttttgacttaatgcacacacaatgctcctcttgaaatctgtgagccctgcagctttaaacatatccacttacctatagagtactcttccaccaatggtcaccaggttagaaaaaacactgaagtcagtcatgtttggtggccatgactgtatgttcaggaaacctacaagtgaagagtagaaaaaataaatcagaatatcattgtcttagtattagtgctgatttttcttgaaatatggtgaaaatgtgttgaaagttgggaagtgagaaaggggtagtgaacatttctattttttaagcactctattacatatgtattcttccaagattgagtgtcctacccaataaaactgtatatgttgaaacgtttcaatgactcagtttgatttattcttataaatgcaaaaatgtagtctaactagataaagagaaaaatacagtttcaatttctctgaaatcttttacgtcttcatctgttcacttatgacatcagtgtcacccttgtattctaagacatttatatacatatctagcctttctcattagattttgcattattttacggtaagtccatgtctgattcatatctatgggtcccatattacctataagacaatgttgaacacattacatgcttaatatgtatgtgctaaataaatgctacatgttatctattttcaatagtacttcttttgaagaagtaaacagaaaaacatagtttcaaagatcagttgacacttgcaagagtcgtaatgtcaaactttcaaagatactcattttgtaattccatgggctttcaaaatgtgcataaaagctaaaaagacaccatctttaaaaataacatgagtttttacaaactaaaatctgctttgaaaattagttgctgattccaatcttatgtaactttttttgttttgttttgttttgttttttgttgttattttgaaatggagtctcactctattgccaggctggagtgcagcagcgtgatcttggctcactgcaatctccacctcctgggttcaagcaattctcctgcctcagcctcctgagcagctgggattacaggcacgcgccaccacacccagctaatttttgtatttttagtagagacagggtttctccatgttggccaggatttccatctcctgacctcatgatccacccgcctcaacctccctaagtgctgggattactggtgtgagccacgatgcccagtcaatcttgtgtaatttttaaaaaaattatattgttcatagcgcaacagttgcagtttaaaaaattacctgttatctctctgactgtccgaaagacgttcagtttctctgggtctatggcttcaattgcattgtaagggtccctagaaaatcaagaagagatgtagccaaatttaaattttactaaaggattgaaaatatgagaaatgtgacaatattttattcaaatttaattttaattagcagtaggggtgttatcaatgcatgtttaaattaatctgtgctagatgtggaggaggaataataggtgttttgtggaaatttttgatgtcacaaaatatgagattttcatcaaagcctattccagatctataagattattcagcttcaactattctgatgaaattcccaaagacagcaagctcatgtatgaaccattttacattattttgttttaaaagtttattcttgatttggaagaatatatatagtctagaaatacattatattatagtgagaacaactggcatttccgctcctcaaagaagtatacattgctattagtacctggaattcgtaagaaggacagaaacaaacacaaataaaattgacatcttttttttctgtagctctacatttatctacttgtgaattttcataatatttataacattgtccagaagtctctcttcatacagattacttagaaccatcttgttcctatctagcttattcatattcacgtttataacacaggaactattcgcttccaagtatatgaattcaagcaagacttccagttttttttttaaagaaatccacagtaagttttaaaattttattacattaaaagacatttcatactatcctaggtagagacctcatattaatatataccatttacagagagattaaattttatccattggctacttcttcaagacagatcaaaacttctaagaacagtgatcttaggcttttttagaagtatgtatctacctgtagcagccaaacaaattttattcttactgtggacatctcttcttttaccagtctctgagaacattcctttttggtatggcgaataaccattagtgatccactatatgcagccttaatagggctatcaatcaacgtgttccacaatcccctgacaaacagataggcatatggcctatgtcctggggatttgtgtctgaatccattggcatttattcatgccagcattcaagtcttgaaaagagtatcagttccagcaaccttgatctctggaaccaccttgtactggcttcctgaacttggttcatcagcatattcttctctactggaaaccattccacatcttaaaaaaacaaaaaaaaaaaaaacaaaaaaaactttgcttgattaaattagtgtttcaaactaagaagtgcaatcaatacaatgtactgctagtttaacatggagtgctttatactaggctcaaatactggatattgctgaggttggagaaacactataaatgtgtttccctataattcacacataaactattgattaaaattttctcaatgtcatattaatatctcacaaaagcttaaagtctcaatgaaatgttctagcaactttctctatttacaagcaaagatatatggaacaaataactatgcttttgatgaacatgaagccaaaaatgaagtgtatcatgtaggaaaactcttgccttcactttttaatgtgcaaagaattttgtatacagaggaaatatcagctctgcagtacaagaataagctttcaacatttgttctttgatgaaaagcagagtataggacagctcaggtcgtataatcaaatatcttggctttattgagaaaaactcaaaattcagggcaagcacacaataatggggtcagtccggacctttactgagaacacttccatgttgccaggaatgaaatgaattctggaatgttaacatgaagctcagtggaccacagatattttatacagttaattttagagactcaggacccttgtcaaataagttgacagaattccactcactgatttcaaagtatgtcttgggagttgcatcctatagccactcgaaatacatagtactttaaaacagttaacttccctaactaaattcggagccatgcaaaagaacactacgtctaccgtgtcattgtgtttggtgatccaaaataaagctcaggaaaaagagagagaaacatattttcatttccactgaaatcactttattttatcatcgagtttattatttcccttccattgtctagcaccattgcaggctactatgtaaaccctttcttgccagtgtctcattgtgacacaacatgaacatgcttatttggtgagcatttggttactctaagcacatgcacatcaataatgtaaaacataacaaaacatgaaagaaaagttttcctaacgataaccctaagcactaagctttcctgcagttcccattctaaataagaaaatgagtgcccactgctatttctggcaatggtactcttgtactataaactaaacatgccaattaactttcttgagcctaattatatattaaaattttaattgatgaattgccagtaaatatattttgtggagaaacttgtttttaaaaagcgtaacaacctcattaaattattatttttgcattttatcagttaaaaacatctcagctattttaatcaaaccatatgaccttatcaaaagctggttagtaaaatattatgggtaatggaaattgaggtaaaacatttctttaattcactgtaagttttctgcttataatactctgtattgttcacctttaaaatatctctatctttatacacacacacacatacacacacaaacacacattacattcatgaccacacttgtatctatacatatataacatgtctaattctactgaattaattctatagccatactttcctaagatgaaacagaaaggcttcagaatatatgtttcatgctggcatgacagtgagaataaagaatacatcataattcatttatatgtttgtcctggaaaataccttataaattatacttgagacccaattataattattattttaaatattccaggtttaagcgctatgattaaagacaaataatcccctgaactaagaagcatgactcattgtaaggaaaattttgcctttatttggtttccaaaagagtctatataagactataatcaagtctataaaattaatatttgttgcacaacatgctgtgctataaactagacataggcactgtgatttttcctttccactgccttcttctcctcctgttttgttttttattgattttcatttctctctgtttccatccttctctctctctctctctctctctctctctctcactatctttccctccttccctgcacttccaaccttctattttataccatttgttaaggttttacaatatgccaggcactgggctgagcaattcaaaacaacttttgtttttaatcaccacaataatcataggaaataggtatttattgttaatccatttctcaagtttttttattggaggaaacctagtgtttgacgtgagagaaagccatgcaactcaacacaaaccctccgtggtggagctgcaaatcacactccagtctactctggatcaaattatccaagaagaaatcctaactctcattttctaagtttatgtttaagacaaacttggtttacctttctacttctaatccatgtaagctgattttccataagtaatttttcacctggatgaatgagcaatatttttctccttagaagtctgggttagtctaaagtggtattcttcccataaacttgtaaatgcatggtccttactgcctgatgcatttttattcattggactacctgtttccattttttattgcatttatttattaaactttcctccactctgggccggaggtgactatatatatgcgtgtgtgtgtatatatatatatatacacatatatatatatatatatatacatacatatatatatacatatatatatatgagagagagagagagagagtaattttataactagtagaaatctagagttttaataattatgttctatgatgaaccaagactaaaataactattctgaacctcactagatagaacatttttgaaacctttctacccatgttttatctgtaagaattttagccttggcaggtcacttttggtggtttgcaatctttctactatcacaaaattcttgcagtgtttctcaatgggggcagcaccaccccacgaacaggaagttggcacatctggagagctgtttcagttgtaacagagactgggtgatcctatagtttacagcagttatcacaaggttgttaactgtctcttaaatcaaaggattgagtcatgttttatacaaccttaaaatgtcctactagacatttaggacctcatatgtgcaaacttcatgcttggtcatactttggccaggtataattccctagttgtgttgctccaatttcacttgatcttagccaaaaagtcgagaagcaatttactccaatttcaatgaaagtcatttccctctttcttttgtcatataacaatgtgtctggctagtggttttctattccagtggtcagctgttcctctgctttttatttcctggtacttcttacacaaaaatgccttctaatctcatttttcataaatccaaactttcgtataattggaaacttggcattcccctaacaatattttattgtaccttactttttcgtatttcttttaaaattacaactagagaattataataattaaaacaatatatatttaggttacattatctataaattttatttcagaattgaaaagtggcaattttttaatatataaaagtggaatgttgtgcctgataaggataaaaaccacttgtctaatgcaattcatgtgaatatgatttcaaatcattccccacagtgaaaggcttgaggctaattcatttattatttctaggtgaaagcacgcaatgtgagtcaagtggctctatcttcttatttctcagaagacattattagcataatataatcttacattcatgtggtatttggttttaaatatagtcaaattgtgggtatattgccttactaaatgtcatatatgcattaaattatgaagaagcacctaaatattgtcccaggtctcctatgcaatggggcaaggagggtaagacagcaatgtaaatggactcagaaggccagtggggactatggtaaagttgattaagggtgtcccatctcaaaatgactagtgttactgatttgctttggctatgtcctcatcaaaatatcatattgaattgtagctcctacaattcccacgtgttgtgggagggacccagtgggaggaaactgaatcatgggagtgggtctttcccacgctgttctcatgatagtgaataattctcgtgagatctgatggttttatacaggggagtttccctacacaaactgtctcttgcctgccaccatgtaagacatgcttttctcctccttggccttccatcatgattgtgaggcctccccagccatgtgggactgtgagtccaccgaacctcttttttctttgtaaattacccagtctcgggtgtgtctttattaacagcatgataactgactaatatggctacccagttccaacaaattgttgccatgtaggaatatgggccgacaatgaccaagtctatacattttaaaaggcaagtaaaaaaaaaaaaacatttcttaagacagatacaacaattatggggtggcagctacatacatactattatactatctaacatggggctgtattaaaagctacctattaaaataaacagatatttagcaataatacatataataattgatttgaatgaaaagaaacactttgttctattgttcttgccattcctatttggacatatttattcataatatgtcaaattagtttgcttttagaaatgatctgatacatgttcagagtaagattttgaattaaaatatatgagagatattctttatctgtagcctgcagcactaacatttagggattaagtagtaatatagacaaatagataacatacaatgttaaaatactgacattcaaagaatacaaacttgtttgttttccagttaaaacgagtagggggtcctgtaatgaaggagcccagataaatcacgttgcaatttgtattaccaaaatgaaattcatttagcagcatctcttacagtggtgctaacttcccaacttaagggaaacaagacgaaaataacacatcaggacaaagaatttctggaagaagctcaggggaatttcaacatactgattagttttatgtgagactttttaaaggatattaattcatgttttctcaagctaatccattagaagtttgaatgaattttcccacctcaaccaatgatacttttttccctaaacatatctaaaaataagtcaagcttgctgaaaactgtggatttgaggaggatgtcctaaaatataatttagtttaaatacaaatttatatttttgaccttagtcaccaaactaaagtttgagcacattccaaaactagtatactgtcattgctggtgaaatcaggcccctgcttttgttggtgaggagcattaatgaaaggtgaaactcttcagcttccagaggaatcaaataaacaaaactaaagaatctcttcagttttgtctacactttgtaaaataacttgcacaaaaatttaatactgacccatgaataccagtgactagaaagatcaaattcccattgatcttggtacagtttatgaatttgtcaatgttactggaatccacagtctgagctgacatcaatgatcctgtgccaatgccatcacaagctgtagaaacaagactcagagttaggggattgagaaacttatttttggccaataaatcattgcatcttcattataaaatagcagagtatttttaattgtaacatataaaatatattacaaattttgttttctaaaaagtaaaataattattcattcgttcaacattcactactggttctgctttaaaaacttgtccctgcattaaaatcgaatgacgatgactcatcagagaaattacattttatatcaagacccagtatacacacataacacatacataagtcttacagaaattttataaatcaatactcctcctaacaacataaaattatctattttctactttctttgaaaatatcatttttaatgattttgaaatgctggtaactttagcaaaatgatttcatggcctacatactaatggtctacaacctgcaattttaaaaacagtggtctaatggagaatatatgcaaataaagagttctaatgatgtgaattataaccaaaatcaagggccattcaaatatttatgcttaaattgaacatgctttctgaagcttctaatttaaacaaacaaacaaaacaatttttgtgtgtgggtggggggggatgtatagagaaagagagaggggataaggaagaaacagagagggagagagagaaaacatcatctaaaagtaagtgtggagtttgtccttttctagggcactccctgatactttgaaaagtttaataacattcaggagatttagactttattttcatcttgcttaatttaggtttcattctggtgaggaattagactacccacagctggaagagattccttcctccgctaaaattctatggcatgaattatctgatatatttattttaaacttatggtaaagtttcttgtcatttcatagatctcatctttcaaaatacattttcaagatctggaaagtaaatttcatgcccctctggatctctttttatgcttagcagataattttgtatatagtggcaagcaactaatatgtgttgtgatgccaacataaccgtgtgaactcttgttttttacaaagcttttaagatttgctattgacagagtaacaggcaactttatttctgagttcctatcaatgttacatgtgcgtttttttctgggccattttagtagataaaattcaaactcaataatatacagtgctataaaagttcatattttgagtaactgttcaaaattatggaaagcgtgtgggtaggtttggttgtgagagtgggtttatattaaaaagttggtctacttaaaagtgaattaaaaaccttgttatataggcccagttctaactaaataatctgagctaccactcaccttttgggcaaatgtcagtgcaaggtttacacattttaatcccattttcttctacttccatcttggaactagggcaggcacgcacacaagaactggaatctaccacaaagttatctgattaaaaaaaaaaaaaaggtaaaataagcattaatgttaacattcagcaaacaagctcaaaacaagatattttagggtttaaaaatgattagcatcattgatagtgtttatgtatcttacccttaaacaactctttgtttaaatatctcaacctgaaattgtatttccagtcaaatgcaatgtgtgttaacaacaactagtacttgcttggttactgctccacatattgaattgcccccaagatagagtagatttcttttatatacttaggaaactacgtgacatttagcttgtgtgtgtcaatagttccacttcatttcatgacatgacgcaagtttgaagtccaaaaatacttcaagtccatgaagcacaaatgaagcttaagttgaactgccttggatcagagtacatttcacatccaggagaaaatgctcaaaatgtgttctatttttcagtggagtgccacaaaacctttctcatatttttatacgaagaaacgaaataaaattggaaagggtagtactttggaaaaggtatatcaaatagacaaggagcagtttgttacccaatacttggattaaatgtctagcagtccagtgacatgggatatgccagaacatcccctccaaaataaaggacaaattattgcacctaaaggctctcacaataaataggaaacacaatacctgctaggccactctggttttaaaagtagcatccttccatgcctgggaatattgttctggcacaatatgcaatgttgtggaatgcttacagccttgaggggtgcccaaagcagaaacggcatatgatgtatatctaggctgtgatgcaagcaatattgctacttgggccataaaacccaagaggctctatgatattggaagcatctatagtgggaaaatatgccatgtagatttatggcaagtttcatcagaaaatcacaacagagacttctaggtttttagagctaagctatgccacctgtagcacaggattgcacaccatttaataaacagcttttgacatgcttctgggtcctggtagagatggatcttgggtcagaccttatagccagaattgcctatcatgaacagggttttgctataatgtcacaatgtcatcatgttgggcaggtccaagagcattccattgtaaaattaaagtaggacatgtgtaggggcagaagcacaagtaaactgcataagcaaatggttaagaggcccccatgccatccaccactgggctggcccctctcagtcatctcatacctatggctgtgtgggggctaagagaaggcacttaggaaaagctaacagagtaagacacaaaatagactaggtatgtggtactagctgaaaatggatggcagcttctctgtctgccatctcacctatgactagacttgaagcacagagacaagagaaaatcttaccaacgggtataattctaggtagcgaaattgattactcattttgtatgaaaagagaagttgcttgaccttagaatatatatgaagtaatgagcttgtcctgagagaagaaatactggaaaatttgagaagaaagggaatctggtgcaaagaatccatgggagtgggtacaaagtatggaaaaatttgcattccaagtcaatatccacatgaaagcatccaccacaacaaagagtcactttgttgagatgatatcaaagtccaatcttgctttcttcccttccccaaaaagtgctgattttgagactactccttaataacctaatctctatctcaggggaacccaacctgcaacaggtgcatacatgatattaagtagccattctttcttcaaggtcttgtgatatggtttggatctgtgtccccacccaaatctcatgtcgaattataatcctcagtattgggggtgtgacctggagggaggtgaatgaatcatgggggtggcttctcatggtttaacaccatccctcttggtgttgtcgttgcaagagtgagttagcatgagatctggttgtttacaagtgtgtcacacctcctgcctctctcttcctcctgctctggccatggaagacataattgcttctcttcaccttcactgtgattgaaagtttcctgagccctctccagaacccctcatgcttcctgtacagcctacagaaccatgagccaactgtacctcttttgtttatcaattacccagtctcaggtatttctttatagcagtgtaagaaccaactaatacatcttgggaaatgcgttacaatgaaaccctttcacatttctgccgaatggaataaacaaatattataattagtcttatatcagttagattcaagttttgcacccaaacgagtttcagaaaatgcatgtttggagtttttaaatttcagaattctggattaggaactgtagacctgcatttagaagctgaatgtccgaccgggcacagtggctcacgcctgtaatcccagcactttgggaggccgaggcgggtggatcacctgaggtagggagttcaagaccagcctgaccaacatggagaaaccctgtctctactaaaaatacaaaattagccaggcatggtggcgcatgcctgtaatcccagctactagggagactgaggcaggagaattgcttgaacccgggaggtggaggttgtagtgagccgagattgtgccattgcactccagcctgggcaacaacagtgaaactctgtctcaaaaaaaaaaaaaaaaaaaaaaaaaaaaaaaaggccgggcgcagtggctcacgcctgtaatcccagcactttgggaggccaaggtgggcggatcacgaggtcaggagatcgagaccatcccggctaacacggtgaaaccccgtctctactaaaaatacaaaaaattagccgggcctggtggcgggcgcctgtagtcccagctactcgggaggctgaggcaggagaatggcgtgaacccgggaggcggagcttgcagtgagccgagattgcgccactgcattccggcctgggcgacagagcgagactccgtctcaaaaaacaacaacaacaacaacaacaaaacaaaacaaaaaaaaacaaaaaaaaaagaagaagcttaatgtccttgttttcccaagaaagcttcaatttggcaaaccaagccatgtaagccaggcccatcagagatttaaattttttcatagacaaatactgaagtgctttaaattagcctgtagtttgagatacacaaactaatctaagaaaggaagactgtaagttaccacatttaaagtaaacaagtcaggtaatttcacacaataggtcttcatgtttagccacttactacagtttggagttgacagctttcaggtgaatcactataagggctatagtaaagaaaaggggaattctctaattcaaattttcctggtacttctgctctcacccaaccctcgggcttcaacctaaggacttgaataaaagggaaagcaccaaaaaaactccaagaaagcatagttttgactgtctttgggaaaggcatcctaatttgaaggtagtagattaggtagtagtataatgcgcttctaagaaaagggaaaatatcatttagccccatcctgcaatactgccaagccctcagttttgtaaggatggtacatggtgacatatagggtgactttagataagaggttattagatgaaaaggactggtgtgaatattgaaatatttaagatgcaaaatctttgctgtcttggagttagtgtgtctgtgactttaaaatgctaattaagagacatattaaacacacatatatatacataaagaagtcaaagtacaatttttactttaatggatatgaacgtgtttcataacaatgactagaattgtgttttcaaagcctttttaaataatctacccctctcggcctggtgcggtggctcacgcctgtaatcccagcactttgggaggccgagggaggtggattaactgaggtcaggagttcaagacagcctggccaacatggtgaaacccaggctccactaaaaatacaaaaattagctgggcgtggtggatgtgcctgtaatcccagcgactcaggagctgaggcaggggaatcgcttgaacccgggaggcggaggttgcagtgagccaagattgcgccattgctctccagcctgggtgacagaaccagactctgtctccaaaaaaataaaaaatctacccccctcatccttatatcctatctcttcgattgttataatggctctggaaagaaaggagggaagatatatatattttttgagacagagttttgctctttttgcccaggctggagtgcaattgcatgatcccgactcactgcaacctctgcctcctgggtataagcattctcctatctatctcagcttcccaaatagctgggattacaggtgtgtgccaccacgaccggataatttttgtatttttagtacagatggggtttcactatgttggccaggctggtctcaaactcctgacctcacgtgatctgtccacctcagccttccaaagtgttgggattacaggcacgagccaccgtgcctggccagaagatataatttttataacccacatcttaaagaagaaaaaatagagaacaaaaggtgttatttaaaaatcacatgactaataagggaacgaagccacgatccatagccactctaatcccatgtcccttacacacattgagtatcccttatccaaaatgcttgggaccagatgtgtttcagatttcagaattttttggattttgtaatatttgcataaacataatgaaataccttggggatgaaaccctagtctaaaaacaatattcagtttttatgattccatatatcttatacacatgacctgaggtaattttatataatattttaagtaatgtttggtgtgaaacacagtttgtgtacactgaaccatcagaaacaaaggcatcactatctcagccatcaacatagacaatctgtggttgtttggcatcaccatcattcataacactaaatttatatactactgatgagcaatcatattcttacacttattcacacataaatatataaaactaaaaaaaaaaaacatggtataccactaacacagtgaaaagataatgtgtttggaataactaggtatcagagtagaatgaccagaatacctccatcagctgtgaaacaacaacaacaacaaataatgcaggcttttagtgtccatctatgatgctgtgttttgattaaaaggttacgatacactgttttattttcttaggtaaaaagaaacatcagaaacagctgagaaaccagggaataggtcctacagggataagggggctttctgctggatggctttttaaaatgtttcctccagggtcatttgcccattaacagtgaattttgtcttagaagtctctttttgattttataaactcccatgacttcttgttctgttatgaatgcaccatgctctagtccttcagtgagcccataacacattttcatcatgtcttctgtagataactttttgtgcaatgttaaaaacattttcattgtcactattaccacgattgctttgattcagagcgacttctgcaatttcaccatcagtcaatgaaggaacaactcgttatcaatgttaaaaacttctgtgatatccatttcttccagtttactgatggactctgaaggattatttttttctcacctgacatagggaatctttccaagtaaccacctttttcccgaacacagtcataggtcagaggttgtacctggcatgcaaaactgtgtctttagtactgtgttccaagcattgacaacagcatatacagcatccttcatgctaagcttcttttgaaaaccttcccacacccaggtctttgttcactgctgctagcatgctgttcaagaaagtgtttttggccaggtgcggtgggtcacgtctgtaatcccagcactttgggaggccgaggcgggctaatcacaaggtcaggagatcgagaccatcctggctaacacagtgaaaccccgtctctactaaaaatccaaaaaattagccaagcatggtggcacgtgcctgtagtcccagctactcgggaggctaaggcaggagaatcgcttgaacccgggatgcagaggttgcagtgagccgagatcatactactgcattccagcctgggtgacagagcgagattctgtctcaaaacaaagaaaagaaaaaaaaaaaaaaaaaggaaagtgtttttgtatttacttttcattgctctaaggatagtctgtttacatggctgaattaatgaagtcacatttaagggaaagtacacggcataaacattgtttttgatgagaatttcagctgcaggatgagtagaacggttgtcaaggaaaaacaaaatcttgcattcaacatccagtccagcttcccagcgatgagcaggaggtgctagtataaaatgtttgggtgaagccaataagaaaagttgttcccggtaaccgatgcatttttagtagcataataattggtaagaaattcactccttggaaactgaggatgcaagcttttgcctatcacagcaagtttacatttatgtgtgcctgctgtattagcacattccagcccagtcattctgtctttggtatccttcattcctgcaggggctgtctaatgaactgtggtcaatgcctttgtggaggagcaatgttaaaacagtgatgtttcatcagcatcacagaaatgtcctggtgtcagatttttatcagtgatgaccttggcaaactcaatgatgaatttctccactgctttgtgatcagcagatattttgtcaccgggaatctctaaagatttaacgccatgtcttttcttaaatttttgtgtccagcctgttgaatatttacagttctcttcaactttcagttcaccgtgctggatctttgcctgtttgatgatcagcataccattatgtggcttatgttcatctacatgctgaaaaatccactctttcggtacacaagcaagatctttatcattagctttattcagtgctgttctatttttcattaacttctgttattcattttcagcatagaacagtttatccttctgtttcttcaggtcacacaaagtgttcataccaacactgtactcttctcttctctatgatgttgcatacttacaccgttctcccatttctccaaaagcttgactttctaagctacacataaacataaatgtttcctcttatttttaccacccttacctggagggatagctgcaggcctttttgacattttcaacaatatctcaacaccacaaaatggcactttggaaaacctgccattggtgtgtctggcctgcacacgtgccattttattacctgtgggtgtgcttccctttggaaatctgggtatgcaaggaaaagatgtaccacagtcgaaaggggctgagagtgtgtgtatgtgtgtggtttctttccctcttgggaacactaaacaaactgtgttgtgtgcattttgactgtgacctatcacacgaagtcaggtgtgaaatttttcatttgtgacaacatgtcagcactctaaaagtttcaaatattggagcatttcagattttggatttttggattgtggatgctcagcctgtacttcctactgtatcacatacacaaagtgaagtaagtcacattatatgtatagcacagactataaataattcttttaaatgagtatatgggcatatatagtgatttttttcagcctttccaataggaaatgtcccattggttactcaaagcaaaaaaaaaaaaaaaaaaaaaatagagtcaagtaaatatcaatatattatcctgaatacctgatgaaagttaagtcggtccttttgaatcctcaggatgttatcaatttgtttaagatcctttaacataccctttatatatatacatgttttatttaaggttaatttgctattaaacatatatatatatatatatatatatacatgttttgtttaaggttaacttgatattaaaaatataatgctaagtattctagttataaataaggaatcagaaataattttaggtaaaaatccattgttattagaagcagatcctattcattacacagcttgctgccacttaactaattacttttttggagaaacagtatgataggcaaaaatactgtggtatagtaaaaacagaaagaggtttttgtttgtttgtctgtttttgagatggagtctctctctgtcacccaggctggagtacagtggcaccgtctcggctcactgcaacctccacctcccaggttcaaaccatcctcctgtctcagcctccagaatagctggggctacaggcgcccgccaccacgcctggctaatttttgtattttctgtagagacggggtttcaccatattggtcaggctggtctcgaactcctgacctcaggtgccacccacctcggcctcccaaagtgctggcattacaggtgtgagccagtgcgcccagccacagtaggagttttataacctcaaacatgtcatccttttgctatgaaactttacacaaatcactttaaagttttggtttagtttctttatttataaaatgggggcaatagtatctatacccaaagtacttataatattcttacaagtttcacattaaaataaacttacataaaattcttttgatttcaaataatgacctaattaatttggttattcttattctgttacttacgtggacatttcttgacacagaatgctccatatgtgtactttgcattgaaattgtgctccagttgaaaggtggttggattgtagacaaaggtttggggacactgagtaacacatgctccactgtcattgaaattcatgcaggcctgcaacacagcaaatattactttcatttacaaataaactcataatacttgttaatgaaacgctgccaaaacaggagaagtttttttctataataattccacaaatattacaaaatttgataatttaagagtcatgtgtgtttccaaaatttcataaaactcttttttccagtatcagtaaataggaaaatttatggctactgatgctcaaagtgcttagcctgtatccagtaatttctaaactgagaattggtttaaagttagctaatagtgaaaaattatttgagttcacacttattcaaagcatttatatttagtcttaaagtatagcactgacaaccaaatccctaattctacaggctagatgtccacttgagctggtattttaaagagttccatatcccaaatgacatgtaaagtacaattatcaccactgtcctgtaagaaaacattgtgatggtgatttatatcggacttaaagaaaaggctctggctggtgactagccaaatacaaatacagtgcatgtaatgccaaaatgtaaagaggtaattagctacagttggcctgtaattaaataatatgatgtcatttctagtatggcttttttcctaatgccactccatttagtaaaagctaccatgtagaagacagttcatttctgctgactcgtatatttatattcataactcaatttattaatattttcaaattcatttgggaagaattaaaaaccattttattacctgagaggtaggtacttgatataaaaacagaatatatgtgtaagtacatataaacatgtgattaacaaaaatgtggatgagctaattctttcaattaagaaattaagccattttaggaatgatttgggccttggaaagcaagctaatacgaactcaagctatgatttacatttaatcataaatagtacatatggttattaataagcattaatttattctgtttcctcaaaacattgcttcatcaattgttgttttagcaagcactttatcataaacatgacaattccctgatgatggtctactagatgcataatcagaacaagacttactgatgacacattattcactaagatgacacattctaggaagaatctattaagaaccaatctagaaaactcagtaagttttaatttatggttataaaatttcatgtgtccttataattgctttactaacatattttatgcaatgctgtacacagattgctcaggaacaaaggaacataagtcagaggaataaaacaaatttagctttgcgacagcatacaaaacaatgtaacttacaccaaggccttagtctggcattcttgaacattctgtaccaaaagccaaagtggaatcattagaccgttccataaaagtaatgaaatgataatttgaagctcactcagcactgtgcttatcatgataatggaaccatgacaaaaactgcatgcaaaacttctaagagtttttgctattgctgtttattgttgttattgttttggaattgttaatgaaacacctgcagtgttcaatgtcttcagaatcaagcttccatcctacgtctgatgaaagacagaggaaggttctcagttcaagacctactgagtatcttctttaaatttttaacatttttatttccttttcttcttcctccctatccatttctgcaatacatatttttgtttcactatagaatgagtatagaagattatattccttatgatattaagaaaactaagaaattactgtctatatcataagagctttaatatatggtttgctcattgctggaattaagtgtctttctttttttttttttaaaaaaagctcaattctactacatatgtttgctggatatttgagagaaaaaaatttctgtgttcattttcaactatataaacatttgtgtatttttacgatttttagctttaaaattaagctggtgttctcggtatatgaaattgagttaaatacaactcaaaattgctgacatgtatgccaaagacaaagagtactgtgtcaggaatatgatatcaaaatataattaaaaactgtccctaacaaactatttataaatcttaaacttttaaaataatattacctttaaaatataaactagaaaatactgaaactcataagtatatcttctataatcttgaaatttatattcaagaaataaaatgcaattgctcccacttgcagaactcagtgatgcaaccacataaacaggtaatcaccgcattactggaaaggatgttattagattataaaaagatatctcaatatgttctccaatgaacctcatttgtaacataaattatatcagaaatatacaattcatttaatagaacaattctagttaatcagtagacaacctagtgagggaatgactttgaggagggcagagcatttttcttaatcctaaagtggctaaagttgatctgattgtaataagacaaagattcagtatgcctgaatcaaatagggaaggaaaggagagcaggataataaaagagagaaatcacagacatacaaagcagtctgtgtccttaggtcctgagcagcctccagcacattctcgatggcagcagtcactgacgtaaggtccgtagcatctgccgtcacattgttctgcacacaccgtccttgtcactgcagaagacagagataggaccatgatcaaagtctgccaccaggagaaactcataagctgagttctggagtgacaatttctcaccctgtctttgactcaattcagcaaacatttaatgaatgaggtttacaactagatcaaaatttttatacaaaaatctccaaaattaatttataattatttcatttttatattctttcttgtttcagcaaataattacaatgccttatgacgatcatacaacttaacaagaaagaatccaatttgaagtcaggcacagtggagtgtgcccgtaatcccaactacttggagactgagacaggaggattgcttgaggccagtagttcaaagatgcagtgggctacgactgcacttgtgaatagtcactgcactccagcttgggcagcatagtgggactctgtctctaaaattaaaaacaaaggaaaattgagataactaaatgagacatttggcaggctaggaaaggtgaagtcaattcacacaatgtgcatagtaaggtcctagtagaaggtgtccccagaaatgggtctaagacttttagtagtcaatgcagaaaagggacacataaatgttaagttaattcacataatattttacacgaggaaagaaaggaaggaaggaaggaaggggagggaaaggaggaaggaaagaaaaaaggaaggaaagaaagccattaatagtaaacacaacaaaaatcatcattggtcttttcttataacatgcttcaatccaagctgacagcatcatatcgaggtatactttagtaaaagcaatacgaaaggctatccatcaacattatagcaataagagacacaattctgcttatctcacttattccaaaaatatttttagggtatttaaggtatgaattttacaggatatgtatagtatatcacttcctggtttctgtatttccacttcagccttgtttcttcctatattttcaaacagatcttctaagctttctttgttcctaccttatcaagactctgcctcataaacattagcattccccagacctgttcttgacaattttggggggactatgggctcattcctggataaaagtcattcatcttctacttagcatactgtctaccagtaaatgactttcagatctagaattgagttctctgtggagctacagcatgcatttctagctgtctacagaagtccccattttgatatgcaaggtgtacaaaacagaacataactcttcttcccacacccactactgagtgtatttcttttctaagttcccttatctcaattaatggaagcaccatatatccagtagcttgctagtaatttgcaatgtattttctgtctcctatcctcttatcatcacttctcctacctaataaaattgccaagtattagcaatagttttctaaatattcctcagtactttccctcctctctattctaactttattcaaaagcctatctctaaatgattacatagtgttctaaaagttttctcagatcccatcttttccttccagttaatcctccacaatgccctaaaagtaatggcttgaacctgtaagccaacgcctataaatcagtgttgattcacagtatgaaacttatgaccatccccgtactaaaggattaaaccttaagcaagggacaaaagccctccataagttgaccaccatctctgcccttccaggaatcacattactctgtttctcacgtccagccagatagaaacactacttgcaattaagttgtgattctcattgcttcttcacaaggcatttctccatgttaaaaatccttcctagcttctcagcctaggaaatacttgctctgaaacctttccagacacagctccaagctgagttattttctcactattgcttctgaacaagcaagaagataaagttaatgcagcagtctatgtagtctgaagatctaggctcaaatccaaaatatatccacgttatatgggcaagttatttaaccattctgtattttacttcaccatttttaagatggagttagtacccacctaataggattgaagataaatatacaggtataaagtgctttacatggtccctattaacagtgctcatcaacttagatatttctatggcacttatacatttgtatttttttcaagtttgcttctacctcaccccaactaacctatgggtttattgaagtttattgtcttacttaagttttaattttcagtgataaacacagggtttggtacttaatacacaatataaggcagtattcccttcaagtaaataggtaaatcatatattgccaactcaatggcagtatctcctcagggcttaatatatttatcagagagataaaaaggtgtatagagttaaagagataggtcactaagaaatataaagagacaaatattaaaatactaggatttaaatgctccttaaattctgctgttgattagttcatgatttcatatttttaattggatccttttccattgaacatgatgatgatattcataaaataatgcacaatattgaaagataaagaatattcttccatttgacatgattaattaattattctctatgtagtacaaccaatacaaacatcaaataaagtttaaactaaaatggcacttggactcaccctctgtcatgttttttattttgtaaaaataaggttacatgctattttttaccataagcttatagaagatttggaaaataatcaaatttttatatctgggtttgtgaacgtatattttgtatttgcaattttggttacattaaacttcaaaataaattatttcttctattagtatcctggtacaaaattctgcataataaatccccttggactgtcccttcactttctttaagtctttgaccaaatcacacctttgtattgaagtctgcccctgtttaatactgaatttttcccaatcaactgactccttatgaaccttcatcttcttttttctctctctttctttcatctcccttccttccttcctgtattttgttacagcatcaattaccatctaacatattattatttattccatttattttgtttctaggtgtattactatgtttgtaactgtaactggcacttacatagttttatttatatttgatacacacattatatatatatatatgatatgtacccaaacaatttgtatcctttcattaactcttcatgtcatacattatgcttatattgatatttctatcttttaaccaagtggtatatttgtttagatgccctaattagtaattcatacaatataaatgacattttttaaaggaaacacttttaacagacagttttgtacagaataaattcaaacacaattcttctcttccaaattcaataaagtgcttcgatgcatcaacagtcgctaattaaaatagcagacatatgttaaataaataaataactagatttgaaatgtgttatcacaggagagtttatcaatttgcttctatttgacagctattgctcagctggaaaacaatagcatggagtcaacaatcttataagtcacatcatattttaatcatagacagatatgtctaagtgttactttttatttttaactccatggtgatttaaagtaactagacaaaatgtttcagtttctctgtatttactttggtttttcctgccaaatgagaaaattaatgtagaaaataattacaatgataagacaagtaaccctgaatgtagtttaaaattatgtattaagtgttcacgttaaaatcatttctctcattgagtacactatttaaatatgaaaataatattatacaaatataatccaatgtagtacaatcttagattcaatagcaattattatactgtggaactattaaaatattttaaattatttaatcatttgtgtggaagaaaacttaaaatttttgaaaatagcaacttttccacatagtattcaaatatttaatattttttcaggacacactgatttctgatattatattcccttttagaaacatgcagaaaaattcctctaaattattatccaaatgcagatgcattccacaatttttatttaacatgttaaaagggagttatggctttcattttccaaaatcagtctataattgatttttttcaaagtaaattacattcaactttaaatatagggcttttcaccatcaacatttttatatcccttaattccaaacgaaaattcagtaagcatgaagcatttggacacataaaaggtaggcaaaaagaacaaaacaacaagcttaactgctaaacagtaatggggttaaaaaaaatatttctttatattattatatgagacttgtaacaagaaagaaaacattccctttgtacaattcaaggctacatgcaagacaagtggaaaggcaccatagagtaaatttatttagtagcattttttgattaataagcattatttaatgtgaataaactcatcaaattatactcatattttattacaatggggacacaaaacaaaaaataattcctgaaatcaatgagataagtcagcctctataggaacattaacttataattgctttggtttttattaattccatccttgctcaaatatttcattacatttttttccttgtatttagtttcctttctaaattgcttcactgggtgcattaaaatatttgggtccaattttcactagctttttcattggcggtatgcactaaatgtgattaatataaaatttaaaactgggacgttaaacttcttatattcgggtcagtaaacttgacatggggaatgtgaattcattcaaaatatccatgagaattagacgggtaacatttaaggaatcaaacaattcatggtaagccaatactactgagagaatgtctatcaagtcaaaaaatattaaaaaatcattaagtagcttaatcttatcagtatctcactaataagaactatggcttaattacttctttcaatataatgataaccaatactgtgattaaagttactcccttaggacaaatttattttacttgaagaagcttggcaatttactaattaaatatttattgttgcttcctagcaacaatagcaaaaaagacaaagaatattcataaataatgcaaaacagagcactgacatcacagtgacaagacaaaagatctctgttcgcccgttaacaatagaaataaggataaatttaggcaaagtctttgtgtctttttacactctgacacttcctcctcctcccccatctccttcctctttccctatctcctctgtcttctctccttcagtgccttttgattatcttcatttcctctaaccagtggttctgaactgggttgtatattagatcaactaacagtctttcaaacttgaatactggaattcttctgtaagtaaaacttttcattcagttggtatcagtggggcccaagactttttaataagcccatttctattaagctcccaggtaatgtctctacctactcatctacataccccatattgagtagcagaatatagagtagtttcaaaaaatacaatacctgagaatcacctagtttctattaaatcaaaatcgctggcaattttctagaagctttggtagttttaataagctccctgggattccaatattcagtctagagttgagaacctttattctaaccaatgggagaaatgggagaaaaaaattttaagtcatttacaccatctgattgactgactgattattccttgtctgaaacttaatcacagtgacttcttgctttaatttcctatttgtgttgtaaaggtccctatcactaattggaaaatcaaacaaacaaaaattgatgtgcaagtagatataggaaaatttgggagggaaattacctatattttcgatggaaatattgcctcactggttctgaaggcaaacattatggataaatgaaataccagtagaaaacttcccttctctcacccagcagctgtctgagtgaaaagtatcttggggcaatccccaattgcactgctaagcacattttaaagcatatttattttattttttaaaattttatttcagtttttattcaaagactcatacctctatgctgcctctattctatttttgtgtcaaaattttgacaaattatgatcataaaacatatgttcaataactagatagtatttgaatggaatgtttttattacactgtttccagttacatacttggaggtttgaactagaagggagaaatacttgggttaaagtagaggtgatatgggttggatgtgaggaagaattactgactattagagggataaaaacactgtaatgggcttcttaagtgtttatttgtcagtattttaaaagaaatctcttctacatgctttagacatccacttaattaaagataggaggcttgatgaaatgttctctagaggtaccctctagctctaagattcaaaatttattcctattaatgatgaaattgtgactaaaaaactgaacactttgggttgtgtaacatgttttaagaaagctatcatcaacaggatacacttaaagtgaaacaaataaagctcacagaccatccaagaagaggcgttacttacagagcatgtgtaaaaaatcaggttcaatgaaactaatgccaaactatacactgttattcattcttccaaaggagaataattgaacacatttgtgtgtccagggccaggtagaaactaaaagccaagtagaaagacttaaaataaagatgtctggcccatctcctatattctgactcagtaagtctggggaaggtgtcagaaaattcattttttttttttatttggagccttaagatttttagaagtagattttataagccaatatttccaaacttctgctctaaggcactctcttatttctaatgaaaggttcccatagatggaaaggcagagtcagagctgggttggtcttaaactagaacgctctttcctatctcatattaaattgcagaagaaataagtcaaaaattgttgcctcacagaggaaggcttcatcataagcctatatcctaatttttacaggaaaataattttgcactttaaggatttttcaattcttttaaccagccacagtgtattatctaacatatttaaaaaggctctcagaggtcttttttgaaaaaaaaaattagacctagcaaaatggaattatcaaaaagtatctgggcttctaaatgaccacaatcatacacattttcacaatacaaaataaaatacgactaattttcttttattcctaattcctaattggtttggtgatagctactctaaataaaccgaccaggccatatcatgaagtatataccccacatgtaaaataactgtttaatccaaaatgcaataacctctgtcattcccctggaaaacatagcaaatagctgtacagtcgctactgaaattgacattcagagtcagttaataaaagtagggccaggccggacatggtggctcacgcctgtaatcccagcactttggaaggctgaggcaggcaaatcacgaggtcacgagtgaccagcctgaccaacatgctgaaaccccatctctactaaaaaagaaaccccgtctctactaaaaagtacaaaaattagccaggcatggtggcgcgcacctgtaatcccagctactcaggaggctgaggcaggagaatcacttaaacccgggaggcggaggttgcagtgagccaagatcatgccattgcactccagcctgcgtgactgagtgagactccgtctcaaaaaacaaaaaacaaacacaaaaaaagagtaggcccatattttggcagctactaatcaggtttgacctgatgaatccctggtgacccacggactatgacatgataatattgttagttgtgtcaaagaggtaagggattctgtctaatccattccttatcaccacctgctttattcatttatttaatgaagttttattcaacctatttaataaagacatgatcaatgattcattgagggaccttaaagctgattataaactacacacttggtcaccagggaaattctcccttcttaataggctattagcatctccacagtttgtgagtgaagattcaaaaaataatattgccttgttacgttaactataaaaatattcttgagagtgagtaagagttattttgcatattcctcacaggcctgtagatattgatttcaaggcaataaaggaagagtatgaatctgcgtaagaataccatagtatttttaagaatatttttaaaaattagaattgaggtctgcaccttaaaatctgcctataaatgataggctgcagataaagtagtaaaaaaaagtcataattatatcatagatctttcataaaccaagaaatatggaaaatttggtattcaaattttttaaatcactgtgcattataacagacatctccacatctaacctgatagaaaaacaaacaaaaaccaaaaaaaaaaaatttactttctttcttttgcttattctagttccctatccaaaatattagtagaagaaaacaaatataatctctctctcactcaattttgcaataaaaatacccacagaagggccaggagtggtggctcacacctatacacctagcatttgggaggcagaggcaggcggatcacttgaggccaggagttcaagaccagcctggccaacatgaagaaaccctgtctctactaaaaatacaaaaattagccaggcagaggaaggagaatcatttgaacccgggagactgaggttgcagcgagctgagatcatgccactgtcctccagcctgggccatgcagcagaaaatatttaaaaaattttgaaaaaataataaatatttaaaaattttgtctcaaaaatatttttaaaaattgaaaatacagaatgttaaaattaaaaaaagaacatcatattaggtaaacaatggacaaatatctgttgaaacaataaataccatcaagtccaaatttctcattttattgatgagaaaattaaaactgaaataaacttacttgtttatgagcaaatctaaagtaatgttcagacatctctaagacagatcaccacttcttcagagcattccaggaagtttctagttttgatgagggtgaagaattgggcaaactattagtgggtgtataaattgatacatgattttttgaagactaatttgtctctatcaaatttgtgtatgtaaattcacatgtgaccaagcagttctatttctagaaatctgacttacagaagaatgtgcatctgtggacaaatatgtatagaaaaatgttcattagttgtaactgagaataatacaatgtaacctaaatgtccactaatgaggaattggttaagtaaattatagcacaaccataactagggaaatagctgtagcattaaaaaaaaaaaaaaaaaaagctgggcgcggtggctcacggctgtaatcccagcactttggaaggccaaggcgggcggatcatgaggtcaggagatcgagaccatcctggctaacatggtgaaaccccatctctactgaaaatacaaaaaaattagccaggcgtggtggcgggcgcctgtagtaccagctactcgggaggctgaggcaggagaatggtatgaacttgggaggcagagcccctgcagtgcagccactgcaatccagcctgggcgacaagcgagactctgtcaaaaaaaaaaaaaaaaaaaaaagacggattgttctctatgtcctgaaatgaaaggattttaaaaatataatgtgaagtgaaacaaaagtgatagacgaatagacatggcatacatatttttgtaaaacacacagaacaaaatcccacaacttttatgtgcttatgtgtatatgtaaatataaatacacacacatataccaaatattaccataaagtaatcactttataaaaaaatgtaggttgagggaagcatatttactgatgggaaggcattattatttttaactttatgacctgagtatcacatgaatttaaaaaaaaaactatactaaaataacctgtgcatttggcagagcaagttaattatcccagtgttacagatgaagaagttaacatttaaaaactagcttatcctaggtcaaatcataagttattatcaaagtggagtttaaaattagttttctgactcctatatatcttcatttacatgttttcatcaagttaagagtcacaaatagaaggtgcctaaatgtaaaaatcaaaaggactaaaaggggagaggaagatagttttggaaactgttttaaatacaacgccaaatagctaaagtgatcaaacacgtgtctgcattacgtctctgaaaaacagcttggctgatgctattttaactaccatgattgtgagtgatgataatgaaaactaagatattactcaaatactctttaaatctcagacccagagagggccaacaatgaaaactaagatattactcaaatactctttaaatctcagacccagagagggccaacactgaagtctatacctcagaaaaagagaccttttgaggaaaccatttaaaagagttataccacaagcacattttgagtatatacagaagaatatgttttgcttttctcctcatagaacacgtttgggattatcttcttaaaaaagataatcaggccaagcagagtggctcacgtctgtaatcccagcactttgggaggctgaggcaggaggatctcttgagcccaggcattcgagactagcctaggcaacataatgagaccttgtctctaccaaaaagaaaaaaggaaaaacaaaatagccaggcatggtggtgtgcacctgtagtcctagctgcttgggaggctgaggcaggaggatcacttgagccctggagttcaaggctagagtaagctatgattgtgcctctgtgctccagcctgggcaacacagcaagactctgtctcaaaaaaaggaaaaaaaaaaaaagataatcatgtcctcctacaagtcacataatgcacctttgtagtgtttttcaaacttttgatttttaaaaaataacaatttacagtacaaataacattgtattatggctcagtacacatatccttgatgaaatgttttgaggaataatgctgagcctaatcagtgcaagagcattttgatactgccttttctggtcaattttattccaatgtatcttatttcaataaaaatgtattgttgggcagggtgtactgaagtgattttataatctactaacaagttgcaaccagcaatctgaaagcattgtcttattgcatgaacaaaggtcaaattaagaaattagagaaaccgatctctgtgctcttcttatatatgtacagcaaattagccttctaatgaattcaggaatttagagccactggtgataaaatttcccttttctgaagttttaggattctagaggatatggaaaatcactgcacaatacagcctgccataatgccttatcttcagaattgtgccattgagactgaccattctcagaggtttgtgctttttattcccaccataattactggaaatttgggatcgttcagtctgaatttctcctacatggcagtatattaaattgtgggccaatacaaaacaactttttggatcctctccaagcaatatatttatagaaaataatataatctatagatattaaagcttttatgcatgattaatatattgataaaaaaattataatctctctgctcaggacaaaagttcggaagtcctcaacatttaccaaaaaagtcatgtcgcgataaagagggtattacttattatatttgttgttacttactttcttaaaattctgaaattacatatgcagtacctattttcagggaaatataagtaactacagatatgcagaattaaaaacaattcatttgttctcttactccagcagtaacaaccaatgtcaacttttgagtctctgtgaatgcttgacatccctattatggttccacactagtatgagagttaagagaacacaaaacacacaattaaaagtaattcaaaataactcagatctttacaattttcaaatccaggaaggggacacaatctcccttcctgcctccagaaaattatcccatcaatccacatttctctacatgcagaaatctcatattctcctccttcagaactttctctagtcccacttcttcttgtctctcctaccttatttccagtgtatataccgaaatgattcatgaggttggaatgagataatacatgtgaaactgttagtacaaaaccggcacaatggataactacaggaagttctctggagatgactttacataattttgactttacataatagctaattttcactttacgtaatagctgtgccagattagacacattgcttaacctctctgtgatttaggttttcatctataaaataaaaataacaactgtacttacctcatgaagctgttacaaagattttatgtattatgggaaattattaatttggaatagtgcctaacatgcagtgaacattatataaatattggctcttggtattgttaagtaatcgatgaatggtagttattatctcgctttatagcttggtatttttaactaaatattatatcattaactgtcttttgtagaagcataaatatgcttctgctgtattattttttaaagctctatattatactattgtatgaatataccctgaatcccctttctaagctatttgcaatgtttgtattttttactattataaatactgctgtaatatatactatggaacattcgtttcatgcatatgataatctaagtgttaaaataatacatttcgtggttcaagaaaatgcatatttttaaaactttgatacaaatgactaattagtctacatggtgatttttacctatttataatctaccaagaataactgatactgttccaagctcatactttctttcttactaggagttatctgaatatgtttttaatttataaagttgtatgtcattgattataagtaatgtcaagtattttttgcagatttcttgtataaatgttcaattctttttaattaaaattattttaaaaatacaaaactatacttaactataatgcagttaaagtaatttttcctttgtttttgtttttttttttttttttttttttttgagacagagtcttgctctgttgcccaggctggagtgaagtggcatgatctcggctcactgcagcctccacctcccaggttcaagggattctcctgcctcagcctcttgagtagctgggactacaggtgtctctgccaccacactcagctaattttttgtatttttagtagagacagggtttcaccatgttggccaggctggtcttgaacacctgaactcaggtgatccacctgccttggcctcccagagtgctgcggttacaggcatgagccaccacgcccggccctctttttttttttgagatggagtttcctctgtcgcccagactagagtgcaatggtgtgatcttggctcactgcaacctctgcctcctgggttcaagcgattctcatgcgtcagcctcccaaatagctgagattacaggtgctcaccaccatacccggctattttttgcatttttagtagacaggtcaaactcctgacctcaagtgatccacctgccttggcctcctaaaatgctgggattacaggcatgaaccattgtggctggccagaaaatgatctttttcttatattttattttgtatttgttatgtcatgtttaaaaaggcagtcatcattctgtaatttttatctctatattttttcctagtacttccagttatatcacatgtttttaaatttttaatctataattcatcaatctgtataggtctatctaaatatagactatatatagtctatcctatgctctttagacttttaatgtactacccatcttatgccttttgttttattgtagggatctaacattatcttattccataagtgagccatttattcatactctctttgttaaataatctatgcttttgtcatttttaaaaaatgtcacctttgtaaaaactaaatcactgtagacatttgcctccaaatgtctaactttgttagattccatttaatcaataccattctgaaccagttatacactgttttaataattattactttttaacattttaatacttgatagggaaaatgattccacaaggttattcttttcaaacatctggctatttatttatttatttattttgagacagagtctcgctctgtcaccaggctggagtgcagtggtgtgatcttggctcaccgcaacctctgcctaccaggttcaaccgattctcctgcctcagtgtcccgagtagctgggactacaggcacatgccaccaagcccagctaatttttgtaattttgtgttttggcagagacagagtttcaccattttgaccaggatggtctcgatctcttgaccacgtgatctgcccgcttcggcctcccaaagtgttgggattacaggcgtgagccactgcgcccagcctcatctggctattttattaaatgtatttttaagatattctttagaaaagaaagcattggtaattgattaaatatagttaaaaatatagcttaattttagaaaaactgacattttcaaagcatgggcatttctatcttagaatgcagtagttccctattcatttaattttgtggttacatattggtgaaatattgtagcttgattcttttaaattatcagcaactagttgttaacatcagaatctgtctttttttctgttccctcatcctctctgttttctagtcaatgaaattacatacttcttaaatacatataacatccttattaaagaggaaaataattatcctgtgtgacagttactcaagaaatactgaaatcagaacaaaacttgtaggtatttccgtggtcataatgctctatcagctccgttataacaaaattcatgggtaaaaatattttagatagaccaaaaataactgtcttcagtgagatagtaatatatacaaattattttttaaaatatttttgtatgtttttataactcatcataaattaatagagtgactatttctttggaaagtgcccatggtaatggagagatgcagccatgataatattataaattgttgagtaatatataaaatttatattggcttcagaaatgaaatctttacatgtctgatatttagtgaactcacatttattttaatataatggacaaaaacgtggcttggcacaagaaaagttgacctgtatccagttaccccttcttatcctctttcatctctgtactgtaccccttcctatcctctttcatccctatactgtttacttaattatttcttttctttgtctttttttttttttttttttttttgagacagagtctccctctgtcgcggcgtgatcttggctcactgcaagctccgcttacagggtttatgccattcacgtgcctcagcttcccgagtagctgggactataggcgcccgccaccacacccgactaattttttgtatttttagtggagacggggtttcactgtgttagccaggatggtctcgatctcctgacctggtgatccacctgcctcagcctcccaaagtgctgggattacaggcgtgagccactgcgcccagcctacttaattatttctttaaccaaattgattaatttgaaaaagaatataatacatttcaataattttaaggcaaaactttaaggagaatatctttcttcatgcttgctaaattctcaaaccgttagagtggtatgtaagtgcttgcttttcctagaataaaatctcacacttctttccatttctgtagccaaaatagtatggctgtcctattcatcagaagcatgtcacatgtaggtaattttgaaattttctctttgatagtcaaatatagttactctaatgacagtcagctcttctgctgtgaagacacaaataattcagaataagttgtcatcactaccaaaataacaaaattattttactggtagaactttcagatatatctgactgttcttctcaatgtcctattagtaatccttcaaatgtggagtattcattttctgatccctctgcttagaatagctatctgcacaacaccccacagtttccattctctcaatctatatctgtatctgtataatctataactatatatgtagttatacacacacacacacacacacacacacacactagatgacagacagatgatagagagagagagagagaaagataagagaacttgttgaaactgaggttcttaaattgagttagaggtgggaccaaatctctagttacctaatgtcccagtttaatattctttttgatcatttccaacattcctcacctttgtcttgtatctaacccacagtatggccacagaacaggaacaattttatatatacctttatgcccctgaagcccttggcttgtcattaagtaatagctcctgaatcccattaaactgtaatatacagagtattttaaatatatacatctcctgtagttaaaatgaaacaacttgttcttttaaatctttgagaaaagtcattaaattacaacaaatattatcaacttatgtcaaaatgaagaacacatcagggaagatttttctcattttctaccggtaaattattggggcactttttgaaatggtcagtgtaatcaagtaattagctcattgtaatgtttactttaattttacaatatctccagaaaccataaatccaaaaaaggaaaaatgggaataattgaaatcaataagaaggcttatggatgtgcaaagttattagtaaaatacaagggttttaattaaagatgttggcgtgtacaaagactcgctgttatcctgattgatggggcctgctggctcagctctttccctgttccccattagctcccacttgcttttctctgctctaattggatatttaccacatcggcaccttctttttaaacaacatttgttccacaaagaatgtaaatacaattacactttagacaaattatatgtgtacgcatgtgtgtgagtataattagtttattatccaaataatttgtcattttgctttcacattctacaggaaactgttgaaaatttcatggagaaagatacaatttaattttcaactgcaacatttcttgttgaaattttgaggaacaaaaatatataatcattttgttagattttattattctatttcgaaggagttccagatatacttttgaataaataaaaggacatgtatatatgtatgacatttttcttaagaataaataaaattcataagccaggctaaggttttgtttttttcccctttactattaaactgaaacttttaatatattgcaaatgttaaaaccaattttcttcatgcccaagcataataaattactgaggaaaatgctaaataatttctaaattttcctagcatattctataatgtctgtatggaaaaagtaaatgacataaaatgttgtttggaaaaaggttttattttgccagtgtagtactacccatattaacaattatctacaagaaaaaaatacagtgcttatctttattttactattattctatttttaattaaaaaaaaagattttgagataacctggcaagttctattacttatgatagtctaggaagactatcataagtaagtaagaagcaagaggtaaatcccatcaaaagaacttttcttttggttaaagtaatgcattagtcagtttaatggagacatttaaattagacatttaaatggagagaagtgtatctgttcactccagtggttaaagtatgcatttcttcattaattttgctgtatttcaacttctacaataaataatgtttttaacctattgtcaaactcacatttttcaatcagcttatcagcaagaaacatcacttataaagcaacttagaaaactaaagagtgtattgagtggttatcagcctagaaaacttcacaattatgatgactttaatgcaaaatgtatgcaaagttcaggaaaatcaaactgtaatgtttggatatatgcctttttccccctcctcactcaaaatgcagtgactgagataacaccaggtctagcaggacaaaaggaatgcgtaaaatgaaacaaccaccctttctgataatgggagactggagagagctggcctgatattgtgcttaaagataaaaaaggacatgcagtatctactttaaatgagataagtgtgcttcatatatcttgcagggacagagataactttgtttctttaatcattattatttatttcttaaaccttagtctctctcatacctaaaacctgtagagctcataggttacgactcagttcttatgaatagagagagttgtcattcttacctgtaagcctgctaaataatacttctataagcttcagacttcacatagcagataagtttgtctcccctgacacgactacattaatccactaaatcaatttacttaagctgtgctgtggagcaatgcagccaccatttaactgagcttaaaagtactttcaagtttgagtcactgctccacatgtaacgtagctctcagtgtccaatcataagttctattttgaccctttgcaactctgtgagaaattttcttgttaggtttatagggtcatggtgctctaacatccagaaggatttaaggagaataaattcatgatgttttagaaaatcagactcatgagtaacacaggaagaggggaacacttggttagattttacaagcacaatctacttacattaatatttacaacattctttaagttgaatgagtttgttttaaataatttatctagaaaatatttcatatgttaggaaaacatttaaaaaaaacagctactagtttcacagtttatagcctgaacataattaaatgctatggaggaacaatgacacaattaaattatttaacgtgcaatcaagctaactgtggcacccaaaaaagtacacaaaataacttgcaaaatgttactaaattttactgaaaatgtactaacttttactaaaaatataaaagattttactgaaatttctgtctggtaggtttgcatagccaactgttgttcgtagtaagttgtcggtttgttcacattcttcttccatttagctaaatctattaaaaacaaaaacaaaaaccttttcttcatttcttctgtttaaaacctctggcctcccacagaccttccctgaagctcactgttgttgtgaccggcttctttgtttctctgtatctctattcagagatgttttcaatctgatcaccactctttgcttcatttcaccctaacaagtcattcattttcatgaacttgttctcccagagcctgggccatttgtctttagcgtggcttctcaccatttagtgacaaagaggataactcccagcacatttgctaggagacacctgtgggaagatgtcagcactgataaggtgtagtctatgaaatatatgcgtcacttcagtttccttagctgaggtgtggggctttttaatacttttttctcttttccccaatgtatggaaagtctcaaagaataattatccataaaaaataaggaaatatttggtaaatcatgaagctgaatacttccagaaaagccttcactaaagtgaatttattttagtcatagggaaataggtcatttgtaaataacatctgattgtatctttcagactctaaaatgtacttttatatagtcaatccacaaaagcagaatattgtcaaaaacttacatagcatgttttctgattttttaaaagttaagtcagggtcagatataagtatatctttagtggacctaagagtaaatattatgttttaaataacagaagagtcagtggaaatctagagaaagcctaaaataactgactttaaaaaaatgaatcgtgtgttacaactgtatggggtctctggaggtctcatattgttatggaatctctcgtgagagctaattctcaaaaaatacaacctaaattctaaaattgtgatcttacaataagtatatttttgagtagttccaaaatactttttgcctcaggatgctgggctctttaaatatggataagtaatttcgctttcaagtagctcagactaagagagagagaggacaggaatgaatgtcaaggacaggcagcctccaaccccactccagggtttttgctcttccatgtcccagccaccaggtgtcagtagacttcacaaggtggaactggcctacaggagtttgccttccactttcattcattcagatttaaattggaataagttttctaacagtatcctttccagtttattataatatcggctattattgattgggttttggatatattaaaaattatttaagagcttcaactgcattgttgaatttcattgtgccccccaccctccaccgccagaaaaaaaacaaaaacaaaacaaaaaaaacccttaggtaagtatacttatctccattttatagatatggtaatgatattctgaaagatgaagtcattttcccatgatagaaactggaaacaactgagatttgtatctcttggctaatttcaaatccagcttcctcgactactaaactgtgttacaaaatactgtatccaggaaacagttgtctctagattaagaacacttaggttaaaatccaggtattagctgtgtaaatttagccctttaatcatttcctctgcttatatttcctcaattgtaaaattgggttaatgtaactgccctctttaactcacaggaatattgtgaaaatgaatttttaaaatggaaatatttaataaagttctatgttaacttgtatactattctaacatttggccggtgtggtggctcacacctgtaatcccagcactttggaaggccaagaagacaggattgcttgaagccaggagtttgagaacagtctgggcaacaaagagacaacccatcactatcaacagagtgaaacactgtctctaaagcaaaataatataaaataaaataaaatttgtacttgcttattaggtccatgaatttgttgagtttaaatttggtaggctttgtggagtaagcacagtggccgttaagccaattttggattacagtaaggatagcttctatgctgaaaaattagctgaattaagtaatttcacgtctgatgatttgatacatgaattataacttgatgattttcttagtcaagacttcctcccacctgtgtttggtagcaagtgagaaaactccattcaggctgggtgcactggctcacacctgtaatcctagcactttgggaggccgaggcgagtggatcacctgaggtcaggagttcaagaccagcctgaccaacatggcgaaaccccgtctctactaaaagtacaaaaaattagccaggcgtggtggcacatgactgtaatcccagctacttgtgaggctgaggcaggagaattgcttgaacccgggaggcggaggttgcacggagccgagatcgcaccaccgcactccagcctgggtgacagagggagactgtctcaaaaaaaaaaaaaaaaaaaaccctccattcaaatatactagaagaacatcgtgtttcttatggaacctaaggacagcagtgtagctggacctcacggaacccagagaactaggaggtaaacattgtcaaaaattgttattctttctttcctcaactctctgtatggctgctttattctttagtgactttggggactgtttctttctgcttctcaataacatacgtagttcaaaaatggaaacctcaattagctttaacatctcttcaggttcaagtttctaagttattgtaaccagcacttttggatcccaaatctaaattctctggagagagaatttgactggcccagtctagtcaattatccacccatattacaagatttctcaaccctcagtactattaacatttttatttgtactgactaatgctttgtttgggtaggggtggaagaggctttcctgtgcattgcagggcatcatctctggtctctactttaccagtgccagaagatcatccctcccacccctcctccatgatatgacaacccaaattatcaaatgtctcctgtggggcagaaatcacttctggttgataaacactgccctgtgaagtaaagggtaaagtgtcccataaaacaaacatggctactggggctgaccatctagaagggggtatttttcggagaaggccacgtgtctgcttggcaattatcctgaaagtggtctattatagaaataagagatgttggtggaaattataacttttgtgaaatttagccaacagaagcagatctactaaaataaattaaaaggttcagaatttttagcactgtataaattgaaggaaaatttcaatcaaagttagggaaaaccctaataatcaatgacatacaacttttttttttgcattctaccctaatacagtgattgaatttcacattttttactcatatatctcaatctgagaataaatattcaccatctatgtatatataatatataatatgtatacagagagtctttcttggtatctgcagtaaattggttccaggacccccataaataccaaactccatagatgttcacttcccttatatgaaatggcatataatatttgagtataaactacacacatcatcctatatactttaaatcatctctatattacttataatgcataatacaatgtaaatgctacgtaaatagatgttataatatatagttttttatatgtattatttttaattgtttattattttaattgtttttttccaagtatttttgatctgcagttggttgaatttgccatgtggaaaccagtgatatggaggaacgactgtaaaatcgatacatataatctatacactgcattttgtaatctgtaaaaatacacataaaataagacacagatgaaaataataattaaagtaattattttaattgtaatagtattattaattttaattaatagtgttattgaatacactgtatgagacttctggtatagaaaagatggcagagacctttttcttcccacctgtttaattcaactgtaaaccctgaaagtaacgcaagaggcaaccaaaggagaaatctgaaaggtggtgggaggaagtaattttgttctgggatctagcactggaggaacaacacaacagcagggtgtcttaagtgcccctactcaacagaagagggatccaccccagtgtttcccaaatctaagctccttcctccctcagatctatggtgagtccctcaacagtactggctgaaccccatgggcctgagacagggtgtggttgggcccaccagagtggctcagccacaacaaggagcttttgcagaagcctctttgacccctctgtaaaataaataagtgaataaataaaataagtaggtgagtgagtaaaaactcatttttaatttgatacctcggtagtttttttctgccatgaaatgaccagtggatatctagcactttcacagtctctttggttactttccacttcatcacaaactgttgcagatttttccttattttagagaacttgacttcctgcaaatggtcacatgcgtgtcagaccagcactgggatgcaacttagcctccaattctttgctattaaaagaatatctccaaatattgtgaatgaatttcacacaataatctcatcttatttaaaagcctgtttaagattcttgtcaatacattcctgccataaaacattgtttctattaaataagttaatttaaatctacactgactatgtttcatctaaccctttgacaaagatccaaaaattccctaatgaactacttcgtccaaagaatagggagggaaataggcatttatgtacattgctctcggtagaactaattgatccaacctctatagaaaataagatctccattttgctgttctctacccatttccaaatccacatgtctatgaccctacaaattcacctctagaaattaatactacaaataattcatacacatgcatgggttgaagaaatcaagctgtagtacaacatgcaaaacatgctaatatttgaatgaaaaatggggtgagtgcttatatacatacttccttgggtatgcataaattatttttggaaaaatacaccaaaatagccaataatatttgttgcctatggagagctgagggaaaaaggtgggacccacgtgggaagatactattttaccttataatcttttccatttcatgaattttggatatgagagtgcccatgaattaaaattaataaatttaagaaatcatttatcattggaaatatttttcctatatttttattctttggtggttcacaataaaataatccttttatatctctttattaaaacagaatctagcaaatagaactagacaaatgtgaactgagacaaattagaaatctgtaaagtttcatctaagagtgtaatatttgtatgtttgaatctttaatattttctgtatcatctatgataacaaagaaatatatttcaacttgtcactatattttttccatatcatatttcagtcatttttattgcagcaggaagaatgagtgtttaccacttgtataggacattttatttttcttttttaaagaaatcatttattcttaagtttcatgaaagttcagtgctggtttgagtactaaacaacattaagaatgctgaaaaaaaaatagctatttgtctttatatttagtatgctttgttactatatgtcttagcaatgatgatagcttcatattttctttagctaatgactaatccaagaaacagtataaactaagggcaatagtcattgtcaaaaatagtgactatttccataattcataaagtttttatccctgtgcctggaacagtgcctggaaaaatacagtgggtacatagtaccctttcttttttctttcctctccttttgtaatgaatgaatagtgaaataactagttaatgaaaggactgagagacccagttaacctgaaattgagttactattttgtacacattggatttcccacttctagtgatgtaaaaactctaaagttatagctaatatcaccatagctgtgctgttgagatcattaacctagaaaccacgaagaaacctaagaatcaattatatattaattttcatttgaaagcaatgaaaatcgggtagttttcttggcccaaagcaaatcaaccacaaggaggtgatagctcatttcatgttttagatgaccagaggcatgaaatggaccaatcattaaaattccttgaccacatcaaacctgtgtgctctcactgatgaacacttacaagtctggcaatgattttctgtgggtccccagcaacggccagtacaggacttatggcaacgtccacctgcagaacacgaaaagggaaaaaggacatgcacgttataatctttcactccttgactaggagtaactcctcaaaggaaatactcctgctcctttatgaggatttttatgtcatactagagctgaaacatagcccataaaatgcccacttaagtaggaaaacctgaatgtcaaacatatgtgaaactaaagtacaacctcctggtattcaaatcctcttatcattttttaggaaaataaaataaatgaatttgtgaattttctcaggaaatcaaaagcaaatgattatagttaataagtttcactttcactgttcagcattattattctattgatctattctacttgatataatttccagagatcacaccttactgagagcaacatatattaaaaagtaaagcaacagttaaaaataagtggaaatctatgagaacaagaatatatttttacaaacacatgaaaaatcattagaataaatggtaaaatcatgcatttaagctatacttttgaaagcttaatttcaattattttaatatatacttctaaaatgtttattaacattatttgcattttcaactctaagccttaatctcctatagtggcatcttcttctaccataggtatttgcctcaacaaacgtagttgtcccacagagaaattcccatcgggactgaaaataaagaatattagctggaagaagtcatataaaaacgacttcctttgaatcttatttctgaatttcatagattcactctaaatttctgtgggtacatgacacatttttagaataaaatatagatgttaaaaatctattaaagcttaaaacttttccataaacagaaatgttttctatgacatttccttaaatgcttcttattaaacattgtcaattgtttaatattaattgttaataggattctcccatttaaagtgtttaacaacgttaactatattataaatatcatcaaataacatctcgtcagatgctcccatctttccttgattcaagtttttaattcctcaaccagaaagttcttacaacctggagtgttttcccgcctccagtgaaactgccaaagtgagcctattctgttaaatgagtacacggttaagatgcagattcaaaagacactttctctggctggatctcagaccattcagattgtctacctttgagaaagtaaactgtactatttccaagttaataaaatacttaggttcaattccagtcatcttaaaagtacggggatctttgctacaacagagtttatttaaagcaattctatttgtgaagtattgccgctgacatcaccagtgtataatatcctgtcactctgccatctgtttatttagagccaaacacattataacaacataatgcaagctcattgtagctgacaggaaaaggactccatctggcctgaacaatataactttaatcagtgataatgataattattattaaaaacttacaggagttcttttgtacaaagctaataaatctaaattgatttatactagcggaaattagaaaggactgtgagacaaaataggaagcagtgaaaactttttggagtacaaacttttttatgagaaagtagctaatgttaatgtgttttcttagatttggtataatcctctaaattgatccattaagtggtctgttaattgaagatagttgaagcataagataatctaccatttaatctatgatttatttaattatgtttggggcttgtaaaatatttggccttattctttgtggccagaatactacctaactggaaaaaaaaaaaaaagaaaagaaaagataaaagcaaatagaagagaagaaaagaaaaagtaaagaaagaggaaggaaggaaggaacaaggaaaggaaggagctaagtaacaaaattcatattagacatttttatattctcaatgtttttctcttactcgattaattttttaacttcttattcttgaaattccaatttgccacccagacatctgctcccagattcaatataaaaaggcatgttgctagaaatactgttgacggttcttgacaaggtatcagggcaaggcccacctatttgaaaatgtgatatagtacccacacacacaaaaaacaagtttaaataatttaaccttgactgtctactcgatattatgagattttgttggtagtttccatttccacttgacctacacatttcaaaattctattatgacaaatgcactagaggatctagaattgactgtactcccataaatcgctgttcagccaagactacccttatttaactttctctctggagccttgacacttttggaatctgtcctagtactcagttcagctttagttttactcttcaaaatggtgcaagacatggcacttgtgttatcactggatgttgccaattagcaattaagtaaatgctacaatatctgaccaaaatatctgattagagatatttatgaatcaatgcacttactacatttttatgcctgtaaccttagtttgattcttgtagataattgggaagtacagagagagttcccatagtaattatctgcctagcatagaaaaaaaaaaacaaaatttcctataagcattccctcctacatccttccaaccacgtatccctgattatttcataagtaccttcttcattttgtgtattaagcatgatgttaagcaatggacataaaatattaaactgaaacagagaagtttatcaccttcttagagtttagaattaattcaggaaaagagttttgactactctgtagctaatgttcaccctctatgagtttaagggaaaaagtcagtaaatctaaatttttaacagcctcctagcccaggaaagaagagttggatgaaagcaggtggagctagataattcccaatctaattcccaggggcttggaagtcagctacattccttaaacgatgacacgtccatgtgacatctaaaaggagatcaccctagaccatttcagtgaagaatgttaagcacaggcttcgatatgtcccttgtttatatatatatatttaatatatatatattatacatatattttaatgataacctactgtcttactgggactttcttcctgccctctcttctcaggcatgcactaacctcaaaagtcctgatttttttttttttttttttttgagacggagtctcgctctgtcgcccaggctggagtgcagtggcgcaacctcagctcactgcaagctccgcctcctgggttcacgccattctcctgcctcagcctcccgagtagctgggactacaggcgcctgccaccacgcccggctaattttttttcgtatttttagtagagacggggtttcactgtgttagccaggatggtctcgatctcctgacctcgtgatctgcctgcctcggcctcccaaagtgctgggattacaggcgtaagccaccgcgcctggccaaaagtcctgatttcatctgaaaaagagatcttatgtgtctgtcatattcagtgtgaattagttttataaactacttctccccagagtgtgttttgtaaatgagggccacgaagagaggaattagtcagattctagaatacgtaaatgagagcagtgtttaggggttttgccaatgctgtccaaatcttcccacttccatgtctcaacctggtacgtgattcttcccattgattattgcaataatcccttttttttttttgagacagagtctcgctctgttgcacaggctggagtgcagtggcgcaatcttggctcactgcaacctctgcctcccaggttcaagcaattctctgcctcagcctcccgagtagctgggattacaggtgcctgccatacgcccagctagtttttgtattttttgtatttttagtagggacggggtttcaccatcttggccaggctggtcttgaactcccgacctcatgatccacccatctaggcctaccaaagtgttgggattacaggcatgagccactgtgcccgagctttttttttttgagacagagttttgctcttgttccccaggctggagtgcaatggcacaatttcggctcactgcaacctccacctcccaggttcaagcgattctcctgccttagcctcccagctagctgggattatagaaatgcaccaccacactggctaatttttgtgttttttagtagagacggggtttcaccctgttggccaggctggtcttgaactcctgacctcaggtgatctgcctgtcttggcctcccaaagtgctgggattacaggtgtgagccactgcgcccggcctgctataattcttttgaagctatgtgagaaaatagtccacttctttactaaaaacgaagaatctgacatttccatgtagctcggtgataggagaattagtcaaattagtacgtcttgttattttggctcaaagagatgaaataagaaacaaaccaacattttaaacaaccatttcagttactttattaactatttttaaatgtcttagagtaagtgctaagcctagtgcagcagcacatgtctgtaatcccagcactttgggaggccaaggtgggctgactgcttgagcccaagagttccaaaccagcttgggcaacatggcaaaacccggcctctacaaaaaatgcaaaaatcggtcgggcttgttggcgcacgcctgctgtcccagctactctggaggttgaggtgggaggatcactggaacctgggaggcgaaggttgcagtgagccatgattgctccactgcactccagcctgggcgacggatcagaccctgtctcaaaaaataaaataaaataaatgaataaataaaataaaaataagttctggttactccccatcaccactattttaattcacaagcaatccctctgctttcacaatgcattattcatcatggaagctggcaaacgtgactaagttcatcttttatgcttgtccagcggatgttactaaaaatgtagcctttgcattcctttgtaggaactagagtccatgaactgcatttatgtttttaagagtcacaaattcatctagaagttgtgcttatttgtgtgaccacctgcatgtgggattcactgtctacctctgtaatgctttctgcaagtaatatgccaggacagttgaagagttacaaaatatgaagtcattggcaactataaaagatcatatcctcaaactgcctctagctaaaggcaacgcagttacatccctggatttttcttttactccttttaaaaactggcaggtttgacctcttaaaactacttttactagagaaagaagtgagagaataataccttttttatgaccatataattcaaaataggaaagtagaacattgattgaaagtctatgctaaaccagtccctattcttggtgtgtgtgtgggttcagggaggggggataaaaagacgaatgtcactaccctgtcctcaaggaggttttagggtccaggaaataggcagaggaataggcaagtaactattatgaccataatatttgcgaaaatataggtatgtataaagtggagagaaaggattgcagaaggctctgcagtttagttttgcttgaacaatctagtttgtccagcagtaaagggaagggaaggagaatttcaggctgaatagctagcctaagcaataacacagaggcatggatgagcacaactgtttggggccataatgagtagtttagggttttttgagcatagtttgcatgagtaatagcagctggagcgtgagcttacaaagtatcacgaaagccttctaaacagtttggagtttactctgtgtgtgtattatggagtttaatgggtattatggagttggccaaggtccttgaacattaaaatgatatagtttgacctgtagggtagaaaatggttttgagtcatgtttcccaaaagttagttttgacactttagtagcttgtgcaagatgctgattttatagtctggtgaggtacaggaatccctagttttaaaaagcacttccagagattctgaggttgacggttccaaaatgacaaaagtatatataagataatggcttggcatataattccaaactgttagtatcatagacatattttgagacaatgctttagtattagagctgatcagatgcttggtaaccaaactttcagacaagcagtgtaaaaatctagcagtctctcatgtcttagagtttattctttgatttgtggacacattcccatcaaattgcatctttctccagcagtactaaaatatacatatagctttgtttttcacatttaacttactgtaaaccactcatataatagtaaagtctcaatatgatttgagcaaatgctacatcagtaggaattaatggcattaccatgatgtggaattgctcttctttatgagatgttaatacttccacttgttcttatctgacaattctcattgtcatctgtttatttgtattcactcttctgttatgtgagttgactttactttttattccagtctcaattcaattttcctatcctgcctcttaatttgaaaactaagtataaaatggaaactttaactttcatacatcttgatacaaaaagatgggcaggtattcttccttgctaaaaaatatgaagttaaaaatgaaactaaaaacatttatcgttgggatttttcatcttacagtatattacatcaggagttatgaggtcaaaatatattaggcaattactgtacaggaaaaacaaataagtacggttaaccttgctaaacttgatgtttttgtaagcatcatcatgatattcattcaagcaatttatagtcaaaattttagaacagcatatatactcatgtgatcaagattaatttcaaacagaagtgtaaaatgcacagaagtgtctgcagcgcttccatctacccctccctcaggggctcaactccctcctgctaatttgtgactgccagtgcacaaagtatcttctccagcatcaccttagacaggatatcagacagatagctaatggacaggccagttaatctggcacaaaagttgtgcaaaggcttgaagattctaaagttactttgcaaatttgtatttttcctgaggccttctggaaacatagatcaattatgaggggacatgacagtggtagaaaccacagctacaaataaaaggctgggcaggctggggtgggtagacctatgagagtgccatttttcaaaatctcttaactcataaatggaagcaaccagctactccatttgcaggctgaatatagaactgtttctacatatagatttaaggagaacagatagagcaacaccattttacagttaaaagaaaaattgatgataatccatttagatctaagattgtcgattatcacttacacgtacaagctcatgtgattgtaagaaggactaacagttagaaataacctaatacatattatgccaaaaatgaaataaacatgaacatactaaatgcaatctatttcccaccgaatggaaagatctgctcaatgctgtctatgatattactgttctgtatattctatgctccttccaacatgccttcagaatgctttaggctactgaaaccaatggaaatgaacttcaaagaaaatcacattaaaaggtcttaatgctttttggaaaagtcatatgttaataacaaaatgtctcaaaataataaaacatgaaatttttcctaaaagactaaaagcttttatatatgatactgtcatatatttgttccaaaccaggcacttttaaagcattaattatcactgtttatagctgctagcacaaagtagaatacagaaattccacctactgtggaacagaattagttccaatcaatgtcaaatgtatttctgagcatataaataaggggtctgaactaactgaaaaaccttacctgaaaacataaagaatatactgagatgtgtcagctttttgaaaccaataacaacaataataatgagcacttactatgagcttgccagagccaccaagggtgtccagaagcatctttcagatgtactcaatctacatgataacccttggaggtgtgcagtgcacaacctgttcagctatatgtagtggtgggccttccaaggatgttctaagcattttggatatattaactcatttaatcctcatataacctgaatagtctggcactctccaaaatttgtatgtccagtctagactctgtgatatgcaaacttatacttccaactgcttacgaaccatctccacttgtgcaattagcaggcacttgaaaatacacatgttcaaaactaaatccatactcttcccactccaatcatacaaattattcctgtacagtcttccccatctcagtcaatagcagctcaattctttcagaagcttctgccaaaaactttggagtcatcctcagctctgttttctttcgtcttacagcccagatccaaattcatgaacatatctcgttgtctctaacttcaaaatctgtctagtatccaatcatttctcaccacctgcaccattatcattgtaatacaaaccactatcatctattgcttggattaatgcaataacctcttatccggtgtcctagcttccaccctggcccctttacaatctcttctcaatatattagccagagcgatctttttagtcagaccatgtcaaatctcctaagttgccatgtgcctcatagtacatgccaaagtccttaccacagtcttcaaggacctacaacacgtagccctctcctccctgcctcagtattttcctccgggcttactcctctcactgtcatctcctgctgttcctaggacatacaaggttcactcccacttagggttcttctgtttcctcttcctctcctcctctaagagcctataaagcaggtttacccactaacttgctcttgttagatgtcacctctccatgactcccctgacccactacatttaaatagcaaacattccagatagatttactagattttatttctaatagatgttcaaattggaaatgctgtataatgcataaaaacatgaaagaagaaaaaaattcataaccttgaattttggtgtttttcattttctagagtgtgtgtgtgtgtgtgtgtgtgtgtgtgtgtgttgcattttaacacgatgtaatactttatacagttttgtcatctgctattttcagtttacatttttatcctaaacattttggatgatattaaataaatataattttatttctttggtagatttaccttccgtcatatagacatgccaaaattcaattaactattttgccttatgagatattttcactggtacatgtaggagataaatacatattttttaatgaaaatacacattaagaaaataccactaatttcacatcatatttttcagcagatttgtagctcattaaaagattacttaaacaatagaaagaatgtgaccatgtgtttcattgtgtccttgtgtaaaacactgatgggatctgaaatagatgaggggatttgtagatgactggcacatgtatcagaacatttgataaaagtatgatgtgctaattggcctggattgacgtcctagctccaggagtgtgccaaaagcttctgtacacatctatcatatttgaccttttagtcactgagttgcataaaatgtttgaaatacacttatcatacttgcaaatgacacaaatctggaaggggtagtgaatactcttatggagaataatcattcagatttaggaagaacttggtggaaggaacaataagctgaaattaaagctatgatatttaataggatcaatgtaaattcttgcatttgtggttctgaatcaacatttcatgtaagtatcaacagatatgtactcttacataaaggctctctggcatgagacacattagaatttcaaatctcacctgttactggttgtgtcattcctcaggcaggttagttaacttatttcactttgtttttatactttggacttaaatgtttatcctaaaaatggaggtgtacactatactgcatactccaatctatacagcatgatcaacatcatcaacctcaccacatcatctaatgcttactgagcactctttactctctgcacagcgcagtaggtattttatatacattatcttatttaattttcacaacaacatgatagcataagtactaccatttgttttattttataggtgagaaaatgggtcgggcgtggtgtctcacgcctataagcccagcactttgggaggccgaggaaggcggatcacgaggtcaggagatcctggtcaacatagtgaaaccccgtctctactaaaaatacaaaaattaactgggcgtggtggcgcgtgcctgtaatcctagctactcaggaggctgaggcaggagaatcacttgaaccagggaatcagaggttgcagtgagctgagattgcgccactgtactccagcctggcgacagggtgagattcctcaaaaaaaaaaaaaaaaaaaaaggaaaaaagaaaataaaaagcatccttatttttattttttaaaggtagaaattttaattaatcttcacacttcctaacatactatgactgagaactctagaagtgtttttgatggtgatgttttagagctaaagtacattatataacatccacagcaaagaaggatacgtaatatatgctgttatctgtccttctagtttcatatttggttgtttaatcagcgacatccatcttaatcagaaattattttttctttttttttggaaaaagcgtcctttaagtagagccagagaattgtccctctgtggcacatcagccctttttatacgtagcatgtttctagtcaaacatttttgttcttgcccattatttcatttctaattggcaattactttgattctattatttgtttattaaagttcagcagtaaatgggtctaaaataaatgtcaattaaatacaaacacattttagtaattggcatttatttctaaaggagaatgtgataggaaattagagctcacagtttaggaaagctaaaatattcaaaatacaactgagtatgtaaccaatttacagtattgtcacttacttctctaagtgttcatttatatgctcacaaaatgcaaaaaatacaagcttttactaagtgctggtaaagtgtggaaaaccccagctattaaatcatttttgtctcctttcaggctccattatttacaattggtggaactgtgggtaaagaactttacctaagagttgactttcttcattaagaaaatacaggtaatgatacctacttcacatatttgatgaaggaatgactaagttgaatatcacatgcaaagtacctggcttgtaataagcagtaatcaatgttagttccctttttcttccatcgcaacacattacataacaattttactgaacagcaaagacagacaaagagggagagggtcagtagaggtgatatggcagatacataaatggagacagaaatgtttatgcaaacagggttgaaatgatcagtaaggtaccacaggtcaagcaattggaagcggggagggtgtgaccccttagaggctttcgcaggcatagcagacaaagacaagcgggtttcaaagatttctgcatcctttgacaaaggcgtgaaaagccacagtttcagcaagaatgttacgaataacccaactccagtgaaactcactctgccactggaacttcgggctcttgtagagttcaggctggtgcacgtggagagagaaaaagaaggcaggaaatatttccaggtatgtttcagaaagggaaacagaaacccatggatggagcaatggtggattagtgaagaagattagatgtcactgatgtgggggtctcagcccactccatgaccttcatctgtcagattgctagtgagacatgctaatgggtccctgaggaactgtaaccacccacgtgttcactttgtgagtggtgtcacatttgagaaacgtggttcaacagctaaaattcaagcaaaagaaatttactgctctcaaaggacatgaaatgggatccaaagcattgcccatggcaacagttctaaactgttttctcacatgactctcactctcattcagcaaaaccccaatcctagttttctctctcttcctgctgtccgtcatcacaaaccttttgtccttctactcccaccatcattgtatcactattatgtgattgatggactaaaccattctcctcaagtatttttcattccatttagctctcttatcaaataattatttgcctgttttttgttatgtatcttaagtgtgcattacaacatctagggattgtgtgtgtgtgtggtgtgtgtgtgtgtgtctggagacatgagaacggtttggtctggtgcactgaaagtattaagcagacacaaaatatctgagaaggtacaaaagatagactatgaatattcccatatttgtacattttatcctgtcagaatagtcagtgtttaaggagaaatgtttgggttctatttcaacatgaacataaagaaattctgataatctgtgtgtagtatggtctccatggatagcctgtgttttcatctggcttccacttgatagttccaagaatagaaatatctcctatataaattcataagaaatgagtgttgtcatgggaaaactgagatggataaaattattatgagttccttaagggaaggaaccatttcttttccatagttcctaacagtgttcaaaacacaatgggcttctcagattcaataaaccaacatttcctttactaagaggccagtatcttcacatcatagtgctaacacagcttcttcaaccctgagtacattttgaaaggtcttataatatctgtggtttgggactttataattatggctggggccattaatcttacagccttccttttttattatatataagattgagactgagtttttgttacagattgctagcctgtagcagtcagttgtggagattagacatcaccgagacagataacaaagaaaaatggataacaaattggaaaagattaggtagctccacaccacaatattaaacaaagtcttctgaggtctaacagcccaagactcatcgtatgttactaccactttttcatctgtcaaagggacttgctgttaaaacaaggccttagctgtgcgtgtgtatacacacacacacacacaaatatatgtatatgtccaagtcctttcacttaaaaagaactcaaattaacaaataggcacatttctaaaatgccactgtaagccaaaggaataaaaatgtgattttaaagttgatggaggttataagaaaatgacccaaaaggcattatagtaagtaataagcctaaaatgtcttgctgtagaatgttttcagtaattcaccttcgaagttcatacacaaaaaataaattcaaggataatggacatataatatattttaaaaatctgattccatcaaaaagctatttcagtggagttccttcttaatatactactagacagatctggaaattgagttattatttatagaaaaaagataaatgatttgcaaaccactgcatagacatctcttgcattccattgcaaattatttttaagtctaaataaatatcagttctattacctatctttcagctccagttttctgttttctaaaaaatgtttttggtcttgtaacttctgaaatacaaatcctttaatcacaatgaaagccctcgttagctagcatgctaaagaggtagttatagcttaaatatattacaattttattatgtacaaggcatggttctaggcaatttatttctatgataaacttaggaggaaagtactactacagattaggaagctgaggccagagaaatttaataacttgcccaagatcacacagtttgcaataagcctgggtctggagcctaaaaatactatctccggagcccatactcttaaccaatacaaccaagtatctaatttatgttaacagatacaaaaatagaatagccatttgggacaaaggagggaagagcacccaaaatatattagaacacacataggaagacaaattttgtgtcacaacaaggtctgatttctaatgggattaatacaaatgctcagaaagttcaacggattttaggaggacaggaatccattaggcaaagatgttgaatgagatcattataaagacactcattcaaaatcacttagggaatgacttgcatggagttaaaaagatgatttgggtcatttaccaaaatctttgatgtgtgtgataaatgagcggtttagtcaataacagtcagggtggagggtggtgtaggtggacgtcaagagcatggaaaaaggtgcccctccccatctcactccctcgcctcacaatattttaatctattattccaattcagttttatatgagaaaaatgagggatagaggggctaagcaagtgtagttagaaactcttggagacaagattcaaactcatgtagaaacacccaccttgagctcagacactaggctacctttcaaagcaaagaaccagaggcatcatcatgctttttggaaggaagattcagggggctttgtcctgaaatatggtcagataaaagactttggtaggagggataggaagagaggagaaaaagaaaagtgatgtctaatttttctctacctccttacatattttaaaaagtattcaacgtatattatactcttactcttaatgtaatttactattgataagaccatgttttgtttcttatccctcaggaaaaaaaaatctctgagcccattgtatatactaacagaaatgacttactatttcatgagaatgttgcaaaactgcatgatggtaatcaatctttctcttctgaaccaaagcaggcagattcctgtccagtatacaactataaggacccttagacatttgtttattccactaagaatgtatagcaagtcttttcaataaaaatagttggtatttaaaattatgcatttcaatgaaatttagaaatgtagaagtgatggttgtccatcattgtattgctttaaaaaacttttaaatttatcattgtattttttgtagtaaagccaatttctttattctgggaaaccttcactggcatatgttttaaacgactagtttaatgctgtattctaattcttgagtacagagtttgaattgatgccacagaaaatatttttgaaaaaattatctagatcaacatttttgtttaatgaagcacagaaaggtaggagaataaaagtggctgatcaagataactacctgtttgatgacttttcctttgtgcatttttattcaagcttttttctttcttttatgtatttctcttacttatattttgccaagaactttaagagaaatgtcactgcataattttctctccatttttctcctgtgtagaaagagcacctacaattggcaaaagaatcacctctaaattgaacataatgtgttcttgctgagcaggaaagaattaaataaaagttgcatacagctgcttgcaacaatctaggcttgaaagattgccaaatgggttagcagtttgatctgcttgttcatctttctcagctccctgtagataccacatcccttgccccaatcctctagtgtaaccagtggtctctccccttcctcctctctaaactttgaaataaaagtcctgaatgagggaacaccaataggagaggaaagacacatgtgaaacatcttggtaaatgttatgaaaagggaaagctgaatgtctgcacatgttttcagttattcataaacatcttccttttgctttctagttttcaagtgatgagaaattagagaaaaaaagggaaaatagttccttaagttctatttaattgtgaaactgaattctatgaaacactttcattagtaaacaaggatgaacttgtgagttgtgatgaaatctgtgaatgatggttgtgaggcaggagaacagggtctgaaggcagggaacctaacgccgatctgtgctgatttcctagaatggaatcaaaaggaaaaccccacctctccactctcgagtaacaaaaggatcaaaggctactccttttgcaacaccccactcccccatttctgcattgtggaggagaaagtaaagtacttctgattggtctgctcctgaaaccggtcagactggtcatgtcggccttgtcttcatttgcataggggtgtgacttggtaacttcacttcagtctgtttggtcaccttccaacaccagtctgactggttgggggccaccacttcattaatagggtgtaaagcaagtaaccaatgggaaacctctccagggtatttaaacatcagaaaattctgtaaccagcactctggagtcgcttgctcaaggctactcccactctgtgtagagtacttttgttttaataaatctgtgcttttattttattgctttgttcgtgcatttttcccaattctttgttcaaaacaccaagaacctggtcaccctccactggtaacagaacacttacataattactctcacccattacagagtaaacaaaaatagaagagagtaatactgaatagagtcagtgtaattgtcattcaattttacacagttactttaaacaccaaatatacaatcagggttttatgttaaaaaatcaattatggaatgcttcgtaaatctctcttttacattaattaggtgcttattatttgactcaatatataattttatttagtaaaaatgatgtattagtccgttctcatgctgctaataaagacctaccccaaactgggtaatttataaagaaaagagatttaattgactgacagttccatgtggccggggaagcctcaggaaacttacagtcatggcggaaggggaagcaaacacatccatcttcacatggtggtaggaaggataagaatgagcagaaggagaaaagccccttataaaaccatcagatcttgtaagaactcactcactatcaccacagcagcatgagggtaacagccctaaattactaaattacctcccactgggtccctcctataacacacggggattatgggaactacaattcaagacgagatttgggtgaggacacagccaaaccatatcattctgcccctggcctctcttaagtctcatgacctcacatttcaaaatgtaatcatgccctcccaacagacccccaaaagtcttagctcattacagcattaacctaaaagtccatgtccaaagtctcatctgagacaagtaccttccacctatgagtctgtaaaattgaaagcaagttagttacttcctagatacagtggggttcagacattgggtaaatacactcattccaaatgggagaaattggccaaaatgaaggggctccaggtgccattcaagtccaaaatccagcggggcagtcaaccattaaaactctgtaatgatctcctttggctccatgtctcacatccaggtcacgttgatgcaagaggtgggctctgaaggccttgggcagctctgcccctgtggctctgcagggtacagccttcctcctggctgctttcaaggcctggcactgagtatctgcagcttttccaggcacacagtgaagctgtcgatggatctaccattctggggtccaaaggatggtggccctcttctcacagctcctctaggcagtgcctcagtagggactctgtgtgggggctacaaccccactttgcccttccgtactgccctagcagaggttctccatgagagctcttccactgcaacaaacttcttcctggacatgcagacatttccatacatccttagaaatctaggcagaggttctcaaacctcaattcttgacttctgtgcacctgcaggctcaacaccacgtggaagctgccaaggcttggggattgcaccctctgaagccatgtcctgaactgtatgttggctccttttagcaatggccggaatgcagggcagcaagtcctgagattgcacaaagcagcaaggccctgggaccagcccatgaaaccattttttcctcctaggccttttggcttgtgatgcgagggttgccatgaagacctctgacatgccctggagacattttccccattgtcttggtgattaacatttggctccttacttatgccaatttttgcagccagcttgaatttctcatcagaaaataagtttttcttttctattgcattatcagcctgcaaatttgctgaactttaattctctgcttcctttttaaacataagttcaaattccaaacaatatctttgtgaatgcataaaactgaatgcctttagcagcaccctagtcatatcttgaatgctttgctgtttagaaatttcttctgccagataccctaaatcatatgtctcaagttcaaagttccccaggtctctagggcaggggcaaaatgctgccagtctctttgctaaagcatagcaagaatcacctttatttcagttccaaataaattcctcatatccatttgagaccacctcagcctgcacttcattctccatatcactatcagcattttggtcaaaaccactcaacaagtctctgggaagttgcaaactttcccacatcttcctatcttcttctgagctctccatattcaaacagggaaacaatctctgcctgttgtccatttccaaagttgcttccacatttccaggtattttttagcaacacctcactcctgctatcaaaatctgttattagtcagcgttctctagaggaacagaactaaaaggatatataggaaagagagtttatgaaggaaaattgactcacaggatcacaaggtaaggtctcaggataggacatctgcaaattgagaatcaaggatcccagtgtaaatcagcctgagtcccaaaacctcaaaagtagggaagccaactgtccagccttcagtctgtggccaaagtggccaaaggcccaagagcctctggcaaaccactggtgttaagtccaagagtccaaaagctgaagaacttggagtctgatgtctgagggcaggaagcattcagtgtgggtgaaagatgaaggccggaagactcagcaagtctgctcttccatctgctcctgtctgttttattctagcagcaccagcagctgattagatggtgcccacccatattgagggtgagtctgcctctcccagtccacttactcaaatgttaatttcttttagcaacaccctcatagacacaaccaggaaaaatacttcgtatccttcaatccaatcaagttgacactcaatattaaccatcacagatgagtgttttacttggagaaaatttaactcagttttaccaacctagcattttaacctctacgcctaattcttccaggcttagaaatttttgcaaattctcatatagcaggatgacttaaactttacgtgaagtacattttttaaaatgtggaagatcaccagatgtctcttactgtgaatcacttcacattaatgttccttgctttgtattttgtggttctaaaacattttaaaattcaaaagtattcaaagcaaagttaattccaccttattttccttattaaaggaaatatgcaatacagaatttgtttagaaaaaggtaacaaaaaaagcattcttaaattccaaaaatctctaattcttttttaaaaactcaccattttaaaaaatgttaggagttactacttcgaagaaaagttaattattcaaattgctttgtctttctccatctattatgtttgaacggtgtgaaaacctttctcatatcagtgacattcagttatagcatgatatattttttcaataaaattcacatattttagtgaaaatgcttgttaaaatgtacttaaaaataagtttcagagaaacaatgaaacctgaaggctgccctcagatagacaatttgaattccagagacctactatttcaagatattttgatcacttcagctcttcattggaagccaacaagtctgctccatactagaaattgcaagctgcttgaggctctcagaggcccccaaatcaggctcttaatacctacctcacataacatgcaaattagaaatagggttctttaagtgcctgtgatataccaggcccaggaggtcacaggcatttaaagcactgtgatttttattattgaaattaatgacatagaagtttcgcaaaacaacagagaactaaatattctctaagaggggactcgtgtatttggtagttggctcatttgtagcatgcccatatgttctatgccaatttcaaactaacacatggcctgaaatgtctgcatcatattaggctttgctaatcattttaccatcatagaaatcttatgctaggccagtgctacttacacctcttcctagaatcaataggagaattctgaagatagtcagattctcttctttaaacaaaaggtactcaggcagaatctctgagtgaattcagatacatacccacgattggaaaccttaatctagttacctgtggacatgacgaaccttggcctttcgtgctagtgctagaccatgctacacaacatctctgctggtcaccttcatgtaatattttttcttccaacaagctatggtcataaagaagatttaaggttcatcagtggaaactgaatctaaacatagttgaaggtggaaaattgccattttaagagctagagcagtaagcttgtggggtacagaggagttaatctttgagacagaaactcttgtttaatctgacagggaccacttttctaaaccttttagtcaaacataaataaaatctactcattagtcttgtggaaaacttgaatgcaaaagttagcatgagtgcaggtaagtatacagtttaataatttaaatgaaaaatgttagcagaaaatgatgctgaagagtcaaatgctttttctttacaaattttgagctaagctgccctacccctaaagaggctaaagtgattgttctttcttgcgaagtgtgtgtgtatgtgtgtgtgtgttttattcagcatttgctcacaagagactaggggctacgatcagttcataccatgcatgaggtgctggccgaatctcttggtgctcttatagagaaaaatgataagcaacggaactggcctcagcctaccattacctttacagggctgttcatattcacaggtggtagtacctggtgtacaaggccaactactaaaaatttctagaattttgagagcttttcattaaataaccattactaaatattaaactatataaacccacaattaaatgttattaaaacaaaggtaatatatactagaaattcattatttcctgaatagtttacaatgttttactatcttctgtgtaattgagtttacttacatctactgaacctgtatggtggaaatactacataatggtgtgatacctggacatctcttccaaaatccacactgattgctcaaatgggaagacgttagaaatatttataccatgaaaatcagtaagctcaacaaattggggcttttttcccctatttttggagagtagttattaaatatttatcagcacggcactgacatatggtataatttaagactgaagaaatcatgcttttggaaaatgcactattaaaacttgtctaagggatccacaccatattctgtgtggagtgtttcctaatatgacaattgacatttccactaaatcagaaacagaaaatgaaattagctttgaactgaatgagaggcaaaaagacctaggggaagataaagagactaatccctaaggtctgaacgtggtcagagggtctcagtagtgggggatatcttcaatgacaacacatggacagggacatggaagttaattttgggcctctctctctccaaataaccattcttattaataacaaaattatgttgataactaatgttttttcttctttttttgagatgaggtctcactctgtcacccaggctggagcacactggtacaatcatggctcacttcagtcttgacctcctggacttaagtgatcctcctacctctgactcttgagtaactgagactacaggtatacttcaccatactgggatatatatatatatatatatatatatacacatatatatatatatatatatatatatatatacacatatatatatatacacacacacacacatatatatatacacacacacacacacatatatatatatatatatatatatatatatatttttttttttaaagatggggtcctactctgttgcccaggttgctctcaaattccaggcttaagggaatcctcccacttcagcctcccaaatttctgggattacagcatgagccaccacgccttgtcaataactggttttatttgtgctttgaagggatcaggcacctgggtcttaaaagcagttgagggagtgcctagcccagctgtgacatgacgggagtccttggtagcagaggctgggaggttggcagtaagagaataagaccagagaggtgaagctatggaatttactccaagtttttggttaagttatatgtaaaagataagtagaaactaattaataattataaactgttgagactaatattgtatgtatgtgtgtatgtataaatttacataaatgtttactttttatgtacttattacatacaaatgaattttttatatactcatatatgttatgattttcaggaaaaagtaataatacttgcaatgcatgatgaatacgaggactaagatgagctaaggaagagagggtatgagataatcttctgttctaccacctggaggtcaggttaagtacttccaaggaataaatactctgtcactttcaagaaagtaaggattatacttctgtaactttatatatatatatatatatatatatatatatatatatatatatatatataatatatatacacacacacacacttcatatacatactatgaagtatatatactttatagtgaagaatatatatatacacacacacacttcatatatatacatatatcatatttatgtgaagtatatatataaaggagaaatgttaactagatagaaaacaacctggattactccggtctgaattcagatcacgtaggacattaatcattgaacaaacgaatcttcaatagtggcaacacaataggatgtcctgatccaacattgaggttgtaaaccctattgtcgatatggactctagaacaggattgtgctgttatccctagggtaacttattccgttgatcaaattactgggtcagtgtgtaaaatctcacttggactagtacggtcttagattgttcagatgctctgtggtcaccccaaccaattttttttttttttcttgagatggagtctccctctgtcgcccaggctggagtgcaatggtgtgatcttggctcactggaacctctgcctcctgggttcaaacgattcttccaccccagcctcccgagtagctgggattactagcacctgccatcatgcccgactaattttcgtatttttgtagagacggggtttcaccatgttggccaggctggttttgaactcctaacctcaggtgatgcccctgcctcggcctcccaaagtgctgggattacaggtgtgagccactgcgccaggccaagcagtttaaaatttttaatatggggatagtaagctagggcctgtaggcttgagtttttatttgcattaatgaattaaagctgcatagggtcttctcaccttatttgtttatatccgcctcttcacggataggtcaatttcactggttaaaagtaaagcacagctgaaccctcgtctggccagtcatacaagtccctatttagggaacaagtgattatgctacttttgaacggttaggatatcgcggctgttgaacatatgtcactgggcaggcagtgcctctaatactgataatgctagaggtggtgtttttggtaaacaggcaaggtaagatttgccaatttccttttactttttgtaatctttccttagagtatgactgtgttgggttaacagtgaaaataacagggtgcttattatatcgtttattaatattgggctgttaactgttagtgggttattccggtctgatgtaagcttatgcaatggagaatgtcttcatgttacttatattaacatgattgcttctgttaagtaatagattagtccaatgtaatgttaggagttcagtagagtgactagaatttaagatagttcgatgttgaacttaaatgctttcttaattggtggctgcttttgggccaactgtggtgctaataatttttactctctgtaggaaggttgtttcctaaggtcaaaagagttgtccctctctagactaacaattaaacttacaggggaattaagtaattctttgggtaagtttaaaattgaactaaggttctatcttggacaatgagctatcaccaggctcagtagggttgtcactgctagtcatgaatcttcccactattttgccagataggtgagtgtggtctttcagctgttcttgagtagctcgtctggttttgggggacttggctatagttctctgtgtaaagttatttctagttaatagattatgcagaaggtataagggcttgtctttgcttttttagtgcttgatatagctcttccatctttcccttactgtactatgtctattgcaccaaggtaaaaatttctattgcctacacttttgtctaagtaaatggtttgattaagatagtttgataacatttttagcaaggtttggggctagagttagctaaaagtgatcaggccatgatgaaatcttctggccataagccagatgctttgggttaagctacactttggtttgtccaagcacactttccaatatgcttaccatgttataacttatctcctctatagatgtgtagacaattattagtaatagtgatatctagagtaatacttgaggagggtgataggctgtgtgtacgtgcttcatggccttattcaaccaagcactctgctcttggtttactgctaaatcctccttgagccctcagatttcacaaaggttttcatgagatttcctggacatagaaaatgtagcccatttcttgccacctcacgggttacaccttgacctaacgttttttatgtgtatacttatgcttaatctataacttttttagggtttgctgaagatggtgatatacagaccgggggcaagagatggtgagttgtatcggggtttgtctattatagaacaggctcctctagagggatgtaaagcaccgccaagtcctttgagttttaagctgttgcttgtagtagtctggcgaatggttttgttaatgtaactattcgactttagggctaagtgtagtggggtatctaatcccagtttgggtcttagctattgtgtcttcagggtattaaagccactttgtagtacatttgatttcagctggagttttttacaacttagatggagttttttacaacttagctttattgaggatagaccttaaacattctttatgccgagttctattagcttgtgttaatcatatggctgtggtggctggcatgaagttaaccaaccctaaatattagtaaagctcagtcaagcttttgtttattactaaagatttatcactgctgtttcccataggggtgtggttgagcaaactcttttgagctgcattcgtgtgtgcttgatacttgctccttttaatctgggtgatctagagggcattttcactggggtggggatacttgcatgtgtaatcttactaagagctaataaaaaagaccaggacaaaacctatctgtttatgaggttgtgtgaacccatctagacattttcactgtcttgctttgaatacttaagctatactaactgcatggaatacgtaagtgaaaattaaaatatgagaaagaaagaagtaaatacaaatggttgtttacagttctggaaattcaggttctttaaagttgaattggcagaggtttggctgagaggatgactcataatttgaatatggttgatttaggggtatgttatattggggcagtgctttcagagggatatgctcaaggtattatattagtattagggcagaggtttagttactctatttattatacagaatggagggtttatttggtaggagggccttaagattttttagaaaattacatcaattgaggtgtagctgttggagcgttcgtggttaaaatatgatttctgggctctgactgggttgcattttagtatcttgtttttggggtttggcaagggtacatttacctaggttgatggtaaaggcagagatggagggaggggagtttgcagatgtaatcggaaatagttcttcaaattgagcataggtgcgtgggggtacatgcatgagcgtatatgcgtgagcatatgtgcgtgagcatctactgattaattgttatgtccttcaagcatgatatacttctcctcacatgacaaaaactagcccctatctcaattatgtttcaaatcttcccatcaacaaacctgaacatcctcctatcacaattctatccattatagtgggtggttgagggggacttaaccaaacacaactgcgtaaaatcctagcctactcctcaatcactcacataggttgaataatagcagtactaatttatgacccaaacattaccactctaaatctgattatttaccttatcttaacaacaactgcatttctatcactcaacctgagtataagcatcacaaccctgtcactatctcatgcctgaaagaaattagcatggttgacacctataattccactaattctactatccctacgaggtttacccccattacagggttcctgcctaaatgaatcatcatccaaggatttacaaaaaattatagccttgtcaccccaaccattatagctatcataaccctactcaacctgtactcttacatacacctcatttattccatcttggtaacactattccccacatctaataatatgaaactaaaatgacaattcgaaatcgcaaaacccacactactccctcctcacttgtcatctcttctaccgtcctcttacccacctctccattaatactaactataacttagaaatttagtttaaataagaccaagggccttcaaagcccttagtaagtaaatgacacttaatttctgtaacagacctaagggctgcaagactctattctgcatcagttgaacgcaaataaaccactttaattaagctaagcccttactagactggtggaattcaaaaccacgaaaatttagttaacagttaaaccccctaatcaactggcttcaatctacttctcccaccattgggggaaaaaggcaggagaagccacggcaggattgaagctgctcctttgaatttgcaattcaacatgagaaatcacttcagggctggtgaacagtggccttgacctctgtcttcagatttacagtctaatgcttgctcagccattttatacccccgccgccgcccccctgtgttcaccaattgttgattgttttcaactaaccacaaagatatcggaacactgtacctgttattcggcacaagggcggggatagtaggcactaccttaagcctcctaatttgagcagaactaggccaaccaggaactctgctaggagattatcagatctacaatgttattgttaccgcccacacattcgttataatcttctttatggtgatactaatcctaattgggagtttcagcaactggctagtccctctgataattggtacacccgatatggcattcccccggataaataacatgagtgtctgacttctccccccatcttttctactcgtacttgcgtcttcaatagtggaagccggcgctggaaccggctggacagtttatccccctttagcaggaaacctagcacatgcaggagcctctgtgaacctgaccatcttctcgctccacttggcaggtgtctcttctattttaggggccattaactttattaccactattattaacataaaccctccagctatatcccaatatcaaacaccccttttcatttgatcagtcctcattacggcagtccttcttactcctttcccttctagtcctagcctctggcattactacactattaactgacaataacctcaacactactttgtttgaccctgctggtgggggtgaccttatcttgtaccaacatgtattctgctggtacaaagcttcgggataatctcccacatggtaacatattattctggaaaaaaggaatcgtttggatacatgggcatagagccatgatatcaattgacttcttaggatttatcatatgggctcaccatatatttacagtaggggtagatgcagacacacgagcatacagcacctctactaccataattattgctatccctactggcatcaaggtctttagctgattagctaccctgcatggcggtaacatcaaatgatttcccgcaacattctgtgccctacgattaattttccttttcacagtagaggtttaaccggcatcttattagctaattcatcactagatattaccttacatgacacatattatgttgtagcccatttccactatgtcctatcaataggagcagtactcgccattataggaggctttgtccactgattctccttattttcaggctatacacttagtcagacctatgctaaaatccacttcaccattatattcataggtgttaatttaacctttttctacagcacttccttggtctatccggtatgccttgacgttactctgattatcctgatgcatacaccacgtgaaatattatcttatccatatggtcatttatctcactaacagcagttatactaataatctttatgatctgagaagcctttgcttcaaaacgaaaagtactaacaattgaacaaccatctgctaatttagagcggctttatggctgtccaccaccttaccgcacattcgaagagccagcctaaaggaaaacctaaatgagaaaagaaggaatcaaactcccagaaactggtttcaagcccatcccataacctctatgactctctcgataagatatcagtaaaattgttacacaactttgtcagagttaatttataggctaaaccctatatgtctcaatggctcatccagttcaattaggccttcaaaatgccacatctcctattacagaagaagtactcactttccatgaccacgcccttataattattttttataattatacacacacacacaatttggcaaaaggttgtttgagaggaacttatcatatataataaaaatgaaggctgggcgcagtggctcatgcctgtaatcttagcactttgtgaggctgtggcgggaggataacttgtgcccagaagttggagtctagcctgggtaacgtagggagagcctgtctctacaaacagtaaaaaacaattatctgggtgtagtggcatgcatctgtggtctcagctactcaagaggctgaaacaggaggattgcctgaacccaagcggtcgaggctccagtgagctgtgattgcaccactgcactccaactgggtgacagagcaagacccagtctaaaaaaataaaaaataaacaaaagaaaagaaaataaagatgtatattgaaaactgtactcaaaaagtgaaacaatacattttcatctcaaggaactaagagacaagaaaaccaggctagcaggtgtattgtgcttgcttccgtaatgttcttagtaaaacttaattcctagagtgagtttcagttgacctggaaagcctcttcttataaatagagtgtcaaaggccttctatggtgtgggtcaggtgcaagtccttactttctcaaaacagcattaaaaaggcagctgagctgccacttgatcttagtgcattcttttttaaacacattttagattctgttagttctctttgctaatattttattcagaaaaattgcatctgaattcataagtgatcttaagttcttttgttttttgttttattaaaacaggtccataaaaatctgttttatcggtattttagaaaaatgatcttttggattcatacagattcaatgtatcctttccatgtctgatgtttttcatatattcccatttccataatttagggttttatttaaaaatatcttttgaaaacagtgtgatttcattctgtgtatacatttatgcaaagttagatgtattgtatgtctaatgcacacaaactgaagctgtactaaaatacatcgagggtaaattttcttgctacttttttatttcttattttttgctttactacacaataccttagaaaggcacatctattttacctaaatattttcatatagaaggagtaacacaagttggtaatgtaatagatgaggtttaattgtactctatctcgagaattctatttcaagaaagctagttatatgtaatacaaagtgcaatattaattaggagtgggtcattactatgatatgtaaaagtcactgaaaaaaaagtttaaaacatggacagaatgaatgcaggcagaacatctggttaaacaagtaattagtcctggaattatgttcatgattatagtggtatctatgaatttgccaattccccctctcccacttcagttgttagttggtatttggttctagaaagcaactaagaatgagtgatgtacctggcgtaatcaaagaaaaaggttgtagggactggagcagctgaggattgttcttctcagtgtcttgatgagctaaacctatgagagacaaccttctagttactaaaacacacttaaaatgtagaaacatagttaaatgtcaatgaatatataatgaaaatgtaactgtcacatattttaaaaatacttctgtcctcatatggtcaattcatataaaaattataattgcaaggtcctttattcttttgtcataagaaatcacccttggattgacacattaactcatttattgctcgtaatagccctatgaagttgataataataacagctcctgggcaaaaaaaaagaaaaacctatgtgtaatctttcaggcaggagcacagacaattactttacctggcaggcctcctggggcttcaaagctgtcctcccacgccagacttggtgcccagtcaatgcactgcagtctctaagggggttgcagtaagacactcagggtttgctgaccagccatgtctcatatatgtctcccatcctggcccaggtacgctattcatagacctctttattaaggtcttttgacagcggttttccttaggtgctttcactaaaatctccttaaggggaggaagtaagggggcctggaagacaccttttctccactctgactccatacttagtacttttcactcaggccttcccacccctctctccttcaagcttccaggttcataaaactttcagaaccattttttttgccactccctcctcagtgaaacaattccccatgtctgcactcatccatctgaccctcagctggcactgttctatggaagaaacatgagactgtgaagttgatgctttttctggtttagcctttggaataaactattgcagtaagtgattaaaagcttgactgttatcctcatttttgcttgtctgaattgaccactgtcacctagcagcttagctgtcagctcagctcagctcagctcagctcttgacactctctgtcttttataggtaaggagatagagtgactgagggcatagatgacttgcttaaggtcaaattgctggtaagcagcagtgccatgatgtaaataagttgccctctaaaatttaagcaaataggaatatacaagaacattaatatggaaaaatagagaaacaatgatttctcatcagagaagatggtgtagttcagagaatggattcgggagccaaactgtgtggtattatttctgagggctctgttctgttccattggtctatatctctgttttggtaccagtaccatgctgtttgggttactgtagccttgtagtacagtttgaagtcaggtagcatgatgcctacagctttgttcttttggcttaggattgacttggcgatacgggctcttttttggttccatatgaactttaaagtagttttttccaattctgtgaagaaagtcattggtagcttgatggggatggcactgaatctataaattaccttgggcagtatggccattttcatgatactgatccttcctatccatgagcgtggaatgttcttccatttgtgtcctattttatttcattgagcagtggtttgtagttctgcttgaagaggtccttcacatcccttgtaagttggattcctaggtattttattctctttgaagcaattgtgaatgggagttcaccatgatttggctctctgtttgtctgttattgatgtataagaatgcttgtgatttttgcacattgattttgtatcctgagactttgctgaagttgcttatcagcttaagaagattttgggctgagacaatggggttttctaaatatataatcatgtcatctgcaaacgggacaattagacttcctcttttcctaattgaataccctttatttctttctcctgcctgatggccctggccagaacttccaacactgtattgaataggagtggtgagagagggcatccctgtcttgtgccagttttcaaagcgaatgcttccagtttttggccattcagtatgatattggctgtgggtttgtcataaatagctcttattattttgagatacgtcccatcagtacctaatttattgagagtttttagtatgaagggctgttgaattttgtcaaaggccttttctgaatctattgagataatcacgtggtttttatctttggttctgtttatatgctggattacgtttattgatttgcgtatgttgaaccacccttgcatcccagggatgaagcccacttgatcatggtggataagctttttgatgtgctgttagattcggtttgccagtattttattgaggatttttgcatcaatgttcaccagggatattggtctaaaattctcttttttttgttgtttctctgccaggctttggtatcaggatgatgctggcctcataaaatgagttagggaggattccctctttttctcttgattggaatagtttcagaaggaatggtaccagctcctccttgtacctctggtagaattagactgtgaatccatctggtcctggactttttcattggtaggctattaattattgcctcaatttcagagcctgttattggtctattcggggattcaacttcttcctgatttattcataattacagttaaaaaaagagaacataatatttaccatcttaaccacttttaagtgtatgtttagtaatgttaagtatattcacattgttttccaacagatctccagaactttttcaaccttgagcaattgcaacttgactcgttaaagagcaattggacatttagccttccttccaacacctggctaccaccattctacattctgttttctttgagtttgacagttgagttacttcatgtaagtgaaatcatacagtatttatgtttttgtgactggcttatttcctttagcatagtgtcctcaagatttattcatgttgtagcatgtgaccagatctccttcctttttcaagctggataatatttcatcattgtatgtatatactgcattttgtttattcaatcatccatatatgacatttgggttgcttccacctctcagttattatgaataatgctgctatgagcatagatatgcaaatatctcattgagaacctgcatttaattcctttggatatatatccagaagtgggattgctgtgtcatatgataattctatttttaatttttgagaaaccaccagactattttccatagtggtcacaccattttacaatcccaccaagaaggattccaatttcttcacctcctcacatttgttattttcttttttatattttaatattagacatcctaataagtgggagacaatatcttattgtggttttgatatgattttggggttggtttttctctaatgattagtaatgttgagcatctttttatatgcttgttggccctttgtgtaccatcttgtagaaatgtctatacaaatcttttgctcactttttcattggattatttgcttcatgttattgagttgcaggttctacatatattctggatattaattccctatcagatacatgatttacaaatatttttccctttctataggttacctttcattctgttgattgtaccttttgatgcacagccttttttttttttttttttttattttttgagacggagtctcactctgtccccaggctggagtgcagtggtgccatctcggctcactgcaagccccgcctcctgggttcacgccattctccagcctcagcctcccgagtagctgggactacaggtgcctgccaccacgcccggctaattttttgtatttttagtagaggcggggtttcaccgtgttagccaggatggtctcgctctcctgatcgcgtgatccgcccacctcagtcttccaaagtgctgggattacaggcgtgagccaccgcccccagccgcacagacgtttttaagtttaatatcgtcccatttgtctattttagcttttgctgttggtgtttttggtgttatatccacgaatttattgctcaacctagggtcataaagctttccccctatattttctgccaagacttttatagttttaagtcttatgcttaggtctgtaattcgcttttgagttaatttttgaacatggcatatgatgaggcccaagttcaatcttttgcacatggatatccagttttcccaacaccatttgttgaagagacttccctttaaaatatattatttatgcctatcactgcttgaaaatgatattagatattaatcctactgctaatatttttaatttaatgtatgaataagcatattactatattaggtatctgtttcttaagcattttgataaatgtatctcaacctaacttattttccttgtaatccattgtaattcattttatgtatttattgattgctatgcattcatgaattaaagtatttgttttgtgctcattttttcttctaaaaatattatgagaagaggtcaatgggcttcaccaggatgctacagtgtccattgcctcaaaaaatattaaaaattcagagtttgttttagtaatttagacagatgaagtcttgaactagggcaatcataataataaatatgtaaaatcaagaaatgggcaaagatcaggatgactcggtgattaactcccaagagccaagtgaaagtaaagataataatgaccccccaaatttttaacttggttgagtgattggttggtggtatgtagttctagggagtcatcaacctagaggttgcatttaaaaccctgagagtgtctgagattacctctggggagaagacagagaaataaattgactaaagataaaaccataatagtcaaaaaacagtcaattcattattaatagctatggtgtcatgcagtacatataatgtgtcagcaaataaaactactatgtaaataataaaactttggcaatcaattggtagttaatttgtaaaagaccattggttatgactctactctgcatttataatttttgcacctgcaattatttacatgaaaaaaacaatacagccacagttgcctaattataggcacaaccatccaaatttgtcttcaaaaagaatagcacaaagagacaccatctgtgaaagtgcagcaaacccctcagacctttcctgctccaaattctgtaaggctggtgggcacacttcccttttggcttctgtctcaggctctattcttgcacgatcttattcatgccttacagaccagtcagtctgataagctgagagtcagcaggtctttccttttacccaaccaatatccacacctccccaccactaccctgccaatataatatgtgcaatagcatgggcagactgaaaacagaaggcatttctgaaacacatcatttgtcttgttaatgtgaaaagattccatttttctcacatgtaattttacaaagtaggcaacatgaatgccataaagggaaaatcccatacaaatttctgttcaaaggtgacaagaaaattatgttactctactttttacataaagttttagccatttattaaaaacacagctgtcagttttgatcaaatacattcatatttcccattatattattagggccatgatgaaatttaataattgtcccttggagtttgatttttcacaaaaatgtcataacacaatcagtaatatagcaaataattattgaactatgttgagacagttatgatttcaggtgggaaatatataatagatgagaaatataaaacccaggttaacacttgatgaaaattctgttttcatacaaatgtcagtaataataaatgtggggatcacatagcctgctttatgaaaatgaaacagataccagacagaataattttcaaaggtttaaatcatggttcaaatattacttgcttattattaaatcatattaaacactttaaatctgataaattctttgtggtagaaagaatacacattttaagaatgagaaattcagtagtttattcgactaatgactaaaatcagactgtaacatgtttcttctatatgaaatctatatttctccattccataagtgtttgaaattatcataaagtatgaccacgaaggcttcaggggcaaatgaaggcttaagaattctcaatgttcactagtttttacttttttattgaaaaaattatagtgaataggaaggtacatttttgttctactacctttgtctcaatgggatatgggtcacagagacttgaagcaatagttagataccagccttaagtttgtggatagtggaacacacatttgtacattggaagtatgataaagtaatttaaattaagcaaagaggaacatgttaacaaaatgagaatttgtgaagaggaaacatgatttccaaaagagaattagctagaagtaaaaggttgatcagccatttgttctgccatatataactgaacatttcaatgaatgcaatcaaagttcaaaatattagtaatgacataataagcataactcattcatcgccacatagggtagaacattttgagaaattaaaaagaataattctacttacatcctgaactaccatttgttgacacaagagtcaagttggaaggccatgggttccgaacaatatcttgccaatgaatggtgtctgcataacaaaggaatttgttctggtctacatagactccaccatttaggatttctgtattaaaaaacaaataaacaaattttttgtcaaactgcttgttgatgaaaaggtaatcaacaaaagtgatttgctcttaactattttcaatgttaaattagagtcatgttgctaatagccaagatatcttttaaaatatctttcaatgaatcatatacattgattacaggaatttgaaaagattaaaaattacaaaagtgaaaaacaaccactcatattctacactctgagagtaacactcctaacattttggtataaatgttacagtcttttatctgttttcttccctggaattgaaataatattttatataatattttataacctgcttgtttagtttaatattatgtagtgagtacttaatggtaattactactctgtattttaatgagaacaggatatgtcatagtataaattaaatggtaattatttaaccaatcctctcttgttggtaatttaacttatttatctctcattggtctttacaacaaatttccacacatgacattccaaggtcatagagtgtggatagttttaagatatttggtatcaattgtcatattatccttagagagattgtttcagtcaaggtgacattgactgcagtcagtaggtaagtaattagcacaaagtggaagctaaaattaatgcctcaatcacaaaaatgttgtcatctcaaatgaaatcgataagattgccaattattcttaacaacacaaagcaatgtataacaaatcctgtggttcactgaagtaaggatacggctgtgggataacatgcactaaagccaatttgtacttgattctttatttcacaacactggccttgattagctaatttgtcctccacaaacaatgactgaccacagaaatgaattctctttcggatagctttaagttatccaggaaaataaaaactgaaatatatcctctgaaaatattattcttattatttgaagaaattagctacaaatacacatagcaccttccagcccaatatgtaccacatttccccttcctgttcaatacaaaagcaatttaagagaaatcatgcatcagtccataaagtgttcaactacaattaatcaaaacccaatcaacagtttatagagataggggatttcttttttcacataagaaacctataggaggcagttgcagatattagttcagctgttccgcagtgcccactatctgttctgccatcctcagtgtgtcagttttattcatttcaggcacaagatggctgctacatctaaaaactaaactgcagtccttctgaattgcaggcaggatgaagtcacaagagcaagcaagagacttcctcctagtgaagctgtgactttttatttgagaagaaatgctctccttgaggattatgtctgcatttaactggccagaacaatatcccatggttatctctaccgcaagagagattgaataagtaactattgaggtggaaatattgctactgggacaaaacccagaccagcaggggtgttagtgaggaagaagagggacatggatattgggaaggcaaccgacaccatctcccacggtagccttgagaaattcatctctcttgtgtggaaccccaagctaagtttgtaggagtcatcttcaactgaagagagataaatgaaaggaacgtgtcacaccacaagagggttatttgtggactggtggtcacatcccaagtgccttactgcattgcatgtacgaaaccctccagattagttttgatattgtagttctttctacatttaaaatcactcccattttcatcatcagtcatttcactgactattggttccattttgtcggtgaggaaaaaaaaagaaaagaaattagatcatctttctacttctaaaacccagttcattattttttatgacctaaccatacaaccttcatcaaagcagaagggagacgtaagacgtaagaaagattgtgaaatggatttctacattaatgtttggcattaagtttttatctacgaaatgtgatgatctcatactaatagctttctcatgagacattaggtgatgctcttctgctctaggaataattttccattaggtgacaaagaaaggagattttgactgctatccaggaaataaaggttatttttcagtctacatttagaaaagttctacttaaaaaaaaaagtgaaaaggtaatagctcaaacattgcagaaagagtgtatatttttcaggagtcacattgtatttcaaatagttcatacaaaggaacacagtatccatctccaacttcctatctaaaatttttcaaatagaatcagattatattatactgaataatagtcttatcaaatccctttcttcaacagtattaatctgctatgaatgttgacatttgtttcttagaaatagtctgttcgagagcttggcttatacttggaaaagggatttagaaaggagacaataataaatccagcataatcttacacgttaacatttcaaattaagacacatgatcaatccagatgatacttttatcattcctaattcaaaactcagcatctgctagcaattctggtcaggaggatttataaatgtttagcaattaatgatgggtagtttatttatgtattgtttgttttccttgaaaatattcttttttcctttatgtttggtatacaccctattctgctgttgaatgtcaaagcctcacagtcagagaatgtagaatttcattgacacttataggacagttttaatgtacagtcttacactttcttttgattaatttgattacctaaatatgtgtcagaaagtaatgttataatggcatttacatatattcttaaagttttcattgattttgtaactttacatttttaaaatatgaatttgacatatttttgtgagaaaatatactcaggtatgtttattactgtattaaaaaaattctagagaatagatactaacctgtaagaaagttcttagagatacaaattatttacttgttagaaggactgcctaatgtttctgtcttggttgactacagaggcttgaccgcattttttagataagaaagagggacaaggattaggaaaagagaaaagtttgtttagatgtttatctaataagagtacaaaaatgtctggctatatttagatcttgtggtgacacacaagaataacaaagttttccacaagttttatcaaagattttacaaaggaatcacctgtgttataccaaccaacagtttccccccactaacatgaaataaagtaacaaataaatgttaagaaagataggcaaaggaggcacacatttaattgatactcaaagaaagatgcaaagtgtctggatgagtgcagaagctaaaaaaaaaatgttgaatgcgtgaatgagttcaaagtatctcatttcattttattttacttccactgcagaaaattatcagagtaaattgagagagacacagatagattcttggtcattgaatcaattgatagaaaaaagctgctatgagttttcttatcatattatacacaaatatttctggcaagttcacaaaacagaactgtctctttttaataaatgtcatggttaaatagagtaagatatattagacatgacatcgatgaaaaaagtatcatttcattgctgaaaatttccagtaaacacttaaatatgtttgtgtctcaaacgtttccgactagattaatgcatgcaagttgagtaaaagatgtcacgaatctttttttatttagagtaaattgtaatctacactattttccaatatcttgaatttaacttatatatagcatagtatttgtagctgagatataattagactaagccccatgaaggtaagaaatgtttttcagtgctgtatctatagcatcaaacctagagcaacagtcactccatgaataattgttagatttaattgtgtatggaaaaaaagtaccatggaatttgcaatcaatatttataaggtaacttctattgtagttcctaattttaaattatattctgaccaaatcaaagtaagaatgaaagttatcgtttcccataaacactctacaggttatcttgactggtcctatgtttcataaagtatgaagctgttactgttttgttcaaaaccatatctccagtttcaatattatgcaaggctcaaggtgatacacaataaatatttgattaattgaaatatctatacagaatatcttgaatttaagaaaatatatatatataattctgtggttagagaaagccgaaaggaaaatagcatttattatataaaacgcatataactgataatatacaatattactgcagacaatacatttgatatttataaggcatttttactccctaacctattttgtacacaaaactcaattattagttaccaggtaaataatgacgatctttagctatcccatacagaccaaatttctctaagcctgtgcaaatcaccttgcatatgctacagagaagcctaaattttcttgtattgaactgtaagtctacctcacattgtccttacatttttcagaaaggtataaactgccaatatgacatttgaaaaaggacagaaagtatttgtatctttgtcattcactccacaaaggttaaccattggaccatgtctttccttgatttccattttcatgagtctaataaataaggaaatgtttgtgttatttaaataacttcttttgtattcttcatttcttgtcaaatgctagttactgcagtgaatttggggatgagtgcccattaacagaatcattgacattttgcaaatatattatctccaaaactatggtaaaatactgaataatagctttttttctctgccctgtatgaaatgacctaattgtgatgtaacatccctgctgaaaatacagattaatatgacccctttactaggtttaagaaatttacaaaattgcatggaccccatgcacaatttgtaaccattttgtgaataagattgaatatctttctctttttccaaaataaagattataattttaaatgcagttacactatatttcactttagtctatatgatcgatattatcagtgaacattttaattctactcaaaatctaccaaccatatgatataagaaggatctaataaacaggaatgaaatatttaacctctatccctgattgtatatctaagtattttgttttgcaggggtgcatctacaggtcaaccttagaattaaaatgataattaaaataataaagattagaaatattgcacttatctaatcacaataggcgcatttaaataatgcatatgtcagacttatactatctatctaagtcaaagggcagaatcaagaatcaaaatccaaggcagcaaaacccattttcaagatgaagccacagaaagcagttacaagactttctcggacataaagcaatgtatctttctcactgtcatcaccttaagccacacaagtctgttggcagataatgatacaaaagtaatatagctcacatcatccacctatgatacttaatacatgatctctggaatggacttggtccagagattcctgtatctttcccaaacccagacctttcagctgggagcacaatgaattgctgctaccccactgggtcagccctcaaggttcattattaataagctgagactcaaaaggctaatgagaaccgggtgcttgaggagacaatggctcattcatcatcaatcaagctttgaagtttttatacagatgatttaaggagagttgaagtgtgcaaaattgaaatgtcacgtttgtattgggagcgggtagagggtgataatgtaaatgagtgacgtaaccttctatatttcagctcgatgatcagagtcaaaagctcatggatgcagataccaaatgtttttccatcagagtatagcaatttcaagatgaaattattagatccactggctgaaaatcagcttaagatagaaaataatatcttgatttcaattgaatgaagctcagtaatgcttgttgcaatgttctaacttattaatacatacttcagtatccactacaattcttagctttcattatgtttcaggtttgagttctagctcctctgagaggtttgctatgaccacctagttcttagagttcccccttcctctaactcctgtaacactgattacccgagccacttatctgacatagagcaaatgctaccttaccttcttatatattcttttgtgtatttgccttgtctcccctatcttattggaggtccctcaaggattagaactatgatgtacacctctttgtgtccctagtgccaaagaaagtgtcaagcacatagtagaatttcaaatgtttttgatgattatgataatgataacatccatagaacatgaccaacttttgtaaaaaattacttgcttagtgatagcataatgttagtgatatgcactagatatttacattgtaaatcccataaaatattgaatacatttattttgatcttaatatattctttctgtcctaatattaagaaagtagtaatccacttaaactcattgatattccccggaaaaaattaaaactatattttatcttgtaacagtactcaaattatgaacataggatttccttctcaaattgtcttattatataatcccatacgtgtgtcaacgtctaacttttttctaataattttcccgagatttgtattctccctgtgttttcttatttctgttaaaatcaacataaatgctgtaaaagtcacatagactcaaagtttgaaatttattactatttcctttatttctatatttaaccatttatggtgctctacagaaaatttctcatagtgtctctttttatatccacaactgctacttaattcaggttctatcatctcataccagatttaacttcttgcctgtaatctattctccccacaaatccatcttgcatattaaagtcataatatatgctatattataaagagatagataatatactctaggtaggtggagagagacaggtggtaggggagagaaatcctgctctatcacggctttgaattgtaaaggcaataatactgaatctagttgactggataaaataaagctcataatctagttttgtttcaacaaagcaaaggtgggccttgtccacctttatgaagctgagtttgctcaattctgtgatgggtttattgtactcacggtatctgtcgcatagttgcttctattataattttaaattgctaattatttaaatagtggttacttcttggtatgagcaaggaatatgcttcttttgagtattcatactaacattgctttaatcagtattagattaggttgtagtttaaagagtatagacatttttttcttctatataaaaatctggctaggttatttaaggctattatataaaaatccacaatcatcagggagccccattctattttgttcttgtttctctaccatcttcaatacaagaggagtttccaactggcaaaaaccatgcaaaagacggagaaaatcatgaaggacaaaagaacagaggaagagtacatgtattttaatgaaaattcctgcaaattgccacagcacaattatacttgtatctcgttggtcagaatgaagtcaacgagccacagctaggtgcatggaaggaagggaattaaagtattcattctgggtgatcatatgagtagctaaactttatatactatttaaaatttagaaagtggtaatagatattggtgacaactagcagtctctgttatagtgactcaaaagaaacctcgcatcttctggatatttataaaacataaatcttgtgacttgaacaaatgtaaagctttttaagaaactttttaattgaattataatatacacacatagatgtgcattatcatattcaattaacttttacaaactgaacacacttatgtaaccagcactcagatcaagagcttgagccataccaacaccacagcagccttcctcatactttccacctcatgtcactctatcagaaccctgatcctgactttgagcaagataatgtgtgcttatttttgtattttacgtatatagaatcataccatacgtattctcttgtgtctggctccttttgctcgatattatgtttgtgaaattcatctatattgtttattttcattgttgtgtggtattccatggtttgtcaattctgcattgatgggcatttggatactttccacacttgggctattataaataactgctgctatgcacttcctagaaaatgcctttagatgattatatgtacacatttatgttgcgtgtatacctagaagtagtactgctgggtcatagtgataatcactttttatttaaccaatttaacttatttatatgcccattagtagtatatgagaaatctagttgcttcttgaccttgtcaagtcttgattattagttggttttgttgtatttcattgtagtcactcttattggtgtatagtggtattattttaatttgcacttccctagtgactactgaagttgaccttcttaaatactatctttaaagagtaatttttaaaggcaagagatttatttctgtttactccaagaaaggtcttactatgtgtaaaacatttacaaagcactgttaaaaacctgatctttaagttattggcaaacaatttagtaaaataatttatcaggtgtaaccctcataacttatttttgttgttattgttaagagatctggttcaatgttttgaaaatgacactttaaaatgtcttagaaaaaattaaaactacattaataattataaagagtaaaatacgatttctggaagacggatgggaaaattcacagtaggtgattatctctctgataacagacaaacacaaccaaaggtatataaaaaggatgagaaatttaatgtcttcttgctattaaaatagaacactcttttacataaagctcacatatttttattcctatatccaccagaaagccctcattacagacaacaatcctcttaaataactgttccaagtttccagaaaatgtaattgcttcagtagaacaaatcagtagagttcaatgttttcattaccaataaggggacggtcatattagtactcagaaatgatttgtcccttttatttacaggatttaatacaataagcctggggatatactgcaaggtcactttcaaatatctcacccactatattagtttgtatagttttaataactcttctcacaatgtgtgatttctacactatttcttttttagaatacttcaaaaaagtatgatttttcttgatgacagtaataataaataatattgctatgtatgtttgttgctggcatgttaagacttgcaaataaaagataaagcaagagaaagaataatgatttactcttgtaagatgattatatgattttcaaatatgtcaagatttttaaaaggctatatttgtgaatattaaaaatataaataagtgatttgggggctagaagtctcagctaaaatgcctagaatgttaattttaaaaataacacataaagacaacactttacaaaataagaaattaaagaaggagtcataaaataagattgcaagcaagccatactggaagattattttaaaagccacaacacgaaggtccaaattaattttcttttaaaatgaagtttaaatctggagaaaatcaggaaggaataattgaataacagtaatcatcattttataaagcactggttgtcaaaatacaaaatatcaggtactgtggcaaaatagaaagaaatggctttttagattgctttgtatacagtttcaaattagtatacattaactacagtaaaatggacaaattttaagctctatgttttacatatacatgtatacaatatttgtacatctgtatcaagcagccgccacccagataaagacacagcatatctctatcactccagaaaattttccctgcttcattccagtcaatactgcatagaagtcagcatagaaagtcagccactatgctgacttctaccacaacaaattagttttgcctctttattaaattcatagaaatagaatcacacaatatgtatcttattcctttttcttatcttctttccctgaaaataatgtttttgagatttatttatgctgttgctttaattcataggctgttcatttttattgttccgtattattccagtctgtgaatataccacaatttgtttatacattagttcactttttaaccatagatttggcacttttactaggtggttgcaggcaaattacttcacgtttcttttctaccatctacaaaattggaataataatctttactttgttgggttacaatgagaaatacagataatatatacaaaactccagttacatactaggtgttcaaaaggtactagctatttcaaaataagttaataatatagttcaggagctttgtctaaactattttaaaacctatgtacattggtcaaagtacaggttttgggggagaaatgatgaccaaatgaaaacctttgagagatacatgaaatccccattaagtttggtgcctagcataacaattttagagatagatatattgagctaaaatattattaaatgtcttactaaagttagttaattaaaaaattgggtttctctgtatttcataagttaaattcttcctaagaacaagatcataaattctataacttactatctttcccacactgaagtatcttagatatctggttgagttaaccctttagtaatttcctgtcatttctctaactatattctgtgacagcatttagagctgctagatttccctctgtttggatcaggttggtgcatagttcgtaggtcacaaaacctccctcacaatctccaggtggcctttacctctgctgtcactaccactgtgcttcaaataaattagcataaattccaaagtcttgtacaagagagctgagctcttttcttccaggccaagggtctggaatttttacagtagaataatgaattaattcaaaaacacaatattctatggtccttaccaccacccaatcattttctccactgtaaaaattattttcatattgtcacatctgaggtcataagagaatagcctccattatagctctgtaatgtgtattaccatgtcttctaaattacataaaggaacatcttttattttagaatgtttctgctttcatagggtaaataaatattttaaaatctttgcggatctttgtctgcttcttgaggctagacataaagaaaaattctaacatgtctaacaatgccagatggtttagtccactcaagatgccaacattcaagaagggaaaactattgagaaattgatatctgcaggggactgggtaaccatgactctgccatagagcaacagcctttcaggaagggaattatcaaaaagtatgagataatttttgtaggtatcctccccaaatctcagttctcttctctataaaatggtgataactcatagtgccacgttcatgaggcaactgaaaggagaaaatgagttatcatatgtatatgttgaccacagtgtctgccatgcaacacatgttcagttgatgtactattattattattgagggaaagataagaagagttctctgataagcagatttcttctatcctgcttgatgatttttctccatttcctgtcataaatacccttttcagagagagctaaaaccagggcaagactactaggccacgttaaaattcatgggtttgtgcatttgctcatttaaaaaaatatattttaacccacttttatgagtttcacatgccctttttggagcacattatgcttctggacacccataaaattattcacaatcactaaatatagaactttcctttttaagggtgggatttctgcaccccaaaggcatagtaagtgagacacacaatgatgaagcaagttgccaaatgcctcatgcatagttggggatcagactaggattccaaagtctgtctgcctggctccacagccccattgttagccacctcactgtacactcttcataaatgctgccattgtgtgaatacttataatgcagtatttctcttaatccttacagaaatcctatgaggtaattattactaatctcattttacagatgaaaaaactgaggtttagagagctaaataactggtaagagttcgaaagaaccatgattccaacttagtctgatggctgagttggcttttaaatttttagtctgtgctctccccattgtagaaaggaaagcgtgagtaatctaaatggaaaacaaaacaaaacaaaacagtttaagcagagatgaggcacaattttatcttatgtaatctacttctaagtataattaagaactcacagtaatttccctgaagtcctttttgaaaatattttatggagttgaaaggtaaaattatgcttttaagggatcttttctacatgaaaaactgtgcgttaaaaaaaaaaaaaaaaaaaaacctcttggctctggtagatgtctggaccatatcccaacctcgtctcttgaggtgcgtttcttttgcctctgtcaaaagtagatgcagaggaaaaggcagcacaataaaaaacttcaagaattcagcccacttaaggaaaagcacttcaatttggtaaaaaaatagaaaataaaaaagtgaattaaaagaaagccaattttattattgtcaagtactgtgggaactctatgcttagtgtttgaaagctctgctttaatgaatagggtaaaatgattttaattaccatatccaaactcataaacttataaagaatttatctctatgtgctttatagctgtatttctaaaaatataaaattgatattcaaatgtgtagggcattcagttcttctaaccgaattccattccccttataatttatttcctattatttgttgagtaattcacataaagaaagcaaaagtgcaaaatatttacattattaattcaaataaatgaaaatgtatttaaacattaagcttaatattctaatcactgtaaaggtaaattggattcatatgatggggaaaaaaagggaatccaaaattaaaacaggtggttaaatgtagccttatcacagtatcttttgttaggtgaacttactggattaaataccgctcaatatcatacgagaactgaaatatcttcttgaaatatatattttttaaatcatcttttttctttgcttgatatagttaaaaatattcatctttagacatgcctattagctaacttttatttaaaatagtgaaaaaaggaagctgattttatttgtgagtttgggatattttctttattttatgtacattaatttcataaatgtgctgagttaaaaggtaatataatatattgtacacagaagagtttttattctagcacaaacaaaaggatatgttcacttctaaagatataattatctttaaaagtagaaagttcttaactaaaactttctcagatataaagtaaaataagagaaaatatttttagaagtttcatgaaactaaacatttatttgtgaatttaaaaagatttaaactggactttacagaagagaataatacaaagagtatcttgtatacattcatgttctacgcctaatttatttttgtagggcatgtgtttatatagttatatcatatttgaaagaatcttacatagaaaattaagctctggtgataatctctagttcatgctacctagctgagatgcaagggagacaaaaaggaacactaatcagattagcataaaactggaatacaggccgggcacggtggctcacgcctgtaatccctgcactttgggaggccgaggcgggcggatcacgaggtcaggagatcgagaccatcctggctaacacggtgaaaacccgtctctactaaaaatacaaaaaattagccgggtgcggtggcgggcacctgtagtcgcagctactcgggaggctgaggcaggagaatggcagaaactcgggaggcggagcttgcagtgagccgagatagcgccgctgcagtacggcctgggcgaaagagcgagactcagtctccaacaaaaaaaaaaaaacacaaaaaactgaaatacaggtagtgggaatgctaataagagtaccaatagtgtcctcagttctaatttcaccattgtcacatacatatctttccttacaattaatgacatcacaagaacattatttactaaaaagctataatattttgagaacttaactattaggttctctattctcattttactttgaagttcagaacaattagctggcaacaaacatcttgaagaattgttgcaaaccagatgctaaacctaagccttctaaaagtatctgtgtgctgacatgtggaaaagagaatgatgatttattaataaataccggaaatacatttttgaaataaaaatatgtttaaaatgttgtttcacttgtaattgtttaatattttattttctccagagcttcaagagttataatctaaattgcaactgaaggaagcttaagctagctgatatgcacctagctatttccccgcttcaaagcctacagaaccatctgcttgttggcaggtgtaattaattagctaagtggagaagacgctcccttttagagtgaataggaggagaggagggagaactctgtgaaagcctaatcctaggcagacccatcagctgggtgcctctgggcaaatttccgatgctgaaaactcattgaatttaatggttcttaatttcacaagatttctaattacagctaggataataagatgcgatccaaaagttgaaaaaaagttggcacattttcaaggaaaatcctttcacacaatgtagacatcctaaagtgtagaagttcatttatttacacattttccacttattccctcaactttgctaataagcaattttgaatctatttggctgacaggtggcaaatgcctattaataatagtaaaatgtgtcatgctaaattttgtatctaatccaacattgcttttcagaatagtcaaagaaaagtccatccaagcaacattattattcattttcaatagattttaaaaggactacattctaagaatagaaatggggggaaatataacactaagaccataaaacttcctataattttatcagtatagattatattagattatcaccgaagagtccagaagataataaactctacaacacttccttcttttaaacactctgtcagaaacaaaattccctcttaaacatctcctggtatttggttttaatgggtaaggtgagacaggtataaggaatagagtgagtagaactatggcaaactggaaagcacccatcacaactaaaagagcactgactgctcagccccagaagatgttactaagagacaatgtgaactcagggttgccagaggttggttttattcagaggggccagaaatgcagaatttatcggtaaattccctcaaattttaaacactcttctatgcaaagcacgtctgtagattacagtctttgagacagcagtttaccacatctggtttattgaataattgtatctgtgaactcctcaatgatgagcaagctcttactacatcaataaccagactgagatatgctctcatggaactagtcttcacagctcctctacctattgataaagaatggaaagggaaagggaggcagttatacagttcatgagagagtaaagaaaagtgcagaagcccctactgttacatgaacagtagagaccagaaggcactgaattccataagacttcttcatacttcttgtcatcatttgttgcaatggagtagaataagcgtctggctatctaatgattcttgaaatgtgtgctgcagacatgtcaccccagaatatcacacttccactgctgaatatttacttccacgtgtaaattttgaataggaaaggcttacatgtcatctggaagataaaatcaaataactggctgtcatgttagtatggacctgtttataggattaacataataacataaaaaatctaaagattagagggactggaaggttaaattataatttagaaaaaggaagcaaatgtacaaaaaggttgcagtcagggatatgttcccaagttttgttagtcctgcattaatcactcaggtgagactatatacttgatccttgggagtagacgtggcataggagaaaggaaattttcaacctgcttatttcataatgctgaatggtcttctacttgttctttggaaacaaatgaattgagtgactttcagctcccctaccactgaatccaataggccaatacaattccaaaaaagtctttccaatagtcagaatttcaaaagacaaattatctcaggaattgacatcagtcaactagtatgctctcagccagaagttgggtgcagggaaaattatagctgcccattgtggggttttttaatgctctataaacacgccaggtaataccaaaagacttatgggaatcaaattggagtccaaggttgatttcttttctgtattcagtacacaggaatttaaagagacctgggctctttcccttagctccatctcttaggatttctggcattgtagccttccttctttaactgtccattttagaggaacatggttagagtgaatccttctaaatgagctcttcatccctaacagtgagtgttctttctacttctgagcagaggttacagctctttcaaaatattctttttttttttttttgagatggtgtgttgctctgtcacccaggctggagtgcaacggcatgatcttggctcactgcaacctccgcctcaaaggttcaagtgattcttctgccttagcttatccagtaactaggattataggcacctgccaccacactcagctaaatttgtatttttagtagagacagggtttcaccatgttggccaggcttgtctcaaactcctgacttcaagtgacccatccgcctgtgcctcccaaagtgctaaagtgctgggattacaggtgtgagccactgtgcctggccctttttaaaagattctattcaactcctccatgccataggctggaagttggtctgtgatcctcaaatccttttttgttttctttgagtatggagaagagttgagtgagaacaagaatctgtctgatcaaatatccgagggtaatgatagtttctggaaaggaaatcagtggagaaaaataatataaaagggtgttaaaagtcaaagaaagaaaacacaagagtatgagcatagaaaaatctaaatagaacaaggagagacgtatttatttaaaatattttacctatgtattacttccattgatttgttctaagtctttcaagagatgggtggcctcttcgccaaaccatgtcatctcttgccagaaaacagcactgtgtctctttgcttattctcttgcctttaaacaattaatttgtcacagtcagtcaatgtggtcttttcaaaaccaaaattaaattgttataagatgaacaacaagggtggaaccaataccaaaaatagataattcagaagctagtatctatgtcaagatatatctagttcatattcacagataatttgagaaaaaaatacaaaaaaaattctattctataggaaagaataatcaatgaagaaacaagtattcttgaaaattgcaaatgtcatatctgataaaatatttaataaatataatatttaacaaaattgaagaagtctcctagaaagtagagaaaaaagagaaatataaagaagagaaaaaaataaaagaaataaaggatacatccaggaagtcaagcattacaagttatagagagaagaaagaacatatagaagaatacattatcaataaattgaggcaaataatttcccttaagtttaatcgagccaaataatttcccataattatgcagaaaaagattttaaaacaaaataaatgcctagatgtgtatatttaaaatttcagaatcttaaaaaaaatgtaaaatcctacaaaagaataggacagggatataagaaaggcagagacagctagaatgagaatgagagactaaggagagagagacagcagggatcaaaatcacatcagacttctcaacagggacaccgtgtgaaaagtagtaacttcaaatactaagtgaaattctttttaacttagaattctaaacccagtcgccattaatcaaaccatcactaaattatgagtatagaaggagacattttgatattcaagaacccagtaaatttacccttcaccatttttttaaggaatattttaaagatacccttcaagaaaataagggagcacagcaagatagtgaaaaataggtgatgcaggatccagcccaggaagtaactaaagagaagtatcacaatgcaacagaaatgtacagaaaataatacggattggtgacataaaactgagaggccaaagaaggtagtctccagggaaaagggggactgatataatgcatcataggaaatctgacaataattggactataacaaaaacatgtagtgtaagaaaatgaaagccaagtggaaacatcaagaaaaaacaagcaaactgcacaaggaaataaatataatcatagtacattcttccctctgctatgattttttaaaagttgcatgaatgtaaaaatcacaataatgtaagtataatgcatattgattttcaacttttagacaaagatagtatcttttaacaatatcttttaaagatacttttaaagatagtatctttaaacaatattgtttaaaagacagtatcttttacacaacaaaaacgtcaagattgataatatattctgttcaatagatgccttaaatgataaatcaagaaataattaattatattttaaatatattcagagatatgttaataatcatcagaaacagcttaatgagctagagagtagacaaaacaggagactgttgattttttttttaattatactttaagttctagggtacatgtgcacaacgtgcaggtttgttacataggtatacatgtaccatgttggtttgctgcacccattaactcgtcatttacattaggtatttctcctaatgctatcccttcccctggcccccaccccaagacaggcccctgggtgtgacgtttcctgcgctgtgcccaagtgttctcattgttcagttcccacctatgattgagaacacgcgatgtttggttttctgtccttgtgatagtttgctcaggatgatggtttctagcttcatccatgtccctacaaaggacgtgaactcatccccttttatggctgcacagtattccatggtgtatatgtgccacattttcttaatccaatctatcattgatggatatttgggttggttccaattctttgctattgtgaatagtgccacaataaacatatatgtgcatgtgtctttacagtagcacgatgtataatcctttgggtatatatctaataatgggattgttgggtcaaatggtatttctatttctagatccttgaggaacaatggttgaactagtttacactcccaccaatggtgtgaaagagttcctatttcttcacatactctccagcatctgttgtttcctgactttttaatgatctccattgtaactggtgtgagatggtatctcattgtggttttgatttgcatttctctgatggccagtgatgatgagcattttttcacgtgtctgttggctgcataaatgtcttcttctgagaagtttctgttcatatcctttgcccactttttgatggggttgtttgctttttcttgtaaatttgtttaagttctttgtagattctggatattagccctttgtcagatggatagattgtaaacatttttttcccattctgtaggttgcctgttcactctgatggtagtttctcttgctgtgcagaagctctttagtttaattagatcccatttgtcaattttggcctttattgccattgtttttggtgttttagacatgaagtccttgcccatgcctatgtcctgaatggtattgcctaggttttctcctagggttttcatggttttaggtctaacatttaattctttaatccatcttgaattaatttttgaataaagtgtaaggaagggatccagtttcagctttctacatatggctagccagttttcccagcaccatttattaaatagggaatcctttccccattgctttttttttgtcaggtttgtcaaggatcatatggttgtagatgtgtgatgttatttctgaggcctctgttctgttccattggtctatatctctgttttggtaccagtacaatgctgttttggttactatagccttgcagtatagtttgaagtcaggtagcgtgatgctttcagctttgttctttttgcttaggattgtcttggcaatgcaggctcttttttggttccttatgaactttaaagtagttttttccagttctgtgaagaaagtcattggtagcttcatggggatggcattgaatctataaatcacttcgggcagtatggccattttaacaatattgattcttcctatccatgagcattgattgttcttccatttgtttgtatcctcttttatttcattgagcagtggtttgtagttctccttgaagagtctttcacatcccttgtaagttggattcctaggtactttattctctttgtagcaattgtgaatggcagttcactcatgatttggctctctgtttgtctgttattggtgtacaggaatgcttgtgatatttgcacattgattttgtatcctgagactttgctgaagttgcctaacagcttaaggagattttgggcttagatgacagggttttctaaatgtacagtcatgtcatctgcaaacagggacaatttgacttcctcttttcctaattgaatacccttcatttctttctcttgcctgattgccctggccagaacttccaacactatgttgaataggagtggtgagagagggcatccctctcttcataaaatgaattagggaggattccctctttttctattgattggaatagtttcagaaggaatggaaccagctcctctttgtacctctggtagaatttgtctgtgaatccatctggtcctggagtttttttggttggtaggctattaattattgccttaatttcagagcctgttattggtctattcagagattcaacttcttcctagtttagttttgggagggtgtatgtgtccaggaatttatccatttcttctagattgtccagtttatttgcatagaggtgtttatagtattctctgatggtagtttgtatttctgtgggattggtggtgatatcccctttatcgttttttattgcatctatttgattctcctctcttttcttctttattagtcttgctagcagtctatcaattttgttgatcttttccaaaaaccaggtcctggattcactgatttttttgaaggggttttgggtctctatctccttcagttctgctctgatcttagttatttcttgccttctgctagcttttgaatttctttgctcttgcttcactagttcttttaattatgatgttagggtgttgattttagatctttcctgctgtctcttgtgggcatttagtgctataaattttcctctacacactgctttaaaagtgtcccagagattctggtacattttgtctttgttctgattgatttcaaaggaaatttttatttctgccttcatttcgttatttacccagtagtcattcaggagcaggttgttcagtttccatgtagttgtgctgttttgagtgagtttcttaatcctgagtactaatatgattgcactgtggtctgagagatagtttgttgtgatttctgttcttttacatttgctgaagagtgctttacttccaactatgtggtcaattttggaataagtgtgatgtggtgctgagaagaatgtatattctgttgatttggggaagcgagttctgtagatgtctattagatctgctcagtgcagagctgagttcatgtcctggatatcgttgttaaccttctgtcttgttgatctgtctcatattgacagtggggtgttaaagtctcccattattattgtgtgggagtctaagtctctttgtaggcctctaaggacttgctttatgaatctgggtaatcctgtattgggtgcatatatatttaggatagttagctcttcttgttgaattgatccctttaccattatgtaatggccttttttgtctcttttgatctttgtttgtttaaagtctgttttgtcagagactaggattgcaaccccggccgtttttttgctttccatttgcttggtagatcttcctccgtccctttattttgagcctatgtgtgtctctgcatgtgagatgggtctcccgaatacaacacactgatgggtcttgactctttatccaatttgccagtctctgtctttttttttttttttttttttgagacggagtctcgctctgtcgcccaggtgggactgcggactgcagtggcgcaatctcggctcactgcaagctccgcttcccgggttcacgccattctcctgcctcagtctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgcctggcccagtctctgtcttttaattggggtgttcagcccatttacatttaaggttaatattgttacctgtgaatttgattctgttattatgatgttagctggttattttgcccgttagttgatgcagtttcttcctagcatcgatggtctttacaatttggcatgtttttgcagtggctcgtactggttgttcctttccatgtttagggcttccttcaggagctcttgtaagacaggcctggtggtgacaaaatctctcagcatttgcttgtgtttaaaggattttttctctccttcacttatgaagcttagtttgactggatatgaaattctgtgttgaaatttcttttctttaagaatgttaaatatcggcccccactctcttctggcttgtagagtttctcccgagagatccgctgctaggctgatgggcttccctttgtgggtaacctgacctttctctctggctgcccttaacattttttgtttcatttcaaccttggtgaatctgacaattatgtgtctcggggttgctcttctcgaggagtatctttgtgaggttctctgtatttcctgaatttgaatgttggcctgccttgctaggttggggaagttcccctggataacatcctgaagagtgttttccaacttggttccattctccccatcactttcaagtacaccaatcaaatgtagatttggtcctttcacatagtcccatatttctcagaggctttgttcgtttctttttactctttttttttctaaacttctcttctcactttatttcattaatttgatcttcaaacactgatacccattcttccatttgatcgaatcagctattgaagcttgtgcatgcgtcatgtagttctcgtgccatggttttcagctccatcaggtcatttagggtcttctctacactgtttattctagttagccattcatctaatcttctttcaaggttttcaaggttgttagcttccttgtgatgggttcaaacatcctcctttagcatggagaagtttgttattaccgaccttctgaagcctccttctgtcagctcgtcaaagttattctctgtccagctttgttctgttgctggtgaggagctgtgatcctttggaggagaagacgcgctctgctttttagaattttcagcttttctgctctggtttctccccatctttgtggttttatctacctttggtctttgatgatggtgacttacagatggggttttggtgtgggtgtcctttttgttgatgttgatgctattcctttctgtttattagttttccaacaggtccctcagctgcaggtctgctggagtttgctggaggtccactccagactctgtttggctgggtatcaccagcggaggctgcggaacagcaaatattgcagaacagcaaatattgctgcctgattcttcctctggaagcttcatcccagaggggcacctgcctgtatgaggtgttagtcggcccctactgggaggtgtctcccagttaggctacacaggggtcagggacccacttgaggaggcagtctgtccattctccaagctcaaacactttgctggaagaaccactgctctcctcagagctgtcagacagggacgtttaagtctgcagaagtttctgctgccttttgtccagctatgccctgcccccagaggtggagtcatacaggcagcaggccttgctgagctgccgtgggctccatccaatttgagcttccccagttgctttgttgacctacacaagcctcagcaatggcagatgcctctccccctacaggctgctgcagtctcacaggtcaatctgagactgctgtgctagcagtgagcatggctctgtgggcatgggacccactgatccagacatgggatattatctcctggtgtgccatttgctaagacctttggaaaaatgcagtatttgggcgggagtgtcccgtttttccaggtactgtctgtcatggcttcccttgactaagaaaggaaaatcccctgaccctttgcacttcccgggtgaggtgatgtcccgccctgttccagctcgccctctgtgggctacatctactgtccaaatagtcccaatgagatgaaccaggtacctcagttggaaaggcagaaatcacctgtcttctgcgtcaatcacgctgggagctgcagaccggagctgttgctatttggccatcttggaatggaaatcaagattgttgattttaactatgtgaatgtaatatatgttttaaaatacaaggagaaaaaaagaagctgaaataattcagcaatggtcgtgtataatggaattctctgagattagggtaacatgctgccaagtgttataatagcaggtaaatccagttgcaacgctgtgtggttttgagacctctacaataatgaatcttgaaacattaaaataatataaagaaatgaattcagcagggacacattttattccatggcacattctacacttaccttcagtttgctacatgaagaatccaatttccttctatttcatatattgacttttttcaaagaaattccaggtgcttccctacattttctatcccgtttatctttgcatgcagtgaatgtttttaatcatgtcattattttaaataacactttttttctgggagtttttttcccctttgactctgtattactattcctatcctacaagtgtgaaatccaagacatgtagaaattaactgacttacttcaagaaagacaggacagtaaactagttctcattgcctttcagaaaccttgctacttgagtacttaattttttaaatctgatatacttgaaaatcctaatgttaaaaatacctttaaacgactctcaaaattaattcatcaaaaaaatcaagaaccttaaattagtaattctcttttaattagagcattggacaaaaaataatataaatcatataaatgaatatttgtgggagtattaaatataaaatgccaaatattgaaaattgcaaaatatctagcaaaagtacatcaattaattacacattatgtatacatattctaaaaactatacagccattataaacatgttactaagttttaaaatatgggaataatttcatgaatacgtgagtaaaaaattgagactacagaagtctaaatacaaatataaatgcaatttgtctaaaatacaccttaggcatatatattcataacgcatagatgtcatactgggacaaaataccatccttaacacctgtataatcttagtaaaattctaaacttcactttcttcatcagaaaaatgtgtaactttacttcatagtaggataaaatgagatgatgcatacaaaaactaatcacatttttggccaaacagtgagaagtgtctgtgtatttactataaacataaggcatgtaatatatgacttagaattatatgataatgtattcagaataattaacttaagacattaaattaaaactctaatattgtagcaaattgcacagaaaataattagaatagtatagaggtactaagatgaaaaactgaaatcaacaatatttaaattacaaatacaaccagggcccaaattacagtcttattaaggaacctatttaaaccaatagaaagcaaagcaggcattttagcgagacagataaaaagtcactaccaaaaaaaaaagtaaatttacaaagaaaagggtcctttggtccttcttgaagaagtctcaaaacaggtagaaactcacttatctggtaaatcataggctttgagtcagaaatttatattatctaatttaacaaataataaaatcaatctgaaagtttctcgataatgtttcccagcattattgtgagtgtcatagtacaatgataggaagtaggttccagagcctgtgcttacagttgctatggcacaggaccttaattacatatgccacatttatacacatgaatacaccattacaaactgatggaaacaccacaggtgctgtgcctacacctctgatttccagggacaggctcagttgataggtgtttttccagagtaattataaataatacctctttttcctctcaaaaggcttctcgcatggggaccctattcattaaaaaagtgtaaggacttataaaatttctataagaacagtcttcacaaaggaaaaaatcaaggttgaagcttaaatgcttgctacatttcaacgcaaagcaattatatgataaagaaagtaactcatagggttattatgacaatctactagaataatagcaactatggatttgattagacatatagtaaattataaaaacataaagtgttatagttattcaaaacaatattttaaaaataattccaaatacgcatttcataggaataactttataatagaaagaaaagtgtttgactctcctcaggtgttatgttttcttgttttgtcaaaaaattcagcagttcaccttttcccaaaagagtaaggtaaaaagcaatctatcaaatttttagagattgtcaaaaaagttaagaaatgataacaaaataaaaaggagattttttttccccataggaatttcaacccctcaaatattccacttttaagtctaccaaaaatatttaattcattgtaaacagcactcaactaaatttttgtttatggtgtatgtgatagttaatattagatgtcaactagaccagattgagggatgcctagatggccaatgaagcattgttcttgggtatgtctgtgaggatgttgccagaggagattggcagttgagtcagtggactgagagaggcagacccaccctcagtgtggtggcaacatataatcatctgccagcgcagctagaacaaagtaagcagaagaagggggataagcagctttcagaatcctctcactctccctttgctggatgcttccttcctctccggcccttggacgtcagactccaggttctttgaacttgcaccagctgcctccctgggagtgttgggggtgagggattctcggtcctttagcctcaggctaagggtctcactgtcagcttccctggttttgaggctttctgactcggactgagccaccctaccagcttctctctttccccagcttgcagatggcctgttgtgagacttgccttgtaattgtgagccaattctccctaataaactcccttttttatatcctgttggttctgtccctttggagaaccttaatacagtgtacaatgctgattaaatgtaaaagtatatttagctgttaataaaatatcagttttcatataaagataacttggccaggcacggtggctcatgcctgtaatcccagggctttgggaggctgaggtgggcagatcacttgaggtcaggagtttgagaccagcctgggcaacatgatgaaaccccgtctctactaaaattacaaaaattagctggatgtggtgtcacacgcctgtagtcccagtgacttgggaggctgaggcacgagaattacttgaatccaggaggtggaggctgaagtgacccaagatcataccactgcactccagcctgggtgacagagcgagagcccgtctcaaaaaaaaaaaaaaaaaaaaaaagatatcttaatgtgtattattcatgaataagcattgataaacatttctaaaaataaaaacaatattttgaaaaacttattgaccatgttggtgatacagaaacacatatctcaactaattttaaataaaatagttatatcacataaacggaccaccaccactaccagtcaccactactaccaccaacaaaacacagaactctcctgaacaaataatcaaaaagtgaatcaataagaaaaatctttgtgattcagtacttagcattcacttccctgtttgtagaaatgtcagtagttagcaagcaatggagctggaagcactgtgttcccataggtactgttttctagatgacatgtaaaactctatgcttgaccataaacagcctttaaaaaaatcccagggcacctttcagggaaatagcagtgtttgcctcaacatcttggcttagttccaactcactaattacattcagcctgcctggataattttagatagttttaatgtgaaagtgcattgcctttgtttgattatagtccctggctcttcctttgaaaagtccatcctcaaacagtcacggggggatttttaaggctgattatttctcttaaacaaaaatgaagacctgggctggcctagcatcttcctcaaagataaataattagtgtccccacattgaattaatactgaaattttggatacacttatagatttaggcaagtcctcagagaagggaaaggaaacctttacatttggagcctcaatagagcggagtaccttcttgttaaaggggttgtcgtagacagagctaggcaattctaattactttattgaacttctctttggtatagttgcaaaaatctggttattactctactcaatatcaaataacaaacatatacatgtatatcaaccctgtaaaaatagatggttttattttccaggacaaaactttgaaaaggtatcataaatttacttttcccctttgatgctgtggcagggattgctatcagtccccctaaatcttgtccctccctgtcttctacagtaatggaattttcactgggcatatgttcaccaaaccaaggcagtattccctccttgcagctaaatatggacacatgactaagtcctgatcattgtgaagtgagcagaagtgagatgtgccacttctggattttgcctttaaaggtaagagatgagcccttatctttcccatttcctgttcctcaaggccacatgattgaaaaccatcttcaattgtacacatgacagcaacattcaaggggatggaaagaatttccacaagatggaaagaatttgggaccccaacattgcagaactatcgaatcctctatatacgttcttgcaggctggatgtctttaagctgctatagaagacagataagaactcatatcttgttaaagttactctaaagtagttcattgttcattgactctgtatcttaatacagatgatattacacattgtttttctcttcccatctcttccattaaaattgacaaattgaagatcacattcctcatctgaaactagaagttgcttcacatgtccagccacctttgcaggaatataaacatagggttgaataatcctcaggatttttatttcaagagatactgaaaatccctatgtttaagtattaggaaaaaaatatctaaatatttaggggacaccatgctggacaaaacacttctagagcctgttggtgcagaagttgtggtgcattgctgatataacaaacacagtttccaccatctgtctaatgagagatcagatacaatatggcaaggagtaaattctttctcagggtactctgagaacatacaggagggcgaattttaaggagatacgttagctgggtttcgaattaccagtatgtgctagttagataaatgtgggtgggggttggggcagaagggtattccaataaaagaaactatcaattaacaatggtctccaaataacagaaatcctatctacttatgtttaagtacttaaagggagcacaaaataaggcagtttttcacttaataaaggataatatctctgacttttgaaaagatgataattcaggcattagctcttggaataaatacactaaaactcaactacatatttccattaacttgaaactattttttcaacaaaaacattgaatatgtttttaaaaatacattccacaggtccacaatgaagacagattctgtgaggaatgatatagtcagttctcttataggtggatggggatgtatgatcactaagaagagaacaaagaagtaaggaaggtagttcttgtctccaattgaaacatttttcaaatgtatttataaaatgtctgctctaaaataaacaagtgacacagttttaaatttctaaaagcaatattttaaattattttttcttgattgtctatcaaatttgaaaatgaagcataatattggcttatggtagcctaattttcagtagatgccacaagataaaacccaaataatctgatttgaaccttgcctaaaatcttctctcaccattgttttcctgtggcagagaatatatccatgattatttagataaaatcattttttgcattcatgtattcaattttcattcatttatttgctaattcagaaaacattttgtgattgcacattctgagacagacatggtgctaagatctagagatataaaaaaatgaaatgacatggtctctgatcacatagaaaacactaactaaattaacaggaagatataaaaataaattatcacaagaaaagacacatgttataatggagatacatacaaagtacaaagggagaactaacagtactggaatctgccaaggggaaatagtaaaagctttagtctgaaacttgtctcgaggactagaaagagcattctaggaagatccccagaatttgcagaaaatagaaatgttagaaaatgcttatagacagtaactattaggagtatttctgcatctttagagtacacatagcataaattaagcaagggaggatggacttaagaacagagcagagaggcaggggcactttcacaaaggtctcaaaattttttaggtgtaatgggaaattatcaagtaattctgagatggtaagtggtatgttttaattgttaggatagtgaaagatttttggaagcaatgctaagaaagggtagaacaaactagaggtgaaaaaaacagtaaggagggtattgcaatagcctgaggagagtgttgacctggattagtggcaacagggataaagagagtaggaaatagattttgtttaagttgtgatagtttttagatgtgggtgataaaggacattgtataataagttccatgcatcacacttaaataaatgaataaatagcaaattttagaacagatgagacccaccagattgggaaaagcaaaatgacacattgactattagatggagttcagtttaaggtgcttgtgggaaatgtttcacattcaaatcattaaccattattctaatggttaattgagtaaggtacataaacagataattcaaaagcagatatcaacaactcacaaatacatataaaaagtatataacttttaaataaccaatggaatatctaatgaaaaagaagtactaatttatgcttgcttaacagcagcaacaactgagaattagggactgttcatgctggtgcaagttgaatgaaatagtgtctcttctactgtgaacaactatatgccaataaatttgaaaacctagaggaaaagaataaatttctggatacatacaacctaccaagattgagccaagaagaaacaaaaatcctgaacacaccaatgacaagtaacaggtttgaatcagttaataaaatatctcccaacaaagaaaagtctaagaccaatggcctcatcactaaattctaccagatctttatttaaagaagatttaataccaattcttttctaactattcaaaaaattgaaaaggaggaaatttcttcctcatttaactaggccagtataaccctgatactaaaactaggcaaagacacagtaaaacaagaaaacttcaggccaatatctctgatgacatagacacacacacacaaaatcacaccaaaatatgaggaaaccaaatctaacaacacactaaaaagataatacataatgatcaagtgcggtttattccagaagtgcaaggataggtcaacacacaaaaatgaataaacatgacacgtcacctcaacaaaatgaaagacaaaaactatgtgatcatcttaatggatgcagaaaatcaggataagaactctcaataaataaggtatagaaggaaagtacctcaacacactaaaaacaattatgccaaactcatacgtaacatcaaaagtttccagcttttcccctaagaactcaaataaaacaaggatgcccaatatcaccactcatattcaacacagtaatagaagtcttagccagagtaatttagcaagagacataaataaaggacatccaaactggaaaagaggaaatcaaattgtccctgtttgtagatgacacaatcttatatatagacagatctgaagactaccaaaaaacttaggactgacaaactcaataaagttgcagattgcaaaatcaacatacaaataacaaaccagctaaaaaagaaagctagaagacaatctcatttacaatagctactagaaaaataaaataaaatacctagaaataaatttaaccaagtaggtaaaataattggacaaggaaaactacaaaacactgatgaaataaattgaagaggatacaaacaaaagaaaaagtatcccatactcatgaatcagaataattaatattgttaaaatgaccatactatctaaagcaatctacagattcaatgcactccctatcaaaatatcaatgatgtttttcacagaaatacaaaatatcctaaaatttgtatgaaaccacaaatgacgctaaacagacaaaacaatcctgatcaaaaggaagcatcacataaccagacttcaaaatatactacaaagctctagtaaccaaaacagcatggtactgacataaaagcagacatgcagatcaatgcaagagaatagagaacccagaaattaattcatgtatctacagctatctgacttttgacaaagctgctaaaaatacacattgcagaaagaacagtttgtttaacaaatggcgctaggaaaactggaaatctaaatgcagaaaattaaactagatccctaactctcatgctagatatagttaattcaaaatggatcaaagacctaaatgtaagaccagaaagtatacaactactagaagaaaacataggaaaaatgcttcaagacattgttttgggaaaagattttatgaataagaccctaataacacaggcaacaacataaaaataaacaaatgggatgaaattggagaacatcaggttaaatgaaataagccagaaacagaaagttaaactctgcatgatctcactagtggaagctaaaaaaatttgatctcttagaagtaaaaagtagaaaagaagatattagaggttgggaagggtaggggaaagagagggatgaggagagatttgttaaagaatacacaattacagctagatagcagggataaattctactgttctacagcactgtaggataactatggttaataataatatatagtttaaaatagctagaaggagaatattgaatgctccctacacaaagaaatgtttgagataatggatatgctaattagtctgatctgatcactatatattatgtgtatcacaacatcactatgtaccccataaaaatgtatagatataacgtgtcaatttaacttttttaactgaaaaataaatttaaaaagaactaatgtatcacttgtagctgatggagttgcaataacttttaaaagtcagacatctatctgtacactttggccaaataatccatcttcagggaagctatcctgatgaaagaatattccatagaaagaaaattacatgcacaaggatgtacactgctgtattacataagtaatgcaacaaaccaaaatccacataaatgtttcagaagttggggagatttatataaaatatggcataattatttgatagaatattgtataactatttattatataatgatgcatcaatataactgtggtaaatcgaatcattagccacaacattcctttgtctctgacaaccacatgcttgtcatggcttctctgtagcaaaagcacactttcctatcacttggttttaggctgggccctatgattttctttggccaggggagtggcagaaatgagaatgtgccatttctatatctagagcttaataggcatcgtggatttctgctcccttttatggactgtaccatcatcatgggaagaacttccaatgctgttacaactgttagcccttcccctgggccacagaataaatcactatggaacaaaactgccccaatccaacctagatgaacttgtgcttggagcagagcttttccagtcaagccctgtataaatcaccagaccagaacttagccaacaacagattcataagaatacataattgttgttccaagtcattgagttttattaggatgtttttggatgaatcatcttggggcaataggtaagtgaaacaatagctatgtgaggacattcatatggaaaatgacaaaagaaaatattcaaaattacaattgctagtgtatgtgggttttgcgattgtgagatgccagacccaagcttaatctagtattttcatgtatttgaactgaaaccaacataaggggtaagcatctcttagagacagaattttttaatgaaaaatataaaatattcattttatatgtatcttcattttaaaataaaaatatatattattttgctttaggttatttttgtttctttaaaaaatcccactaaaactcattcctagcagaattcactttattactctcagctgcaaatggagaatctatagaaccttatgtaatcttatctaacttaaaatatcttccttatgctattgtggtaaattcaatgttaatacaaattcatatttctactgcattatcaaagtatattaactcaaatagtttcacagcttgaaaatgtcattaatcaatgatggggcttctataatctgtgtaatttttgtcctctgataaggtcaggttttctaaatgactggcacgtgctaagcatttcactatttctgtcatttaatttttgagggcccaattggccaattcatagttaattactcaatgtttacattcaaagagaagtagaaatgggagatataatacacaatatgtaaaattgtgtatgaaagaaaatgttttcaatagcatggacaacatgaataaaaattattacgaccaagaccagctttgtgcagaatggtgatttaggctccccgactctgtccaggcttgggcatggagtgttctcacacaatctgtatacttttccttatggcaagtgctttcccattgccctctagctgccagtaactctccactgaagcattttacgagtactgcttaaaaatatttcctacttcctttcatccttccccttaaggtttaagctgcctagattctcattccttctcagctaattgctttcgaaaaacagtatcttgtaaattaagtccccttaaaggactgcttaatgtgatacctggtttaggaatagttactatttagcaaatggtacctgtgtatgcctcatcgctaacgtatgcagttctgttgtatggtatctctggcattatggaaggcaaggataggaaataattcaggcaagcaaagttccagagcacgcttcaaatcataccatttagacaactgtctattttatttataatgtgatctgtcctgcaaccaaattacttctttttaagttaaattcaacccataaaactaatttatattcctgagaaaaacgaaatgctacttcaaaagttttatgaaagttcatatttttacaagttttacctaagtagaatagattatttacatgtattataatagaaggaatatatatttacaatagaaaagaaatgaacttgacaatgatgatttgattgtcaaaattagataagacttaataattaaaaagaccgaaaataattaaaaagaaaactcacttcaaactataattttacgttatttttcctactttcaatgttctctgaaaaaaatatgtttgtttttacacaaaatttgcagtggcaccaacttatttaaaatgttaattaccggactgtaatgaagaatttttagcaagacacatatttgacttcatctttgttaatatctctacattctacactagggtacagtaaaacttctgtatcttacctgccatctagtaatactgttggaaagattattatgattgcattatgaatgactgatttaaataaagttaataaatcaaaagagaggaacaaagcctttgcaggagaccagaacagatataaatttttccataagagaagaaaaggacagtctattcttttatatcaaaaatcacttttttttcagtagaataagtctgttttaagatgttaaatttactgaatagtttggacaaaattaaaacatgtagatttattatcatcatcataatgataataagtagttaacggtaatgaacatatacgtatttccaaagcttttatgagactacacattgagaatacatacttataggcccttattatttctttaatgcagaaactctgaacaggctcattgaaaagagcaaaagatggcattgtataaatagcaaaatgaattcaagcttttattattttttgtctcttctgacttctataacttagcaacaacaaattaaatcccatttcaatgtaacactatcatgaaattctctatttaacaaaatgtcttctagaccccagctgattatctaattgttctgagcatttagcaattcagtcacttttattaaatatccactatgtgctatgtgctttgaaggacagagagataaatgtgagtcagtccaggagcttataatctggtgggtaaggtagacttttaaaaacattttataaaacaaagctgaattaaatatgatgtttaaaacagtcctggtagaaatgtaatatatttgtcattatatatatattatatattattaataatatatcaatgatatatttatataatacattagttatataatgtattaatatattacactatattttattatattatattaatctacaatatagattaattatattatataatatatataggataatcctgttaatttgggagctttggcttaggaaaaaatctcttaagatttttctagagcagaacttccaagttagactaacattttggatattaatggtctacatatagcttccctagaatcaacctaatcccaagaagacatggagatcaatttacaatgagcttttgggcttccatacagaactaagaaaacagactgaaatataatcaacacaaacactaaaagttaaaatttcaatgtatttcaaaaacattttgaaatgaagtagtgtggtataaggagaattgcacaaaattagtaagaatcatagagtgcataatccttcattgctttttttaaaaaaatccagcacatattgattgaatgcctgctatatttcaggcactgtgttatggattacggatataatcataatcaaatacatatattggtcctgtctttatggaaccttctatctcaagtagtaaatgttcaaaaaatttgttaagtaataagttatgaatcataaaaatatatttcaatgcaggtccctattgtgtttccatccatagcccttattatcttctcttatactatattatttatttatttattgtatttattgcagactatctccccaaactaaaataacatctcacaagggagtagatctctgtctgttttatttcctcctggctcccaaggacctagaacagtgtctggtatcaataaatatttgttaagtgaatggataggcctgactttgcttaacaccaagtatgcagaatgggaacaggaaactaaatttagcaaacaggtactaccctgatagccacaaaaggatacaccaatataaaataaaggaagctgactaattctctaacaccacatacaagacacattcatatgctatatgtgtatttctgcatttatcaaaacattttaatgacatattttacttaaggcaatccttagagtttaaagaatgaattaaacttcttgcccaactgttatttgcagagatggcttttgtaaaggacttgttcttcccttttgcatgtgtgtatatatttaaacacatgcaggtacacggttttcagttaagtttgtgttgggataaacacacagcatgaatcctgggggctatgaaatacatctgtgtatatataatccaaaatttattatggaaacacaagaaaattcttcacttttaagtatggttagattggggattaagaataaaatttagaatgttagactcttaccctacccatgctctatccgaaaatgactttctacccatgttgagtgtaccctcttctcattatctccagctctgatttactcattcattcattcacatgataatttatgagtgctgttctaagtccttggagttacctaagagctcttctaagcactgttgggacagggttatttccttctgcaagacacaataagaaggtttttgtttgttttgttttgttgtatatcttttcaaattgccattcatcattattgacaatccacataccacttagtttgtgaatatgtttgtgtatttagtttgacattttgggtggaaataaaagccttctgtttgtagttaattaaaaatgaaagtattcatgttgggattttatttttaaaaattgatctggtaagacaaagtggtttttttttcaatcttgctgatatacagttctttttttaatgaaaaaatgtcaaaaaacttaagtaaattaaattttgctatctgctgtatttgttcaatttagttggaaagtttaaaaatacctccaatccatctatatttgctgaagaataaatctagactttatatgtatatattattatacattgatggctataagacacattcatgatcatgcagtttcttcatttgcacataatatttacaacatatgcaattattttatttttattatatacaataaaaggcaggccattttcactttttaaaagtctcctctgaatgatacattgatggctataagacacattcatgatcattctaggccagccccctcactttacaggtgaggaaacagaggcaaaaaagcaagtcttgccttagcagagctatgctagaattcacatcttttgacattaatctgtattgtgtttattccaggactccagattaatgttaatctgtaggataatatatgagtttaagattagaaaaatcttagggaatgtgaacaatatcaatgtgactgaacagagtcttagtcatattaattaaagtggattgacttttatatgttcagttggatgggaaatcagtgttctatcagtatttcctcaatatcatattcatggcagaatattcctttagaattttcaaaacacattttgctactatgaattgtgtagttacgtattaacgaggatggttgtatggttatcattttcgcaccagaagaaaaataaacccacaatacacaaccctgaaataaggaaagtagaacaagctcttctactatcaaattttcttccagagcctgtggcatgcctccacatctgtgatctgtgtctgggccctagaattcttctagggtcatcacaatgctgcagagatggactcaaatcagatgcaaatttaatcaggtgaacaacaacagactcagaacacatctaagatgattatttttacatttttttgtcactgttgctactgttaagcagtggtctcttgctaaaacacaacctcactcagaaaccaatatataaagaaaggttccctagatgaaactgagtgccccacagaaatgtctggttcagtctcattattttacaaggattgaaaaggaagccagattgggagtccttcccacggtctacatctagagtctggacttacttctcaccactcctgcacacactggctcttcccaggtctcactccaccttttccttcctgccaagcatgctccagcatcacatgctgcctccttttctgggagcactgttgccacagtcttgatacagctccttcgtgttgaggtttcagctcaattttgcctattcaggaaatttgctggtaccaaccactctctttccttctttattgagagaaactcagttgcataaaattggactaatcttaatctttggttcatgaagcattctcatattggagccatgcatggtttcctttactttcattagttacttaattagttattttaaatgtgtactaattacctgtcagcttaaagcacacacaaaaagctaggatcttgataatgacttacatgtattacttccattaacccgtccctatgccttctccaatctgaactctgtggtcacatcattattttcagttatatgtactttcattgcgtccatatataacatacacacacacacattattttagttgttttaaactttagtaaatagttatcagtctgcatgcaatcttttaggacttacaatttttatataatatttgattgttgaacttgattcatatattcatatgctactcaagttcacttattttggttaccgttaagtatctcattgtgtggcttattcacccatcagttactttctacgtcatcactctgtcttatttgcttcataaaacatagcagtatttgtagaacataccaactttattaatttgtttacttgtttatcatctgcttctcactgctaggacatactttttaaaggacagagatatatcttatttatcacgctatttcaaattattcatgtaacatatattgcattaaaaaaatgaaaaaagaattcactctagacaaactgaacaccttgagtttccttaatatgtcaggttgtttcttatctattgtccttccttcattgcctttaaagctctgccacttagatttgtgatttgaagcagcctaacatacgcctgcttctttttacttatcgtctatatttacaaatttaaaatggatgacttatcataaaaaattataaatgacataaaatatacaaaatgcctggcacattctgaatggtcagcaaatagtaacaagtatgactgctactccaatcacattacttggagtgaatataacccccatccccctgggtagttttctcatccatcaaggctcagcaaaagtttcacccgcttcagggaagctctgagatacctctctatcccctgtacctatcctaacactagcacactgctctgaatttgttattctacttatccacccccatatcccacaactctttcttggggactgtgtcttatttgtttacttattgactagtcctctttcctctaatgccatgttaaacaagtaccctttgagtggctcattccagcttccagttattgtaaatcacactggattttattaacttgagggcatcatcagtatctgcttccctgatctctatgctaacaacccagttaagaaataaggggcttaatcaaggtgctaaatttgaggagcctactctacttggccaaataactaatgggctctttcctatgacaccctttctttataatgattccctttttatttcgtaccacttctattttactcttttgacttaaagatacatttaattattagcctttaatttgtttatttctatgtttgatcttttaaatttcctactgttaacaatatatttttagttaactttatagtagcttctaaaattagcataactaaaataaattaacgttgaatactagaaagcaataaacatcattccaaaatgaaacaaaatatcaaaatttgtataattttcatatttttatcaatgcaataaaaatataaaaatgtatgtttaagtaggtcacattaaaaaataaaatacaacccaggtagcagaaatgtttataacaatgaagtgaaatgagattacatttcatctacgtgatcttttaattatatttttattaatcttgcaccattaattaatagggttataagacagcacatttaacaaggactgcatagagcactttgatatggccacataaggcatgagaatctaatactgatggtcatatattctataaaacttaacatataccaggatgaaaatagagtggaacacattaaaatgtaggttaaaaaaataataaaaaaaaacccaagtcataaaagcttatgctaaattaaatacagagggatagaaagaaaaacagcaaacattatttgctaatgaaaaagtacttagcttggagatgaatgaataaaaatcataattaaagaatctctaattaggctcattctaatgtttcagttcttgtaagacagttccaactacgctttccaaaggtttttcaaaatttcagagttaagtggctactgggacaacaaaggcaaccctcgtgtccacttcaaacaagtccagtctaatactgaaatagatgttttactcatgaagggtcatgttatgtgtgcagttcactgtgctctctatatcaattggataatgagagagcttttcagggtcttgttaaaaactttagccagatgtcaccccaaatcaccaccactaatttccgtactacaaaacagcctttgacctaatgagtagtcaaatattccagctatggctttttcttagtgtttctacaaacatgactgttatctaagaaaaaagactaagaaaaatcattggaatgttatgtttcctaacaaactattaagtatgatttagttacttaaaataatagtaatgttgccagtcatggtaacattaatacctgtaatcccagcactttgggaggctgaggtgggtggatcacctgaggtcaggagttcaagaccagcctggccaacatggtgaaaccccatatctactaaaaatacaaaaaattagccaggcgtggcagcaggtgcatataatcccagctacttgggaggctgaggcaggagaatcacttgaacctgggaggcagaggttgcagtgagccgaggtcgcgccattgcactccaacctgggcaacaacagcgagactctgtctcaaaaaaaaaaatagtaatgtcttcactgtacttttaaaagtaaatcatccatttgtatttctttttaactagaaactagaccagaagttctgcagtaacaggacaaatgtggcgtcaagccaaggtgacacactcatttttgttcttcccaagaacatcttcagctgtctgtacttgaaagtaaaaggtgaataaatacctgaatataaaaattcatatagctactgtagcttttatacctatcatgtcacagcattcaaattagttttcagtaaatattaactattatgtcttactctagtgatagcatctccacagacttgacatataagccatggatttgaaaaaaaagttgattattatgagagatgcatatgcctgagtattctgtccttactgagaataattttttatatcttacaaattaataagatacgtttagagcatagcactcttcacaaaaatacattattaaaactaaaaatacatttttctctttaagaactgtcacaaataaaatgattctatttatgtattagcctttagtctctgataattggatttatcttttaaaatattttagacataatgcattaaagataaaaactctccttatcaaatactgaaatatgtttcttgaaataacaattaaataaatatatgtatgtgtgtgtgtatatatatatacacataaacgtgtgtgtgtatatatatatacatatatatacacacatatatgtaaccagcatccttgtgtatcagaaggggttagattctagtgatggcaatttcaaaaaggggctggcatgtaaagtaaatatgtgaaccatcctggatagaacagggagcgaggggtcagaggatagctgaagaacacattccctgtctatacgcattgatattaaaatagtttgatgcactgaattgaataaactacatatatatagtttatatatatataaataaataagactatatatatagtttatatatatgtttgcaggtgatatgttgacatataaattagaattcttgtgttcaaatttcagtttggcagctatgaaatctctagaaactgatcaaatattttctaggttcagatattctgcctgtgaagtgaggataacacttccttcacaagtaaaggaaaaataatatataagagtagatataaaaactgcctggaacagtgcctgacaaacagcagatacccagcatattctagaatcctttccccatccccttgtaatcacaatctatcaggatgaccttgggtgcaagtgcagtgaagtatcatatggtttttcaagtaaggagctgatgattgcacataagtactctagaaataaggcagctccctgactggttaattcaattacttaaagatgtcttaagtctaaggacgtcttagttttcaggttctctccatttttctgctctgccattctcagtgttccactgaaaagaaactcctttacattgatttcttcatccagtagaggaaacccttcccagaagcttctcagcagagttcactttgtaaatataaggcataattacaaaagattcccatactctaatcaagacctggcaaggagaatggactacaatgatttgtttagactcagatctagctctgagctatagatagatatgatcatcttccctgagggatggatagaaaaaataggaatttttctgttaagcaggaagaaaagatatgaatttggattggcaaccaaccaaggatactcatgttggattctgtaaatatatcaattttcacttccattaattttatgattagcataattgttcaagcagaagcagcattcttggctaacatggctcaggtttccactgagtcattctaatatcaagctaaatgaatatcagattagactagacctggtcattttcaaactatattaaagtatcctttttaaaatgaaactttctagaagagtcccaatttatctaggagataaaaagtagatctgcctggttgaactgaagcatggtatgtgactgtaccccagttcactggatgccacccctaggtgcatattcagagcatttactatgaaaacgagtgtagtcgatctttacagtcccttctagacctttaattttatgtctatgaaactgacaatatgtcatccttccgcaatttgctaccatgtcagtttgcttcaagatgtgtttgatgggttgcatatttttatgatacgacaaaggagtagtataaagatatcagagaaattaccatataacacaattgaaataggctagttgaaaggaaaatgcaaaatcaaaaacaaaacaaagcaaagtcactgtaaattcaccctgaagcaaaactggaggcagtgcaggagaattctagtcccctggaaaggcaggtggcaaagtcactgcgactgctcaacaacttacagactcttaacagcagatctcaaaggagtgatgatgaaaacagctgcagctgctaaccagagagtaggggcaaaatacatatggatagcttgaactgtaagatctttcgtgtaaatttttgttttatcaacaagtgggtcacttaaaaaaaaaaaagaaggggggtaggggcaactgactttaagggaagaagacattttttaattagatcatattaggagaacagttaatatttttttactttgttccaaataaactaggtagaaatcaagataaccaataaaatattcctgaaagactcaataaatatcgaatttgatgtcatcaatatggaagtgggccagtacaaggcctggaaacagtaaatctcagcagatatcaatacaatttgttgtagaatctgaatctcacaaagtgaaatttaggatcacttgttcagcagcagggtcaaacttaaaggtggagtaatagcaatttaccttcttgatgtaccacttgggtaatctgtgaaagatgctggcctgtaaggagaatctaaagtctcccagggggaccaaatttcaaatggtaaagtcatatagattttaaaaacctattcatatattttaaaacttttttcctaagctaatgtaggccaaagctttacattcagtcataatgcataaacatgtcaaccacaatcctttactgagagatcctacaatctcctcatagggaatatttttccttaatatttttagggaaagatcttttttaagcccattaaagttgcaaaggctaatgaaatgttaaataatgggggatcttattggatttaatcatcaccccagctctgcttcattaaccatctctgctcagccttccacaacttcagctcttcaaaagttacgcaaagtaacaaaaatacatcttttgaaggctgatggagcaaataatccagatgaatatttagaaatgcatggctccattgtgatttcctggttctctaccatgccatttttctgcctccagtatgagttagccacaaggactctctacataaaaccactctgacacttgaagttttatgtgttcaggaaagggtaaaaacactatgcaaggaatatctaattgtggtttaaaatttctgttgactggaaaaaatagggcatgtgagattcttgattaattttttttattttgaatggtcctaaaatttcatcttatgatgtataatcaatatgaagtcacattcagtaaatagagtcatggttaatttgaagcagatcctaaaacatttaatgaaaaacatcatttccactcaccttcattctttcaaagaattcagtctttgaattcctatgtcattttattttttggtaggttctgatgaagacaaatcatttgcttatggatactttggctgagatgcatttaatgaaagattcagtaccgtgaagtaggtcatgatcatattaaatgagaatacaagcaaatattgatacaagtgaagcaacaataaagttgcaaaaccaaggggaacctgacctacgagaaatgtgggagtgtgtgtttgaggaacagttgaataccttggggttgcagggttgaataaaggagcttcctagaattagaactgggaagagtatacaagacacataagggaaaacttaacagtattgcctatgtttattgctacttaaaaggcaaagaaatgctaagtataaataaaaataagccaacaaaatcatgtcaggtctttatctaaaaataggttgtataatatatatcttgccttcttgatggggatttctgaagaagttagaaagatgaagtgagttaacgatggaaaaatattttgtaaatgatggctgctctgggagtccccaacattagccttcattcagatatatagacacacgggtctcaatatacagttttactcatggataaaattgattacagcaatgaaaataagaacacactttcagatcataaggtaaaaagtcacaggcagagtctgcaagaatccatatgcaaacttacttatacccacttcctcccatgaagggttacacagagagcattcttcccccagaaataaacatgtagcaacatgtgtgtgatatttctacgagggaaatccattagagatttaggcatccaaaatttttattagaaggtagtcacatatattggtactctctgcttagtacataccaaacttccagagtcatagaaggaaagcaggtgttcagcataaaccacattgtttgcacaacaatcgaaggacaatagaccatgcatatcagttgaagaatagtgagaacactacaaatattcaacttcccaaacaccagacaagggccaatcttgcaagcaagcccttctatgaatagcagtttcaggtctgctgtgttaattaactcttttctgcacaatgacagctgcaaaatagcttgctatatattattatataatatttcggtaatattataaattagaaaagattatatgaaatgaggttattaaattataaggaagctttagttttaataagaaattatgtgtaacatacaaaggcacaatgggagccaaatagttaagtacagtagaagtaagagaaaagttttttaaaatattgttccatctctaaaaaaggaaaccagttttaggcaatagaagaaaaatgccattaagcaacttttaaaacttcttttatggttccaaaaccatttgattatgaaatacatctaaataataaattttggtggttaaacttcaaacatggcaagattatacataaaatagatcttaaaattctataattccatatcacaggatattgtgcatgataaattgttgacaggttaatcctaatccaaatctatgatactgaatctgttcgattcacagctaaacatgacttgaagagtttccaccaaagtgctccaaaatgcttatagaattcagacatcaattctagagggaaaggttaaaagtacttgggttattgaaccagtagtcaagtgaatgactgaaaaactcctctcaagtacataaagggctcttaaatagattctctgcaccaaagaaagcatgagaggcttaatctaaagcatagaggattaaggttagataaaaggaaaaatttataggcaaggagagttgtttaacacagacatgtatcgtagattctcctcgggaaatattaagacttaaaggcttatgtagcaaagggtttaaaatcatagactctcaatccaagctgcctagggttgaatctccttctcactaactaactgggtaggcttgggcaagttatttaacttctctgtaactcagtagtctccacatctttaaaaatgaaatactaatcgagtttgtgtgtgaataaaaaatacacataaaagccctagaataggtcctgtcatctctctaggcactaggttcccatttactaatgttgtcattttctgtggataatatattatgttccaggtattatacagggtagcaaataaagacagatggtgagacaatgcagttatagaggtgaatcagaaaatgactcatattcttgaagaaacttctaatctagtggggaaggtggtcataaacatatctacaaagcacatgggaggagctctgtggcccgtgctgagggttagctgaatgccaaagtggactgcttgggtaccatcattcagatggtgaattacacagtgctatttcatgggtaatgactgtgaaatcagagtgaaaaagtaggagtaccagagtgcggagaatcaacagcagagctggtgtcaccctcacttgtgttcgctttccatgtattgcaactttctgtagtttacaatggcccacttgagtgagtttatgaaagtctggttatttgagtaatttctgtgagtgtgtgtcagcggggtgggggatggtggtggtatttgatcctatctgaaagttatccaagctcttgacttccaataatcagtaccagccatcatctctacatagcctctgcttcagtcatcccctcagtgtttaacttgagataattttaaaacacatgttaaatatcacatatgatacagctttacctttaaaatgcagaatattttccacttattacttagtttataattactatggacagcatattcttgaaagcagctgttataaaactcaagatattaaaagtgaagttttttaaccattcttttcccattgtcttcacttcaactttcaaaaacaaatacaattcatatccttattgcagtttcaggcattttctgcttatgtgggtatgtccaaaaatgtcagtgtaaaattggcattatattgtatgtaaacaaaattcaataatattaaacccttcttaatgataaacattttatagtttaaaaatatatttgaaatagacaaataattccagaaacacaataacgggtctgtgattcggactaacgggtctgtattggaggtcacagctcctattttaaggtacagtgcaaactggatcaccttccaacatgttggctagaactgaagctattgaactctgatttttcacccaaggaaaagctattttctaagcatcctactgtgaaatttgcttacagcaagaaaaaagaaaagcagaaatgatttaccaactgaataagtgtaggtaattttactgtatgtgcattcttaaatgtttaatacaacaatggaccacctctttgcatggagttaaagattcctttttacataatgtgtcccaataaacaaagaagcaaaatattgaaagaaataaagagagagagagagggagagagggagagagagaaggaggaggaggaggaggaggaggaggaggaggaggaggagggaaagaaagaaagagagagagagagaaagagagaaagaagagaaaagaaaagaaaagaaagaaagaaagacctaattgtcacccttcacgctcatatttctcttctgtgccttaagctctagttcacttaaaaagtagctcttcatggagaatagatatacaagatataataaaaaaaaatacttgacctctaggggctacataacacttatgagatgggtatagagaaaactgtattataagcattaaggtgaaaaagattaaaagtatattctgactggtccccaaaacaattctcaactaggtttttttctcaggtgcatgtaactatttttccacagtacagtagatccataccacaagaagatagtcatgagtcatcattcaatataataataacaataactgcatatttcttattctgcagcaaaatcattgacataaatattctataatccaaatctctttgtaaatatatggtattggtactgaaagataaaatgcttaaaacactggtgtaaattaaaaacatgtcttgatttccttctcaagtgttgttaaacactataggtttacattcatattacgtgtagttctctatgccaatggtctccaagatgggtgagtgtgcactcctatgtacaaaaagacctactgggttaaaaaaacaaaatgttaaaagttctattcattgttttattttaaaaataagaagaaatgaaactaagctttgctaataggtaacatgtagactgacactgcccttacttagtgggtattctccagtcctgttacatggacaggatggaggaatcatgaaggaaaaactgaagctgcaacagaagaggatgacagtgaagctctgtgatacggtttgggtgtgtacctacccaaatctcatcttgaattgtaactcccataattcccacgtgttgtgggagggacctggtgggacctaacagaatcatggcgtgggtctttcctgtgctgttctcatgatggtgaataagtctcaagagatctgatggttttctaaaggggagttcccttgcacactcgctttgcctgccaccaagaaagacgtgactttgctcctcctttgccttccaccatgattgtgaggtctctccagccatgtggaactgtgaatcaattaaacctctttcctttataaattacccagtcttgaatatgtctttattagcagcgtgagaacagacaaatacactctgccttactctcacttgtaacgtttgccctcagcatatcacaacttgctgcagtttccatggatgggcctgcttaaggagttgatagatttatgatccagttttaattaaacttaacctcacaaaaagcataaaattggctttaaaaaaggttcttcagaactattgaggaaaacatgaatttttcctcaaaaacagcacaagaatggctaagctggttctcctaatagtgcaagttcttcatggacattatgcagtagacactgtgatgatccaatccaatcagacaagaagttgacagaaattcaaaaatatatggatttatgtccaatatcattaatgataaaccttgattcagcaaggttttgtgcttgaaatattatctaataatagcaatgcatttatgtaatttataaacaaatacagtatttgttctcaacaatggggtatgcaatttaaactttggagatcaagtgggacacttgccaaatgctttagactaagtaaaacattttactaatgtcacataataaaatgtattttttctacattccctaaactaatggcatataccaatatgtgcttagattagtcaattctgttatagtgaagaatataattcaaattcagtgagccaaattttacactaatttgaacattgaaaatttgaaattatacattaatatactttatgaagaaaattttagataattccctccacaaaaaataaaatcaagaatcttataatttcaaggctggaaaactgaagttgccactatagttagataaatgtgctcttattagtttccaatgtgctatatttgtgtttacagacaaaggatttctctgagtaattgtggtgactattgggctattttgatactaacagctattgaagtcaaaattaacttttacaactgtaacaatgtcaaccaaaattcatcaagtaatgattctaattatggttctgaaatattgtgcctgacaataacatcatcatgaaatgctttaagaaagcaaaatgataccatgacacattgtattgttactttaggccacaccttttgaaatattaaagttagtgtggagaaaataaaatgtggcattaaggtaaggtatagtataaggattatatatttggatattttgaaaatgtgttattttcatttatcctctgatacatttcatatattattttattatttaattttaaatttatctccatgtttttattccaccaattaaggaacaattagaatatttaatatgaggccttcaaaaatattttccttaaatgaaatatggcttccctggaattctcaaatgtctacaatacattcacatatgattttaaagcagaattaccaattgtatttgacttgattggaattaaaatttgttagcacctgctaggtattcatcagttgcacagtgggaacttgtagcctagtgaatctagacaaatatttaaaagttggtaatggataattcagcagttaaaattatatatggacatttttgcctgacaattcatgtttcaataattttttttcaaatatgtcccagaattaccaccctcaaggaagcaagtattatttacaattctgtcccaaatttctaaacatatgtctgtttattaagtcaaaagtgatggcaaaacagcaatttaccaattcctaaattaagttgccgattatagattactcttaaagttagtaattaaaacaaggtgatttgaatttttttgaatattgttgcttgctggacaaataacaatatttctgaatttctgacatgttgtacatatcacaaaaaggaataaggctgttgggtttttttttggtagtaatttctggtaggaaataaaggggttgatattagcaaacatttttccttgttaatacaatgtgtttgagatttcaaatacgtttccactttttttttctgacataaatctgtaaacacacaaggtaacaattcattcaaacttgagataaatgtagtcaatatcttttctggaaaatgtattttcaagaaatagattatttttgtatgtgactacaggtagtctcaaataacacatttcaatgtacctatattgcaaacataatgtgtacaacatagaatatctcctatctttttcagtgccacattgtgatatttaaagtcaaaggaactgccattaaaccctgcctaaacattttattttgttaagttattcaggaatagtctttgaaattagaaatatcacctcacctcccgccactgacacaaacactgagtttatttatattcaagatttaattctctattttgaataatttaaatttaaaagatatttaaaccaaagaaaataaatttgaatcctttcaacacaggggtcgtatctgtctttttaaattattacattccaaatgactataacagtgcttggccggtagttggcatgctgtaactatttgtggactaaataaacacattattcttacaaacaaatctgatagctacatgatcctggacaactccacttcttctggtccactcatctttaaagttataaaacagttaaaatcattcaatggaatagttgatgtttataatagagactcatacaggcaaaagcactaacagctattgaagtcaaaattaacttttgactaacataagttctatgttagtttgagacatgaaaaccctaattaaagaacatggagtagataacattattcttattatgttgttttgaatatatgtttttaatgacttgcctctactgatatttcctttttgactttcactatttatcttctcctagaaattgtagatgtatccttaaatcaacttttaaaaagtcagctttcatattgggtgaagacaaataatgttccaaaaaagccagtctaaataagaagatgcgtcctagagctttgcttttttagctgtcggtactagcaggccaacactcaggctggtgcacatgtgcgtgcgtgtgcacacacacacacacacacacagcatcaaaccaggatagttttgcataatggctctagaagtcattgtataccacagactgagaaagattggtattttaaaagtcctcttgccttatataactttgaagagaaaaatttaaaagatagctattcttctaaacaagtgattggatggcagcaaaggagattttaaaaatgtttttctagacatccttaagctagttttatgtttatcttagtttcgttctgtgttcccttttaatgatatgtgaagtcttaactagcaaaaaaatattttaatgagctttcattgttttaactaccaagaaaaggctatttgctctgtataaatatcataaatgatcatgtctactccataattagtgtatatcactagtacttgataaatgtattacaagtaaaaatctaagcaggtttgacaatatttataagaaaacgtgactttcttaataatatttacagatgatgccttcatacacaaagaaaatgagtttcagaggggtcaaatgaattgccaacttttcacagagagcaagagaggttgaagtggattttgaactagtttattattaatgctgatgttttgtttattctatctacactgcctcacacatagtgacagacttcgtcaaataaaatccctgaaaatacacatccctggctatttcaagttctatgttagtgtgagaaatgaaaacactaatttttttgacttactagatgaatgaacacatacgtaaagtaatatttattaatcattaatcacaatagttattttatctaaatatcatactaagggcaaaaacatttttaaaagtaagttgatttttccaaaaggtggttgaaaagtgtgatcccttattaacaccttcacattttatttggataatagcactagatatttttcacttatcttcataaccatgtagatatagtgttgtgctcatttaaaataatgataaatgaataaactaattttcagaatgataaagcaatttgtcaaatatctcaactctgataaatatctgacccatgtctcttgatcaaaagctttatttctctcagttgaatttttgattgctaacctagtggtctgagaacctctgaaattgtatgtataactctgtgtggactgtcgagggagaagcttcataactttctacaacatctcaacagacttgacaattcaaaattcttaagaaccacagatgacacttttataaacattatatataatagatttacatattttcaactgttgtttgtttagtttggctgcattcacaataatggatgatacatgactatagtatttcttcaatattccagagtgacactgaattttaaatacaatctattgaaatctaacgactacattaagcaccatttaactgtggatattcaatgcctgagattactcagtgatggataacccacacatcttttatagactaatttattcttagtgtcctccagcaaagccatcaggcattcttgggacagctgaagggcactgcactgagagaaagaaggggtggcattccatggaagtcatgatggtgttcttcaccaattcttgtagcattgggaggcactctgctctgaattgaaggaagcatggtcagtattgtcctcaaagagagtgggctctgtttttgttttcagtccattccctctttatgagtaacaggtggaaggtttccccaaagctcctgcagcatgccagctcccgactaacagctggcatgaatactgagcaattgtcctcaaatataccaataccctagacaaatcaaatcagaaaccacgctccatcactatccccaccaccaagaaaagtgccacatcagaattggtaaaagctgttccctgggttatttaagtaggtagccaaggttaagaacttctttgttcagtaaagccatcctaggcaggcaaaatctcatgagacgatattaacacctatagaggactggctgagtattattcccagataggaatgttaaaagtctttgtttcttcattgctgtttttggtaccagcagccagctaacacagttagcagtggcttcagacctctcaggggatctacaaatctctcactagctcaccagattgccttgatcacaggttgctgggcttgtgtggaccatgattacaaatttaagaaacatgtatttttagccctttgtgaatgggaacctcaatctgactttagtacatccaacttttgtaatggttttagaaacaattttctgggaaaaaaagaagactctgtattttatgtttggctatttgtttaaaagttgaatgttgtgcaaaacgtactcatctattacaacttgttcaatcttatctactttttgtcagagtgacataagcctctcctcctacaaggtacaatagctatgctaatttgctagcccttttgttgtctggttatcaaaagccatgagtgacacttaggatttgagagcatgcaaattatttcttaatctttatgtattccctgaattgtcaattacacttaagaaacgaaaagaaagagaaagcactatttccaacaaataagcataactgacaatttttttcaactacaatactgttaattgttgtttttttttttcatttatagtgaatatcattcatgttgtccactctaggaaaaaaaaatcatccctagggcatttccctctagcaattctagttttagccatatcactcactgtaacagatgagattaatgcagcttttcaaccatctttaggaagaatattcagatgctttagcagctgcccagcttcttaagaactcactaatcctttaatctccagacactttttttcataaaagattcacaagcaaaacaaatgcaatatggatcaaaaaatttaatcagaatgcttaaaatgcaattacattcatcagggtgttctgttaggctgggtattaaatctgggctttattcaatatcctccttttattataaagcaatatttttccactctgtaaaccatctgatccctaggctaatgtcctctcagcttaaatattaaaaagagagcgctatgaaaaatgagctggagaaatattcctcttatttcagtggaaaaagttcaaaccagtctcttcctgaaatcttgttttataaatgaccagataatttgaccacctggaattctaaagttacactttcaaacagtggctgcaggatcattatcctactttaaatgtcaaatgtatatcctcctacacacctcctcaattgagtaaaaaatgtcaacaatttgaacttgaaaataatagtctatttttccctaattcggcatttgcaaagtctgaaggcaatgctgatttcttcatgcaagcacagaaccctgaaaagtttaaaaaaatccatcttagttatatttctccagttccctatttcacatctaatagcattcaactgtaacaatagctttgaaataaagagctgtccagcacagcatgatttgaaacagttgagtgcttcttttaagtctataccctagctataacatggtggttggagttttgtaagacatatggaagttaagtgaagcagtggaggaagttcaaggatttcctctgacaaatgccatcctcagagtaagagaaacttggtccataaatgcagacacactaacatcttgagctgtgcttaacatttaatggattctttgtaaaattagtaagtggcccaattatgcagggagtcagttttccctgtttcctcctaaaatgagtttgtgcaaataaaaaataattaaatttcacttttcaattccaatgtttccacattagatgaaaacagaaacaattgagcagtgaattatcatagtcctatattcagtcaacaagcggttacaataaccaacaagtagttactacaataatgttaaaatctatcatacataattaattcatttgccactcattatgctgccaactgagcccacatgaagttacaataaggatttgcaagaagatttaaggtttcaaatggcccaatgcacaactgactgtaagttatctataaaggctagacaatggccacaggcaaagatactatacagcaagcttgtccaacctgcagtccacaggccacatgtggcccagaacagctttgaatgtggcccaaaacaaatttgtaaactttcttaaaacattatgatttttttttgcaatttttttggctcgtcagctatggttagtgttagtgtattttatgtatggcccaagataattcttctaatgtggccctgggaagccaaaagattgtacacccggctacagccatcacttctattaccagtagtgcaattattgaggctttcctttgtgccaggtttaatatgcactaactgattaaattttcataatagcgtgatgccattgtgtgtattatacaatttctcatctaggccgtttttgtctaactttgatatatgtggttatagtaattactcttgttgcagataagaaaactaagaagtagaaaagttatataccttgagcaaggccatactaaaagtaagagagacagagcggggcttcaaacccaggccgtctggcttaagaccccatgttcctaattctccagactaattctgccttccaaattcattctgtatcctctatttaatttcctatctaggcctgtttgtcccaagttattttgaagcatacagtttaaaatattatctacctgatattggctcaacaagtagaatatttagaaacacagcccctagctaaagtgggtccatttctgggtataaagtttgtaccaccttgtgtcatctgtgggataggccacatccagacacagcatagcctgtatgacacagaaagaaataaaaacaaaacaaaacaaaaaacttgcaagtaatatggtgtgataagacttctttatatggaaattgcaattgaacctggaatcatggcctgtcttctagtctagcctaatggagtaaaatgacacaagtccattgctttctgggcttgtatgtttctcaggtctctcaaggctgcactgaccacctgacttagggactgcctctttaggaattgggaagcaatatctattaatgtgtatcctcatgtataattgttctgtttatggataaactgaagggagaacaatcttgaacctattcaaagatgtcagtcttataatactacaaaaccatattggtctttgtggccaatcctgccacaaaaagtactatgcagggaagaatccaatagactagagattaggcacctggaagtcacccaacacagtatagcatattcttggacctctttctagagatttcaaatatgaggggtggtggagtgtaatgcatgaataacaaatagaatatatcaaaataaaacagtagtttatcagctggtatgcaactagcagatgctcagctgagcttgacatttgtcactccttattcttcatggtacataaatttatttccaaagtgattggtatgtcattgagcaaactacatacaaaatgactttctcagcaggtaatggttcaaattttatgcaaaacctaatgattttcacattcaactattttttaaatccctgctaattcttagactgtggaaaactatgaatggtgtgtatgtaaccaataaaccaataagtacagtgtttttttcctatgcagaaatatggaagacatattttcctgatagatatcaacatgaaaaagtattatgactagatagttctgctttataaatagtatgcatatattatttatcacccaatctgagatgattttgatagtggaaatatacattaataactaatactagaaaaacagatgggagtattctaagaaagcttgtgcatggttaccatatttataaagtactacagattaatttgtacttttattgtatatgatttgaagtttgaaatataattcctacttctatattacaattaattaaagcaatttcaatgaaacagtagtacccaattattatagtaataacacataattattttttctgtgcaatgtttaattattaaagttgatatctatcttgagcaagattcctttaaaataggtatatggtgctaactcttagatttccaactatgcccagatcctttatagacatatttaaatgtacttcttactattgtttgaagatgtagagaagcctactcattatttttctttcttttaaggcaatatttggtttttctttttactattaatgtgaaaaattactaacatctcatttataaagataaaaccatacatagccactgaatggcatttttattaagatcatctttctatattggcattccaaagagtagaaccaaaagtatatcttactgcccagcaaaatgcaaatgaggtggagaatagcacattttatgcacaaatagcatgtttggttttaataatgactataggataaaaccacaaattattcaaataagggtttctccatgaatctcagcttttaatctcttgctaggctgtttaaaaatatatacagaattgaccaaactgttttcaagacgctgcctgcaattatcacactgatgctttttaacatttctatcttccatccaaccttctatgcttccatcgctgtttgcatagaaccatatatttattcactgaaagttaccagttcttaattacattttgtttccatttaagctatggtagtaagcagtgtattgtaatattagcaataatccagtgagaattccccaaaatgcaatgctttgtctgggttggtgcttaaattgtattatatgttgagtttagtctttgagttcttccactttaagttactgttctcttattctctaagaagcagtatatatgccttttattcatatacatattcatatacatattcaacatatatgtagtgtatatatatgttgaataatttttcaacttgtgttgaatatatatatgtatacatatatagggtttactctctcaaacaacatacagtcaagcagagaacaaaggtaattagatatgatctcagatatttagaagtatattaaacaacagggtacagctttctacaggcattcagaagccagaacagatgcctagttgggataactagagaagatattgataagttaacaattgacagagatggtggaaatattcatttcagctgggggagctgtcatgtatgattagaaggagcaaggtgtttggagaacagtattaattcatatggctggtaggtatttgacatgtagggtcagagtggcagatgaggctgttaggggccagatcatggcttagtcatcaagaattcaatattatctacagacaggtaagacagcactatctaaaattatttttctttttattagaactgaaagataatctaaaactaagtaataatatcaattatattaagacactgaagagtttagattctgatgtgtacacaattatatgtatcaggtttaaggcagcacatttggaccttgcaatttgactcaaagttgttttgactctgctctgcctgatagtcaatacaactgataatctgcagctgatcttaaattgtctcagatactcatattgaaaataaattattacctttagaactaaccagcctgcaataaaactaacaacagataaagtagtatacaacactttttgttttgaataaaaattgaaaatgatgtacaaaatttgactgaacaaaatggaactccatagaagaaactgcaaaagaaaattcacaagtgaaataacccattacgtaatatgaactaatgattcagttcatggtgttaaggtctgcaagaaatataatttatttaatgaaaataaattcaaaagaaaaaatcaaaatggaaaaattatatgtcaaaaataggtcaagaaattaaattggcttaatccaattcaatccagaaaataattttaaaatataactaggtcaaaatatcagaagcaaagcatctctgggtcaaaatgttgtggcccaattatctttaatacactagagtttccctcttcgctaaactaaaagcgctggcttcttgctcatgtttagataatggggatgtagcacaagttctaaaatatggtaacaaacatatgtaagttgaagagcatatttgctgtaaaacataaccttgtgcatcatcaaaaaataatcattgttataaggatcacgtggtatattttgggataatatttatatcccataaaatagcccttgccttcaaaaggtgtttgatcctattgtgataagagaatagtgaaaaagcaaataagagatatatgcattgaattcttagaatacagaaatttcaagacaaatttcttgagaagagtttctcaagaatttttttaatcaaaagctaaagagatatgagcaaaggctaaatattctacattttactttattaaacagtctgaatatctaccttgatgagtgcttttattaagcccaataagacctttactgatattttcttctatagagacatcttgtgaaatagtcacagaaaacaataaaaatattaacaagcttcaacatgaatttatatcactattgtcattatctgtaactttcattcagtttacagttcttctactctagtccaggctcttatcattctatgtcagtctcttttgggctttgaatgcttccaatatcttcaaattttaattcatttattacttgcagattaatcatccaaaaacactattttccatacattgccccatgttgaagccatggaaaagctctctgacttcagtaaaattaaaaatgaggaaaacatttaaatctttttaaaaaaatgacttggggccagtattagtacattttaatatagaaaaagatgattgatagtatgctgaatcggcactgacactggccttaagctagaaaacactaccctatataaaatcttggacatcattttatttgggagaagggtttggtaagtattattttagtctactgcagtaaagtaggtccttatgcagtatcatcaattggttcttggaaactgtgacttttaagtgaaatgacatacagcaggtcctcaaattacattgttttgttcaacatcattcccctataatgttgatgagaacaaaaactacactaagtgaggacttactgtacatggtacaatggccaactttttttttttttttgccgttgccatcactaagctgtctatccactcttcaatagatacacaaaacttttttttttcctaatggcctacatttatttagtttgtctaaatatgtgggaaaagaagatgtttcatgtttgtcctttgggctcctactacttgctgcaaaagattcagcttttctcagctcaatactacctaaacaagaagtgagttgcaagatcctttctctggagctattactggcagctagaatttacaggtatgctctattagaaaataaataatagatatcatcacctctggcatactatcttaacttcctaaatttttcatgtgactgttgttggtctaatagtcttgtcatcacagcctactactggatctagttctgtcgatttgtgcttcccttttgctgtcatccctttctgtgcttggggaaacacaggtcttgcttctgaagggggcataaagaataatattaagtagaacagtctctgagatttcacagagcttcccaatgcttatatggttttaggctggaaatagagatcagattcttgcataattgtgtgaaagagactgaatcatcaacagatcttgctctttttttttcttcacttacctatagtacatcaatgagtgaataggtccagagtgagcagtctatgttgcctttcttttaactgggaatccattctctatgcattttaggtcaaaacgtttattccaaggtgacaacttcagtcatatggttctgaaaacctctttggtctacttgtatgacttgcattaaaaattattactcccatggctgttcaaactctgttgataacctctggcagattcagaccattactctgttaggcacactaattagttcttgatgacccagtcctggagatcattagcctctttcctttcaaaaagaactacacactcttgagtgatatggaggcagtggtctgaggtactgcctttatacaaaattagttattgactgctaagcagaaacaagcattcccaaatgattcctcttaccttattccaaagcatacacaacaaaaactcccctgcaattatcagaaatatatgtgtttttttctatttaggactttacactattgtgattatgatagacaataatccaattagttacattttaccacaatttgtcaacatgtacaaaggaggacaacaatgactcaataaaaagcaatacattagttataatgacttaaaaaggagtcatcaccagatgccactgtgagattggttatgtgtgttcagaaaaggggctttaattctttattcaaacaacagatattttctcattcttaacaatatgaaccttttaacccatttggaccatttgaacatttacctccaaggaaaacagtagatcttatccacccaaaggaacaatgttacggtgtttgaattttctcaaattgttgcttgagaatataaattgtgtaacaacagtaaaaattagacctagacctatattttatgaaattacaaatctcttttcagaaaatatagagatgattattaggatagttttatcatctacaaaatcaaggagtccatagttagaaggcctcattatttgagcaggaaaaataaactttgtgttaattctcatattatcatatgtgtagtttggatatttaattgttaaatattatattgaagtgtgccatacatggaaaaatgatgaaatcagaaatatgttcatcaattttcacatttttttaaaaagggcaaaacactcgtgtagtcaccaccctgttcaagatataaaacacagtcagtgctgagttccttttgtgtcccttcacaattgctacatcctcacctttcaacaggcaatgccatcatgacttcttgaagcacatattagttttacctaattgtaaataaactatataaatgaaatgacagagttggtatgctttcatctctattctctttcactcaacattatctttgtaagattcaacccgtgttgtacaaaagacagtattccatccactttcacgactgtatagtattctatgtgtgcctataacaaaattaatcatctcagcctactactgattgaaatttaggttgttagcaccaataatgctaccatgaatattcttaagcttgtcctttgaagtgtgtgtgtgtgcatttgtatatgtgtgtgtatgtgtatatgtgtaaatttcttttgaatataaacataaaagtgaattctaagtttctagatcacatggtaggcatattatacctttagccgctattgctacgcagtttcccaaagtggatgtaccaatttaaactcccacctatagtgtatatgagttcccattcctccatgtactcaacaacattcgttactttaagccagtctggtgggcacatgagggtactacactcttactttaatttgcttttttttctgattagtaattatgttgggaagcttttcatgtatacagtgggtctttggatatcttctgttggagagtgctccttcaagattttgcacattttttattgagttacctgtctttgccttaaggaattgtagaattcctttttatattttggatataagtctttgccagttataaacatttgaaaagtctcccactaaatgacttttcttgtcactcttaaaattatgccctttgatgaatgaagttctaattttagtataagatttatcaatcttttgcttcataattagtggattggtatgtatacatgtgtatgtgtgtcctcaaggtaataaaaatattctcgttttcctctaaaagttttttacctttaacatttacatccacaatctaccagtaattgatttttgtctatggtgtgagatttgaatcaagacaatttctacatagatatctcattattccaacaacatttattaaaaacactggccttcatccacttttctcctccaataccaattctttcataaagactccctctatgtgagaattatattactttgtctatttctctgcccttttaccaataataggcatactgtgtactgtagctttatgatgagtcttaatatccagtagttttagtcccccaaatttgatctttttcttcaagaatattctgtttgtccttgggcctttgcaatctttaagtttattttcctagccagggaaattgggaaaggaaaagaaataaagggtgtaaagattaaaaaggaagaagtgaaactattataatttgcagataagatacttatgtatgtagaaaaataaaaaagattctacagatgaatgattaaaattaataggtgaatttagaaaatctcaggatacaaagtcagaatgaaaaactacttcatgggtacaacgtaccttatttgggtgacgggtacactaaaagctaagaattaaccactacacagtgtacccatgtaacaaaattgcatttatacttcttaaatattataccacaaattgcctacctaagaacaatataatgaaaaatatttcagttttaaccttggtttaaaaattactatggaaacataattcccaatgactggaagtctggtgtcagtctaggaagtcctcataggttacttaatcctcagataatgccctttctgatttcaattaggcaattacagcccagagctgtgaagtctggggaatgttcttcattaagtcacttttctcagccctagctagtcttgtaatttctatttatttatttatttatttatttatttatttatctgagatggagtctcgctctgtcgcccaggctggagtgcagtggcacaatctcggctcactgcaagctctgcctcccgggttcacgccattctcctgcctcagcctcccgagtagctgggactacaggcacccgccaccacgcccggctaattttttttttattttcagtagagacggggtttcaccgtgttagccaggatggtctcgatctcctggcctcgtgatccgcccgcctcggccttccaaagtgcagggattacaggcgtgagccactgcgcccagcctagtcttgtaatttctttctagtctggaggaaagaaagcagacttctggagacagtaaggctatatttccatggcttatctcatttcttccagaatatttaaatttgatacaactattattaatatagctgtttcaatgtttatgaacatatgaaactagattttcaacaatatgatagaaaacaaagtagaagaaataatgtaggagtacttttggtgttgtacaatcaacagatttagatctttagtaaatctcagatttactatctcgaatttagaactttagacaaaattatttaaaaagttattatatgtaatataattgtatgttataatatttcagctttcaggttgttaaaatgtatatcttgaaaatattctggcatatggttgtcaggtaacattgctaggaagtcctacattttattctgagtttttgttcctctgactctgtgtatatctctgtgtgtgtttgtgtgtgtgtgtgtgtttgtgtgtcttaggtattgtttctttaataaaagaataacgatagtttttgcaactgatattttaaatgtccttcctttgcaaaatagttggcagtcacacttaaattcctccaattaaaagaaaaaatttctagttcataaaatctgttaagtccaataagtgttgctataagaaacccttttaacctatgtatatatcctgaaattctgctcctaaaagtcccttcaccctaaaaaatcctcacagcaaactggaagagcaactgaactataatacattttaaacggcattgcctcttgctcaaataacttgaaaattacttttttttttgtctcctccagcttttcttcagcatggtttctgaattttaatcaaaacataaaaatacaaaagaataaaaggaataacagaaaatctaatttggaataaaaacaaatgacaattggataagcctcagcatattctgggaaatgttaaaagcatcctttcaaataaattatttgccaaatttgaatacaatttacctacctgaaactgtttcattcaggtaaagtctattacaaaggtatacatgagattataggttaatgttttacacattacgacaagtagctcaagaggcaagatgattgtttgagaaaaggtaatttgaaagtactgaattctccgctattgggaaatgcatgtatttattatagtaagagtgaagcacacgggtaaggatctcacaacaataaatcctctgtcatctgtatgaggaaaatggtgagtacctccaggatctgagaagttattattaatagatggcacgatgaatgtaagcgtgcttctaattctgtaatttgaaagcatgcatatgtttctcgatgtaacacacacatttatttactcatagacaaagctgcagttatgttcacacacataacgtcttagggaaataagactgaaggaggtgagaagaaagagagtgtggaagaggtgaagaaagagatggagacaaggagacagagtgcacagtgatactgagaccaagagatggaggtttcaaaaggcctgcataaagatgacttggctgatgcacatagtgagaaaaagcaatgagctgattggaagactgcacagtacccttacagtcccgtagacagttccataaccaaagttaattgctttgatcctccaatgtttttgacatataaaagtatattcagtaaattaacttccctaaatctgaaatttaaagcttatgaaaagtcaaaacaaatgtttgaagactaatcaaaataaagtcctcagcatggtttgatttagaccattttgtactagcttaccaaaattctctattgagttaaataaggaatgtaactaactaaaactgggaacagagttaataaaatcatggctcacaaaaagccattttttttttattttggccagcaataaaatccttggctagcgtttctctgttagctataacaaaaacctagttgtaaataagaaataaaattttgagacagatgttagctgtaacatagaaatatactttccattaacaatctggcatgttgtatggtggttctactccaaaaggcaatgtatcttttaattatttattcattttttttgagatggagtcttgctctgtcgcctgggctggagtgcagtggtgcgatctccgctcactgcaacttccaactccccgttcaagcgattctcctgccttagcctcccgagtagctgggattacaggcatgcaccaccacaccaggctaatttttgtatttttaatagagacagggtttcaccatgttggccagactggtcttgaactcctgacctcaggtgattcacctgcctcagcctcacaaagtgctgggattacaggcatgagccactgtgcttggccggcaatgtatcttttaatgtaacttgataatattgtcctctgcctctgcagccttcccagacatattactaaaattaattcaattttagcaatcaaaactgtaaatgaacttagttattcagcaatcaatgaaatctaaatgaagagtcactgttatccaattcctcatgcattcccttaaaatctctttctctagaaaaagtctttagataaaggcagttcacaaatatatggcaaccctaacttataacttgattatcatgttatcacatccctatctggttcacataaattatctaacctttgtcaaattagaaaaatatttggattcacattttttaggctgaatttcatgaatactgtaatatacctattttgtattttataagcttagatagtaaaatcattcaggtaaatgactattctttaaaagatgtgttatgtttaataaagtttaatattaaaattcctaaaagttaattttaagttcactccagagttatggagctatgtcttcctctgtaagaaataatacaaaatgaatcctgactttgtagtgaaacaattccctcgttttattgtagaaatattttgggggtggtgactctgtgattgctttggaattaaagcaatctgctcattatctcatattggatatgaaagctgaaggcaagaataatgcaaagcacacatataattagtaggttatatacccagaagtaatcagttctgtaagacacacttcttcaatgtccaataagcagaaatgattagcagcaatgaaaaagaaatgtaaatgttttccattaacttcttttcctatttctggtagaaaaaccacaaataagtgattcattacaaacgtattggcaatggtaaaacaaagaaaaattgttaatgcaatcattaaatttatcttacaagtttctgtaattgtttaaaaacataaatggtggttattatacgccaaaacatctcttgtcattcattttaaatatttgtcaaaatcaatttaattctggaagtctatgtgagaaaagtcacaagccaactgctattgtaagtcgcaaacttcttagaagagctctttcattactaagtaaagtataccatgattgtatgatactggacatagagaaacaagatttgcctttcactctttgtaatttgacttgtttgtgcttttaagttactccaattattttctaactttcaacattattctgattaagtcctagctacagagtcttcaaaagacttttataagcctaactcttaaattgctgctttctttgttttagcaagcaccaaggaactaataaaacaagtttactcatgtcaaattttagattaaaaacagattgctccttttatgtgataacagagttgaagcaggatgaagtcacctcaattatcattgtccctgggttttattgtacactactcatttaagacaaataattacctaggcctcttagcttgcaagtgattcacacattataagtctgtaatgttctgcatttctgctctcttgctagtacaattaaagtttattgacagtaaatatagtaaattttaatttttgccatataaatacttagtgctatgttactgacagaaagatgatttcccaaaccttaggaaatacttatgcaatgttttatttaaatattaaaaataggaatattcactcctacattaacactagcatgttataatactaccatggtgttaggctctataataaccattagagaataatttggcatgaaaataaatcattaattttatttctctgaaataaaaaatacaactcaaaaagaattaggaaaaaacaaagacaatatattacattatatatattttatatatatataaatatataaatatatttaaatatattatataatataatatattatatatttatatatttatatatatataaatataatatatttatatatttatatatatataaatataatatatttatatattataaaatatataaatacattatatatatttatatatatattttatatatatatatatatatatatatatatattaaaaaaaagtagttttttttttttttgagacagagtctcactctgtcacccaggctggagtgcagtggtgtgattatggctcactgcagcctccaccttctgggctcaagcactctacctcagcctgatgagttgctgggaccacaaattcatgccatcagtccaggcgtgtttttttttttgttttttttttgtttttttttttttttttttacttttagcagagaagaggtttggctgtgttgcctaggctagtctcaaactcctgagctcaagtcatccgtcatcctcccacttcagcctctcgaagtgctaggattacagacacgagtcactacacccagcccaaaaacaatattgatggaacccaaacacaatttgaatattgccattaacaatataaagaaaaacctataaatattggctaaagactaacaatgaattgtttttataattttcttcatctctcacaggtgatacatgcacaatatgttcacacacgaagtcttgggttatctttaagaataaaaatactcattaaaaaattacagaaaatgtattactctagaatgggtgggatttgaggcttggaacaacaaggaagctacaactaaacaaacaactcagtggatgaaatgaatgtgtgtgatcagcaaacagcaaggaaatgaaaaaactaaaacagaggatttggaatgctgaccaatggggttataaaatgaaatgctaattttttcactactattaaagccagcaaatgatcttttaaaaaattttaaagcataaatgggtaaagtcatgtgaaataaaggacaatttcttttctttttctatattcagcattttaaattctttaaagttgtatccaagttaatataaaacatatttattcaaaaattttatttaaccttgctgttactaaaatatttaaagacacagataaaaggtagtgccatatctctcttaaaaatctcattcaagattctgattgcatgacatgtagaataatcattagatctagcaagtgtttattttcaagctagaactcaaattttccattttaatttttaacatatttatcggctaaagggataaaaacaataacaagtttacaataattgtatgatgataaaatcacagctaatagtttgttaaagccaaattaatgctataacatctgtttcttatcagcagaaaataagagtttttacactatatttttaattcagtagagaatatatgctttgttctcaatttttttcaagcattgtcttagatgagaaaaggcaattttccagagattcctgttcaaacataacttctacagaatatgttcataagtcaaaactcactagattaattcatggagacaacactgcataattgaaactcttgtcattgcaatcactgattaaaactattttcttggctatatttttgtgaaataaaaaaggaacttttagaataggtgaagaagacttctaaatatatagtaaagatactttgctcaaagaatttaaaatggaatgaactgcataaaactgatatatcagatcattattttacttagaaaaaagggaatttaatatggttctatctaaaaataaagtgtgagtaagataataccataaaaggaattgtgctgaagaaaaatagtgagaggtgaagccagttggacttcctgggtcgagtggggacttcgagaacttttctgtctagctataggatcgtaaatgcaccaatcagcgctctgtgtctaactaaaggattgtaaatgcaccaatcagcactctttaaaaatgcaccaatcagcactctgcgtctagctaaaggattgtaaatgcaccattcagcactctgtctagctaaaggattgtaaatgcaccaatcatcactctgtaaaaacgcaccaatcagcactctgtgtctagctaaaggattgtaaatgcacaaatcagcactctgtaaaaacaccccaatcagcactctgtgtctagctaaaggattgtaaacacaccaatcagcactctgcaaaaacgcaccaatcagtgctctgtgtctagctaaaggtttgtaaatgcaccaatcagcaatctgtaaaacgaaccaatcagctctctgtaaaatggaccaatcagcactctgtaaaatggaccaatcagcaggacatgagcagggacaaataagggaataaaagctggccaccccagccagaagcagcaacccactcaggtccccttccatgctgtggaagctttgttcttctgctcttcacaataaatcttgctattgctcactttttgtgtccgcactacctttatgagctgtaacacttaccacaggggtctgcggcttcattcctgaagtcagcgaaactaagaacccactgggaggaacaaactactccagacgtgccacctttaagagctgtaacactcactgtgaggatctgcagcttcactcctgaagtcagtgagaccaggaacccaccagaaggaagaaactccagacacatctgaacatctgaagtaacaaactccagacacaccatctttaagagctgtaacgctcactgtgaaggtccgtggcttcattcttgaagtcagcaagaccaagaacccaccggaaggaaaaaattccagacacagtgggatatgacatcctaactcaatatatgaacctataggggtctaacattcataggtttctgtgtattcagtggaaaaattgagaggattcatcattcaattatcttttctttcctcctttttcttgaccctctgcttcatagagagggcttggaggtaggatccagagtgagcctctgttagaagcattgagagagaagccagaaggtccagtcctgctggcagtagcaaggggccaagaccactaggcctgcctgtgttctcacaagccccactaccatctctagattttctcatcacccagtcttgaaaaatctgtgcctgccccttcagtagctttgccatttcttgattcctttcctctgtgggtgttctggcactggccctttttcccacctctccttcttttctgggatgctgctgctgttgctatctcctctatccttccatccttggcatctggcccttaatcctcagactgggtgggagcccatcccttgtcttttgggatttgcaaactcctaccctgaacccacatgaaagtgactgctttcctgcttctggggatctctttggcacttcccaggaactcctccacctggagcagtaactccaggctgcttcaggctgcatgcttgcacaaaagctggtggttcaggtcaagaaagtctgtaaactgccccagcaaaatgataccagggtctgaaaagctcaagatgctgaccttggcagaaaattgggatattattatttcgaacataaaatagcaatcctaaatgcttgatatttacgtaccaagagacttagaaataatcatacatacagtgaatccttttgaatctctgccattatgtaaagtgataaagattgattagaactggccaggtgtggtggctcacgcttgtaataccagcactttgggagttccaggcgggcagatcacttgaggtcaggagttcaagaccagcctgggcaacatggtaaaaccccgtcgctactaaaaatacaaaaattagctgagtgtggtggcaccctgtctctactaaaaatacaaaaattagctgagcgtggtggtgggtgcctgtaatcccatctacttgggagggtgaggcaggagaatcacttgaatcttggaagcagaggttgcattgagccaagattgagtcactgtactcctgcctgtcctggagagtgaaactctgtctaaaaaataaaaaataaataaataaaagattgactataatttcctagaagtggtccttcataaaaggggcttaaaattccttttttgggtgcttccttgcagacatctactaaaaagtctctagatcttccaatattttcacaaataaacttcattaaagtatatatctatacctatatatatctatatctataaagtatatatctatatgtatatatagatatatcataaagatttatctgttattgcttaggagattggaaaaaacctgtcctgaccataatattaaatagctctggaaaacgcataccatatttggttctttttaacttatctttggattggcatctctttaattacctcccaacttatttcttggagcagctaggcctaaatggatgtagtctatttaaaatagtcatgtgatattctgtgatattcctctgtttaggtaaaataagttgataattatatcttttatttttatttttttcttgagacggagtttcactcttgtttcccaggctggagtgcaatggcgtgaccttggctcactgcaacttctgcctcccaggttcaagtgattctctcgcctcagcctcccaagtagctgggattttctgtctacttgaatgtctgttgggaataactaactgttccatctccccaaacatactttttaatcagtttttcccatattaattaatagcaagatcagccatccatttgctcagaccaaagagtaagaagtcattcctatttctaacccaatataaccacaagtcgtgccagttctatctccaaaatagattatgaaatagacacattatttccagtaccattcatattatactacttaagaagaaaatgagagactcttaattctttaaagtgtaaaataaattaaacacacccctttgaagccctaaaattatatccttttgtaattagaattaaatatacacttatactgtgaccgataaaaactatcaggagaatatacacttatactgtgacctataaaaactatcaggagaacgagaccatcctggctaacacagtgaaaccctgtgtctactaaaaatacaaaaaattaacctggtgtggtggcaggtgcctgtagtcccagctactcgggaggctggggcaggagaatcgcctgtacccgggaggcggggcttgcagtgagccaagatcacgcccctgcagtccagcctgggcaacagagcgaggctccatctcaaaattaaaataaactaaaataaaacctatcttatgatcttgtctctgggttccactctgaacttatgtcctatcactctttctttgatttttattctttggatgttttcctattttgtaattatgactagttattcctgcctaagaatacctagaccatgcctgccttaaatgttttatagaatctagtatcaaaaatctaagctctacaatactatattattgtacaagtttatgcatgggccttcaaatgaattgtcagcaaggagaaatcgaagctaagtttcttgataatgcaacaattgctctactcagaatctgaaacacatagactgtgcattcctattgtcttataatcaagtacaattatataaatgaagattttaataaacattaaaaaacttaaccagtaaaacagcattagttgattctgtgactaacattaatcccactgtttataaaaagtattatctaagcttgtcttcctataaaaatcctcaattgtttttcaataaaggtgaatataaattttaaaatacgccaatagagctatgattacaaatacattgacctaaaattatctatgatttttattttgcttttcaagtgaaaaaaataaaaggaacaaacacataaaccaaaaaagggggacctcctctttcagctttagagtgctcccctccctctgtctctgtatgggggagcttcttccttctgtcttctcccttccttcttgccccttcttgcctattaaactctccattccttaaaaccaaaaaaaaaaaaaaaaaaaaaaaaaaagatcgtgttctttccagaactttcagtgtgatatgaggaataaaagtaatctgaactatcaaaaagtatgaaatgtataaaatggcaactaattccatacatttattacgtatttgtttgtttcgctcaatgcagatgaaggataagtcaatgtagttaatattttgtatctgctattcactttactttttcggctttgattcagctgtataaaaacaacagtccaggcagaaaattggcaaatggacctgaaactcacattctctccggtgaaatcatcttataatcatttgcaagaattgaaaatttctgcaaatatatagatctgcacaaagcaaaatttacaagtatgtaaacacacacatcatcccagatttaatgataaaataagaataaaataaatgcagaaaatcaaatagtaattttaaaatgtaagtttacaaacttcagtggcatgaatatcaaaaatggtaacactttacacataattgtaaaaatcacataaaacatgtagatatatgaatgtgtatactcttataaagctcttcatttctttatttctttaagagatggggtcttgctatattgcccatgctggccttgaactcctgggtgatcatcctgcctcaacctcctgagtagctgagactataggtgtgtatctccatgcctggctttgagtattttatttttatcaaatcagctattagactaaatctttgtggaacaacttaaaccgtatgtttattgttatatatgtaacaaatcttcatactagaatcatgtttttacagctgttgcactatgtatgttcaatccatccacagtaattaatctctatgactgaggactttaactgctttcctctgggaatcactagcattctttgctttccttttcaatgaaaagcatcttttacaatcatggcatctgctcaagaatgggataagatccatagtactttttgaagttccagattctactatgatatccaagactatatactgcagtgtttccagtacatagaactgcagttctctctctgattagtgttatctttgcagattttaagtcagatttcttagataggaaaaaacctggtatgtatagaggaaagttaaatatggtatttctacagaatgatgagtcatttctggaatgcaactgaaagttgatctggacaggaagatacacaggatctagagaatgggaggttttaacctcacagaaaatgtgtatttgaagcaataagaattaggaaattaatgaagttctgctatcctttaacaatgcttctctctttaggttttgtgaaatgaaatcattcttgttcccataagttgctattgccaaacatggttttatggctcactgccaggttcttcctatatgtctgataccctgaagtgaaatagaatggctcttataaaccttttaaactagatggcatagtgaagataagccatgtaaagtatgataattgtgaataatacagaattatctttgaaaaccaataaataacattcataagtgatcatttttgtgttattttgtttattctatgtgtcctctagctcaactgttgggttgttctttgatcaaaggaacccttattttattcctttttgcatttcccaagattctgatactctataccctgctgctctatgttgcatactataaaatatattgaaatgacttaataaagacttaaaaatgttatttagtgtcatggttcttgtctttctcactggatctctcaatatttttctgactcaatttttcattgatttctaaaataatgcctcaaattcgttactttcactatgtctaagtcccaattttccttacctctcaataaatctattgcaacagcctcctaaccatgatgcttgtcttgatttttttctaaacctcatttcaatttcataaacatcattatgttgctccctacataaaaatgttttatgacttaacattttctctaagttaaagtctaaatatcccagcacagcatataagcccctttggaatcttgtcccaacaattttttcacttgattccatgaactctatcatccagtcacaccgaatggcttcaatcctgccaagaacgaactctgtattatcctgatacacagcacagcataatgcttaagagcataggctctgaagccagatggcctgcagtgaaacatacctgtgtttttaacagttagcagacacaagtatggctaatatgattgttagtcctttctacaatcactgtcatctccctgagtctgcttaacgtgacatcctcctgctctaggacatgcctgtacatcactgtatgatttagcttaaatgtaatttcatctaacatgatatttccaaccttcccagttgctatcctgtaataatagttacatagttgatatagcattttatcacctagcagaattatggtctgtttatattatttctctatcactacaaaagtgagttattaggttgcataggccaacttgttattttagtaaccccggtacctagcctatttcctggcatataagaaagttttcagtaaatgtttattgaactaagttaggaaaaaaataatgcaaaaattaaattacattgcttaaaatataacattggacccccaaaattatcaggtccatcatgtgtctaagaaatattttcatattctgagtgaaattattgcatcttctctaatagagtggtatatatacaaattatattgatatttttaacatattattttcttcatgatttacaaactctcaacagaagtttcttctgaaaatagcaccacaaaaacctatttgattttacttttaaatttccatggatgcaaatgacttacctgggtggattgctggttataattaccttgagagctgctaaaagtcctaaaagtatttgtgacctagactgtcatatttagtaagacttcactgtcctccttgtgattctcccagtatccatcatcttccttttctttctccaattgtttccttcttcctttattgtctaccactctttttatagttgcccatacaactctaataggttttgtaaacttttaatttgaaaattgttccatttagcattccataaatttgggaagtaaaactcaatatagattattttaatgcatgtcattgtccctgccaattatctgtaaaatatatttttgtgttctcaagtacaagtggccataaaaaaagtacaattccttcataaaagtgacatcaagcttataaaatgtctttacattttcaatttaccttagttgtggaattgtattgaaatatactgtcctaatcattcatattctagacacttgttattaataggtatttatactaaaataagatttccattgttatgtcctattattttgaaacttagtcatatgccctttattgagatatctacatcgaaataagattattataagatatcatgctaagttactataagatcaaaattctaatctcaagcagtgatatgttctaatagaccataaatcactagcaccctttgtggtaatataacaaccttggcataaatataatgttatagtgcatgtgaagcacacaaatgagaggactaaaatacagttttccaggtaagaatacaactttcattctcaaagggactcctcaaacttggtaatttttattatatatatatgtatatatactctcagtgtctacttgtatgaatttcagagacatcagtgaaaatccccatctgtggacttgtgaaataaagacttttgggttttgatcaagaatgcctgatttctcattttcagtataagggaattcaatttgttcgttcattcaacaatcaattactaagtttctatcacgcagaaaatgtggcacaaggccctggcataaatttaaataagacctagaaattctaaaagtcaagcttagtgtgggaacacaattctaagtgtcacatcatcatgtgattagtgctatatttgaaggtgagtaatattttagtatcatcaggcaagaagtaaatatcttccattaataaatttaaactgtggaaaggcagattatcagggaacataacaccagaaaagaggataatacactgcatacagaggtagaagatgtgagtccaaaattttttaagctgccaaaagatatttgggcatgccgacagtcccaactacttgggtggccaaggccagaggatcacttgagcccaggagttccagtccactctgggcaacatagcaaaatctatttctaaaataaataaataaatacaattttgtgttaactgctatatattggggccattttttctggtagttaatcaagtaattttctctatgccaataaattaattgattagactccatctctctaccatgtgccttataaagggccttttccaaaagcagtgagcagtgctttggcattaaaaaaaaaaaaaaccctctagtcatgggtcattcagactttattgtgggacatttttagagcatggaggcacacctatgttcacgtactacatctatataaaatggtattccctagcagtaagtataggacaatatttcaaatcttatatcaaaagtgaataaagaaaatctaattgaagcaaaagctctttctctaagctgttttccatcataaaccaaaaatatatatttctattacaaatcacttttaaactctatctaaagaagttacattacagtgacagctacggctattagttattcaccttgcaatcagcactaaatctagtaaatatggattcaagagactatatgtgctcgctgtgatagaaatgtatggagagagagggaggagaagcaggaggaggaagacaggggaaacatctaaaggggaggaagttactaagagatgcagagggtacaggaagcatgtctccaaataaaaatcaccagattaaataagcacacattttagtattatgctttatgaagtcagacatacatttcaataattgcttttaatgattattcatgaatgaattattaattttctagaccaaaaatatcattccgtgcttgctaaataacatttgctcaaatgaaaaaatacatatataaaaaggctaaagcctttcacatcattagtactgctgtagagggttagtatttgatcttgttataattcatgctcagtttgttagaacatttccacatcacaaattacaacattcgggttcaaggatggatataaagtacacagagaaagtattgtaagagaattattttgcagtgagcctgataatagaattatgtgtgtacctatgtatggttttgagtggaagcctatgcaaatgtcagcaaaaggcgggggttcttttcaatttttcttgagaacaccaatttttctgacagtcttgtcctttttaagatttactgagttatatctataaaatcccctcagtttacagataaaatagatttccaaattatcacaaaatttattttttttatcttatttagtgaaaaataaattcagagtcatgctagaatatgttaaacatcaggtcagtatatttaaaggtcaatatggtatgataattgccccttcaaaaaataattattcaagtcaggttagaaataattgttgtgcatttattttccagttttcctattacaaatttacttttactgtaagtgatacaattttatcgtaagtaaaattgtattgttttactgtaagtaaaaggtacatttacttttattgtaagtgatattatatgtctgttaattcagtaggctttattggttttactgataaactacacaaggtggagggagaacaagatacactttagttataaacatacaatgtaaaatatttttggactagataactatatgaagcatacaatttttaaattaagaactcaaatccatcacattgtttctagttgtgctagaaaaagtgaaatcttaaaaagtgaaatctttagtgacttcctaatggtattccttaaaatatgatgggacagtgagaatgattcggtccaggaagaaggagtgagataagaaattctaaattgcagttggagtgccacgagtaagctaagcccttccatttcagcacagcagatttcatatctctcccatctctcagcatcacagagtcttagaactagaaggaccccagataatacctgaacctcccattgctgatgcatagatgacctcaacaacatgttaagcgtgtagtcatctacttttctaaaaacctgtggcaaagtcactcacctcttgcaatctcagagaagcctttttaaattttaaaaattatattaatgagatgacaatgcaaacttctctgtagtttctcttcataatacaaaaatgtacaaatgtagactacataagattaccaaaacttcactcctaacatgtagattatgaagattaccaaaatcccatgcctaagatattttcactatttacatacacctacatatttttttccccaaaagtagtgttgtatatgttctccaactggcaattttcactaactgtattctgaagaaaatctttcattttcattagaactagctaattccattgtgtaactgtacaacataaactgtataaatatatttttctttaatcatttatttgggggtgagattttggttgttgccaaattttcactatggacaattatgcaaaattcctcatacgtatatatttttttgtccagggtgttaagtcttctgtggcataggtttctggaagtaaaataattgtgtaaaacaatgtgttcttaaaaaaaataatagatatagatactctgccttcaaaaatgtattgactgtataactcatggtatatataaaaaggcttcaaaatcttcactctgattcttccaaagtcattaagatttttaatatatcaagtgaatgtgttaaaagctttgttaaatacagccagacatggtggtgtgcacctgtagtcccagctacttgggaggcttaggcgagagaatcacttgaggctgggagactgagtctgcaatgagccatgatcacatcactgcattccagtcaaaaaaagcaaacaaacaaaaacaaaacaaaaaaacctgctgctctcattttttttctcattttgctagttatatctatttacactgaagaataaagacaaaatagaatattttgatagcagcctctagttcctttatactcagccaataagagagctcctttaataatctgaatagagaactgtaatccatctttatttttcagctttgcatctaactttgttcttgtcttaccctatctactcttgatcatcagctattcttatttccagagttttttgtttacttttaaattaagtcttcatatttgcttgtgtaattatttaatgctaggtcttcaaataatgaattttaaaggactgggtgaaggtaatatctcctttgataaattaggtaaaatttaggatctgaccatgaatcttctctgtatctccactctcaacactcttgatctgcaaaatcccttcagggaccagtgctctctccatactagagtgataaccttatggcaggtggagttctttcctattgtgagtgtaaacttgactcttcactgctccttaatttcatgccatgccatacagcaacagagattcctcttcagcagtttagccatcttccattctgtagatgaggcatttgtttttcatttgaagtgaaagaagttcagctatgtccctttggtttcagaattacatttaaataaaaatataaatcacatttttcctgcacaaaacatttttgttaatgctaaaatatatcaaattgccaaaataatgttttacacaaaaggtttgtcaaagacacacaatatgtgcgctgtatttcttaccaaatgcccactctttaagctaaggcttgtattgtcatgcttcaaatagaaatgcaaaaaaaaaaaaaaaaaaaaaaaaacaaactcaaataaaatgcttttaatctaaggaacatgcagataacgtttttttttttccaaagcagacatatctgcatttctttggttgttggttattaatatttcattaattttcaagctactgcaaattccccttgagatatcattaataaaataccattcaaatcagcaagattatagtcaaaatagccaaactacagaggccatttaattacctagaaaatttaagagtgctgagcacttgctttaatttaaagaactgaataatccgatgctttgatgattacaaagagtctttagctttccctgttttgttggtaattttaattatttctcatactttccccacttagatgcattcctttatttgcccttttagaataataatgagcaaattttgaagaagaagaaacaagtacccaaatacagtcatgaactacacaatgtaatttcagtcaatgacagactgcacatatgatggtggtctcataagattttaatggatctgaaaaatgtttagtgtctagtgatgtcatagctgtagcaatgttgcagcacaattattatatttttaaaataagtttagtgtagcctaagtgcagtgtttataaagtatacagtagtgcaatgtcacaggccttcacattgactcatcatttactcattttcttatccagaacaaccaccagtccagcaaactccattcatggaaggtgtcctacacaagtgtagcatttttaatattttataccatattttctactgtaccttttctatgttcagatacacacatacattttgttacaattgcttacagtattcagtatggtagcatgctgcactggtttgtagtaacaggctagaccatatagcccagacgtgtaggaggctataccatttagatttgtgtaaatacactctatgatgttcacaggataatgaaatcacataacaacacattccccagaacatgtcctcaccattaagcaacacatgactgtacttctgaaataaattttaaaatagacaaatacacaggcactcagcagtcataagaaggctttctctcttcacttacttcagtgacacattcaatttttgatcaagaaaagtagtcaaaaaattaatagcatcacattttgccaaaatattgtatacacttagagaataccaattttgctgattctgagtgtttccttgcacacgtcagtaggtattttggatttatgtgtcaaagagactcttaattttactctaactctatctcacaaatggttatgcacctgatcacaccacatccacttaaagaatggcaagacagaggaaggagaagaattacactttcaccattatgcgatgtgtattcatactggagccttgtttatttcaaaattttaccagattatatagagcaattaaagtttattctttttagttaatattaatagatacttttccctcatgaatgtgttgttttctggataaatcatagagactgtgtgttcggtgagaaaaaccagttataaaagggtatatgtaatgattggattcatgtgaagttcaagaacacataaaatgtgtttatgtggatagaaattaaatactattaataatttctggctattgaggggacaggtattgactggtaagaggcatgagggaatcttctgcaggcaacgggaatactttgaatgtttaaatgtatatacatatataaaaattaagctttacactgaagatcgatccactttccttcatataaattgtaatcagtttttaaaatgtttttttatcatgccaaaacaaatattttaaaaacctaaatattaaacagtattaaatgaaaaaattaacaaagttttatatctattttcttctttctggtttcattgttcccgttcaaatactgctattccacatcttaactactgaaaagcctactgaggcaaaggctcataacttgttctttcttccttaattacggaacctctcctttctatatgcattagcctttctttagctaaatgtagtcataagtgaatgattttggacaataagacgtaagtggaggcagtgtgtacaactcttaggacgagtacatttaagaaaaggtatatgtattttatcccttcttgcttcttgtcagctggcattatgacgtggtggctgaagctcgagtagccttattggactatggcagaatttatgtgctgaggttggatgagcaattagacagaactgtggggtcataacattcaggaagccagatcagctctgaactcactacctccagattatgctttttttacttgagaaagaaatatatttttatttaagccacagttaatgtattgcctgttttgccattaatagctgagcctaatataaattgatttactttatataaacactgtttttctatcaactctttctcactataatctattattcaagcatactttcggggtttttctgagaacgtatctgattatgccgccttcctctttaaaatgtctttttttttttccatttcagggatattgctattagtccagacattaaaatatgtttgctactatacagtcatgttacaaaattgaaaaatctgattctgcatttttaaatgaaaacaatttgtataggaaataaatacctgaatatactcaccaaaatgtaactacttattattttgggtttaagaaataatagataatatttttatttacattgtatgtcttcaaatttactaaatttatgtcggtaacaatgcatcaggccaggcgaggtggttcatgcctgtaatcccagcactttgggaggccgaggcgggcgggtcacctgaggtcaggtgtttgagaccagcctggccaacatggcaaaacctcgtctctactaaaaatccaaaaattagcgtggcatggtggtgggtgcctgtaatcccagctattcaggaggctgaggaagcagaatatcttgaacccaggaggcagaggttgcagtgagcctagatcacgccactgccctccggcctgaggaacagagcgagacgccatctcaaaacaaacaaacaaacaacaacaaaaaacaatgtatcaccgtagaaattaaaacaactttttctaaacaaattaaaatcttccatcgaaatttatcttataatttaaaacagttctcattagagtcaggaatcagtaaaaaagttgccactctcattataaccattttccattgtcctttaggcctaaacaactaaagaaaaaaaatttaaataacaaaataactttttgaaagaaagagataactttgtcattagttgtggatgatatattgatattatggaaaatacaatagtattcattgaaaaagtaataaaaggtatttgattttagcatagtgatgaatttcataaaaatatgctgaaagcaaaagcattcttttatcacatcaaaagtctaattgttaaaattccattaataatacatgtaggtatttacagttttcaggataaatatcaaaataatcaagaaataatgaatattttaaacatggcatggagaaaattagttatccactttaggaaaaaaaattaagacaaattaagttttgtttttttttttttccttgagatggagtttccctcttgttgcccagactggagtgcagtggcgcaatctcagctcactgcaacctccgcctcctgggttcaagtgattctcctgcctcagcctcccgagtagctggcattacaggcaaattaaaattttaagtagaaaaaaacaaaaaacaaaaattgcattagagaaaaacacaggataattctataatttttgactagagaaagtcttttaaaattagcacaaatgataataacaagaaagactaacattcactgagttcttaacagatactctcctaggtgcttttacatgtgttgatttatgtgtgtcctctaaccctctaggagaaaggagctaatacatgaaaggcacacagacattaagtcatggttggtaaatgctggggctatcttaacccaagctatctggttgaagatgctgcattcttatctacattcttttcccctagaattcacacagaaaatcctagacaaaaatgactacttaatatcacaaatgtctgcataaaaaaaaaagacaacataaaacaggttagtgaaaacctgtttttcccaaatctagaaaaacatatttgcaacattaatgatagctaagagattaataagattatgagctcataattccataaggaaaattgatgaataccatatagaataacaggcaaaatatataaatagggagttcccattgaaagcaatgaacattaccaaataaaatgatgtttaacctcattgataatcaaatacaaatttaaataaatatatcctatgtcttcatctattacactagcaaatgtcaaaatggttgttattgccagtttggccagggtgtggcaacacaggcactctcatgtactatgttaggaggataaattaacaaaactttttgaaagataatataggatctgtacccaagattaatgtgtatgaatctttcttggtgagactgcccttttaagatttagcctaattaaataaaagggaaaatgtagctgacaatggaacagtgtagtagtcatacttataatagtaaaaaactagaagctagttaaatgtacatcagagagtttggttaagtgtattatagcacatttacacaaagaaatatcaatcatacaaaaggggagcatatgatattataagttccaatatgtgaagataatcttggataattggaaagagatatattctaggaagagaacaaaacatgcactgttttgggtaagagaatgaagtctgcattccagaagtatgaaagttatatatttaaactcaatatattattaatatatattaacaaaaataaatatataaataaagcataattattatttaacatatagtctcataagtactaatatgtgaaaataattttcacatattattgaaaactatatgctatatactccttggtatgtcctcatattttctgaaatacaaacttccttctcttacccaagacagtgttttgttttcttctgtctctagaatgtacctctttccaattctacctatcaaacattctttaacagtaggttttgctcaaaatgctacttacactacaaaatccttgtcttacgctagatcttctgtttttccattcattaaaaatatctattagggaatttaccactatgtggtacgcattatagtaatgtgtgtatatatcttccatctctgggaacctccaaatatttcaatgacagtgtctcctctatatttttatcctcctattatgtctatccctcatgcgcatacacagtagatgcctaataaatgttcacaccaaattgtttacttgactatacataaggggtcttcaaaaagtttgtgaaaaatgtgtatcatgaaaaaaactatgcacagatttcaaaaaacatttgcaccaaaataaacccatactaacatgttataacatgtctgaacaggatctagtctgaggccctaggaaccattaagacatccatttgaaaacagcctgtatcagagcaacatgaatcttgctaaaattgaagcaaaaatacacctcaaatttacggtgaaatcattgatgctttacaaaaagttcatggggaaaatgtcccaaagaaatgaacagtttacaaatgaatgttaagaatggacaagataatattgaagatgaaacctgcagtggcagaccaaccacatcaattttcaaggaaaatattcatcttgtttgtgccctaattgaagaggaccaacaatttaatggcacaagtaatatccaatgccacagacatctcaattagtggagcttactcagttttgactggaaaattaaagttaagcaaactttccactcaatgggtgccaagaccatggcactcagatcagctgcacacaagaccagagctttccatggaaattttaaacaaataggaccaagagcctaaagaatgtcttcgaagcattttaaaaagaagtgaaacatggcattaccgttacaatcctaaaaacaaagcacataaaagcaatggctaccaagaagtagaagtggaagtggtctcggccaaagcaaaagcagactggtcaagagcaaaggtcatggtgatacaggcggtagaaataaattatttaggcagatagtgagggcaaaagagtcatcggcagtttcccttttaacaaaaagcagtccaagaaattatttttttgctaacaaagagcagcctgaaatactgagccgcaaacatcgataagcaagcttgaagcttgcacgggggaatgctggcagctgcgccaatagagaaggactacctgagggccaggtatgtctgccatggaagctccatcttccctttttttgttagcacatgtatgacaagaaagaaatgggcaacatggagcagctcagtcagagaacctgcctgcataataaaagattggggtgggggtcgggggggctgagatttgtgccccatgcaaatgacgcaactggtctaaccagtttttcggaccctatgtagatcagataccgcccctccactagctcatctataaaacctcttgcatttcaccacgaaatcagcaactcatttttctgggacccctctctgtagcagagagctattctccttcttttgtctattaaacttccactgttaagctcactctttgtgtgtctgcgcccttgatatttgtagccatgagacaacgaaccttggatattatcccagacaacgaagcagcttcagtggcagtctttttggggggatgctcaaggcattttatttctcgactttctggaggaccaaagaaagataacatcggcttactattagagtgtttctgagaaagttaaccaaatctttagcagaaaaatatccagaaaaccttcacgggaaagtccttctgcaccacaacaacacccctgctcattccctttatcaaacaaggacaattttctgaaagttatgatgggaaatcattaggcatctagcttacaatcctgattcagctccttctcatttttacttgtttcctaatcttaaaaaaaataataaaaaaataagagtagtcattattctccagttaataatgtgaaagagactgcattgacatggttaagttcccaggaccctcggttctttagggctggactaaatggctggtatcattgtttataaatgtgtcttggatttgatggagcttatgctgagaatgaaagtttacattttttatttttatcttttaaatcaattttctgatgaacttttaaaagtcccctcatatatagagatagctcaatagataaatataataaatataaatatgactgcttgtcaattactaaaatatggtttctctatagtgaggtttgttctcatttctttgcaaaaatagataataaaattattcacataaaaacacgagaggcacagcaatgttctgaatatttaaattattttgaaataaatgataccttaatgctaacacagcaatattatcatcttactaaaaatgtatcattattaaaattttgtcaagctaataaggttgagaatctgaagttcttaaaattgtttaagtatagccacctggctccaggtcaggcttataattgctacactgtggtaccagttctaacaattgaagagactgacagaagacttggaatcaacatcaagttaatcttcatgtaatttatcttcacttcactcaatccatatctattacctatctccttgtatctgtgttgggttctaatatctactgatcagacactttctaccttctccctttactgggtatatacccaaaggatgataaatcatgctgctataaagacacatgcacacgtatgtttattgtggcattattcacaatagcaaagaccaactcagatgtccaacaatgatagaccagattaagaaaatgtggcacatatataccatggaatactatgcagccataaaaaatgctgagttaatgtcctttgtagggacatggatgaagctggaaaccatcattctcagcaaactatcgcaaggacaaaaaaccaaacaccgcgtgttctcactcctaggtgggaactgaacaatgagaacacatagacacaggaaggggaacatcacacaccgggccctgttgtggggtgggtggagcggggagggatagcattaggagatatacctaatgtaaatgacaagttaatgggtgcagcacaccaacatggcacatgtatacatatgtaacaaacctgcacgttgtgcacatgtaccctaaaacttaaagtataataaaaaataataataataaaaataaaattaaaacaaaatacattactcttggccagtcacggtggctcacacctgtaatcccagcactttgggaggccgaggcgtgaagattgcttgaggtcaggagttctagaccagcctggccaacacggttggtgaaagaaaccctgtctccactaaaaatacaaaaattatcctggcgttgtcgtgggcacctataatcccaggtacttgggaggcagaggctgaggcaagagaatcgcttgaacccaggaggtggaggttgtagtgaggcaagttcgtgccactgcactccagcctgggcgatagagcaagactcagtctcgaaaataaaaaataaaataaaatacgttactctttgaaaagttggaagattttgagaaataatttctttgtgccttgtatgcattatagaaaaactcaatggtgataattcagcctatttacataattctatccatgagggactgactcactccccggtgaggccactaattcaaattttatataatatgaaatagagaaaattacttctctattggaactaaaatatgtcttcttataaatgaacctaagttctggcttctgaaacagtacaatataaacataattgctccatgttagagactagcctattctaagtttctcagatccattttgctctattacgtttaaacacctgcatctaatagcaacacactctggatacatgattcctgttaccttcctgtttatctcttctgttttcattcttcttgtttcagcttatttctaagaccttaatccagttattttttcctactcaccaattcctcttctttctctagttttaatattgaaatagctaccctggactctgaaacatggcacgtctagttgtctctccaacatccagttctcctaccaaactttcctgaaaccctgactatgaaaatgtaccacggaaacggcagaaaagtaatgtcttacttttatttttccctctatcatcatatatgaattccctaggttttgttcttttgttcaagctaagttcctgaaccctaaatccacactgtcaacacagagccttctcctaaagggccatcctacccataaggaacccctagatgttaaaacatgtcacctaaccaaaattttctaaaggtgcccatttcccacatgtatcatatttatagcatttcattatcctctgtctgtgacacttgcttgtctagagcatcatctgaggtaacaacccccatctgtccaatttcatcaactcactcttgtgatagatattagcagctaatatctaaacatgttatagtgaagactggaattttccaattgggttaagttgaaaaaattaaccataacattgtatttcacttctttttttggctatgttgagcaaattccaaaaattctaaacataattataataaaattagagtcaacaatagtattactctattctctttttttctgaaaaataaaaatagatatttatgtctggaaacctgaaataaggaaaattgattctactttacaaatatcattgtgggtaatgggttggatatataatttttaaaatgtattgaattatctctaatattttttaaaatgattactgtatgtttggcttttttgttgaattgatatttaaaattaaaactttttcaaaggtaataaggccataaacatctcttcaatttcaatatggccataatcttccaaggaagccctaccacaaattataatttgttatgacaagtgtataaaaaatgaaactcatgttttataatagagagaggccaaaaggttaacatttcttctcctaggcctgaaagaaagtcaataaatgaatctctaaagctttacccagaaaagctggatctatagtgatagtaaagaaaatatattttgaaattgtaacctattaaagaaagaataaagaaaaagaataatggaagatctgtagagaaaatagagaaacaactgctataatttttttttttcttttttaagacaggctctcactctgtcacccaggctggagtatactggcatgatctcggctcactgcaacctcaatctcctgggttcaagcaattctcctatctcagcctgctgagtaactgggattagagtcacccactaccaccacaaccagctaattttctgtacttttagtagagacgcggtttcaccaggttgtccaggctggtcttgaactactgacctcaggtaatctgcccgccttggcctcccaaatgctgagattacagatgtgagccaccgtgcctggccgatttttttaatctaaaatgcatttcatcatcttctatcacccttattaagggaagcaatatcagtttaagaatgtttcttaatgaaattagtctttaagtttcatgttggtactttactatatgaaatataactctcagtatttagagaaagttaaaatcatagaccaagttatatgctagttgaaagaatctaacaatgtggagaattaaattctgttaataaattttctatacgtcaaatatttttaccaattcaaattatataaagcatagagagaaagaggtaaaaaaatgcttcaaattttattgcaaagagcaataagttctttttagatgatatcttcttgggcatatacagtttctgttttctctgtcttagatacactcatcacaggtatctgctgagttctctaacttgctttttattcagatcttaattcacattattaacctttagtcagattttccctgaccatcctatttaaaattgcaaactccatccaaccattaactaatcccctgttgacatttttcatagcttttatgcctatcttcccactaaagtgttccagaagaacataaatttggttcacttctgtttactactgtattctcatcagcaagaataatgcatggtacatggaaggcactcaaaaaatattcattgaaataaaaatgaaagaaggataaaacttaaaaaagtacttatatgtgaattctataatttctaactaaaaatttaagaatttcaggataaaaataaacatgtgcccactgactatataaagaggccaaaagaaatataaaacatatgggaaaagaaatagaggtcataaaaacaggaacgaaaatagaaggtatcttacaagtttcacatggcatcttggggacggctatgctgtaattatattttcttaggggcatgtaaacaaatgaaagaaatgccattaatcgtaaattgaagaggtctaaacttagcctgtactctttcttctcttatttccatgtcatctacacatgcagactgtcctattacttgtatgggctcaacatgctgccagtacctaaccttaagcctgctcaactcctgcacattgaaggcagttaaacttgtcactgactttagaactgatacacttgatgtgaggattcacagtgggttctctgaaagaatttcttcacttgttccttatcatttccaattccagtaccacttctctgcaccttcaaacttaaaagcaaatgtgggaggaaaagcattaagtcttcaactcattttttggactttttttcttattgtaactttccacattacttaattggctctggtaatatatgccaactctcattgttttattcagccctgtaataggtccactcccccaaatcaggctcctgtaccagttagaaatataccgcaatgaaaatgaagagctaatatgaaacatcctgaattagaattagtgaacagagttgaaagataacagaggattacacacacacacacacacacacacacaggtgagagaaacaacaggaaaaaaaaaacaagtagtgattagttaatgactcattttaaccctaaattctacattgaataattgtattttacatctgttagaatcaagatttcacacagttaacccagtccatggtgttcagtgcctaataatagctctaaaatgccatcctgatcatttcattcacctcctcaaaaattcaactagatcctaattacctcaagacaaaagttgtgtcatttatagttctctgtgatatcacatcactctaattcaccttttcaattatttttcctaatattactttctaaacaaatatacctaattatgtttcttcaagtgcctaatgcttttctccccaggttgttcatattcaggaacccagtaacttcataatattcctccagtgttgtttttctgtttaatcatgttattatcacacaaatttattgatcctgcaaagctatctacttgtagtacctaaacatacttaatatgtttattgtcggtctgcctctcctagaacataatatccaagagggtatggatttgaatctgttttgtttattaatatgcttcaaccacctggcacattattgctgaataaatgattttcaaatatcttctactttccaaatgaccctgaatcaattgtttcctctccattcccagtgtgtctgccttaaattaggctctcattaacattttcatagaccattataaccatcatataaataaattccattcctaatattcccccaggccaatgcatccttacattagcaatatcttctgaaatacaaatctgatcaggactttttccttttttgctaagaagctttattttatagtcttacatgaggctactttttcagtttcttctactgccactctaacaatgaaaacacttttctttgggctactctaccaaggaaaatgaacctttttatatttattagcatagaacacaggcttctgagatttcataaggaagaaaacaagctcatgattagtgaaaatatggtacattagcataaagctatttcaagcaatgactttaaacattatacttatcaaccattggataaacacattacatttccacttatgattatatatttcacaagaatgtatgtgtgtacacacacatatattcacaatggcataatatttgtcattattacatataatcaattttatttttgtttttattctattgtgtttcacttatgcaggtaaatattcatttcacgacaggggaggagccaagatggctgaataggaacagctccggtctacagctcccagcgtgagcgacgcagaagacgggtgatttctgcatttccatctgaggtaccgggtttctctcactagggagtgccagacagtgggcgcaggccagtgggtgcgcgcaccgtgcgcgagccgaagcagggcgaggcattgcctcacctgggaagcgcgaggggtcagggagttccctttccgagtcaaagaaaggggtgacggacgcacctggaaaatcgggtcactcccacccgaatattgcgcttttcagaccggcttaaaaaacggcgaaccatgagattatatcccacacctggctcggagggtcctacgcccacggagtctcactgattgctagcacagcagtctgagatcaaactgcaaggcagcagcgaggctgggggaggggcgcccgccattgcccaggcttgcttaggtaaacaaagcagccaggaagctcgaactgggtagagcccaccacagctcaagaaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacccgcagactgcctcctcaagtgggtccctgacccctgacccccgagcagcctaactgggaggcaccccccagccggggcacactgacacctcacacggcagggtattccaacagacctgcagctgagggtcctctctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaatgcagagcgcctctcctcctccaaaggaacgcagctcctcaccagcaacggaacaaggaacaaagctggatggagaatgactttgacgagctgagagaagaaggcttcagacgatcaaattactccgagctacgggaggacattcaaaccaaaggcaaagaagttgaaaactttgaaaaaaatttagaagaatgtataactagaataaccaatacagagaagtgcttaaagcagctgatggagctgaaaaccaaggctcgagaactacgtgaagaatgcagaagcctcaggagccgatgcgatcaactggaagaaagggtatcagcaatgtaggtgaaatgaatgaaatgaagcgagaagggaaggttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatacttcacagacaagcaaatgctgagagattttgtcaccactaggcctgccctaaaagagctcctgaaggaagcgctaaacatggaaaggaacaactggtaccagccgctgcaaaatcatgccaaaatgtacagaccatcgagactaggaagaacctgcatcaactaatgagcaaaatcaccagctaacatcataatgactggatcaaattcacacataacaatattaactttaaatgtaaatggactaaattctccaattaaaagacacagactggcaaattggataaagagtcaagacccatcagtgtgctgtattcaggaaacccatctcacgtgcagagacacacataggctcaaaataaaaggatggaggaagatctaccaagcaaatgggaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactatcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaaaccgctcaactacgtggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcagggaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccactagcaagactaataaagaaaaaaagagagaagaatcaaatagacacaataaaaaatgataaacgggatatcaccaccgatcccacagaaatacaaactaccatcagagaatactacaaacacctctacacaaataaactagaaaatctagaagaaatggataaattcctcaacacatacactctcccaagactaaaccaggaagaagttgaatctctgaatagaccaataacaggagctgaaattgtggcaataatcgatagtttaccaaccaaaaagagtccaggaccagatggattcacagctgacttctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgataaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactccaattcaacatagtgttggaagttctggccagggcaattaggcaggagaaggaaataaagggtattcaaaattaggaaaagaggaagtcaaattgtccctgtttgcagatgacgtgattgtatatctagaaaaccccattgtttcagcccaaaatctccttaagctgataagcaacttcagcaaagtctcaggatacaaaatcaatgtacaaaattcacaagcattcttatacaccaacaacagacaaacagagagccaaatcatgagtgaactcccattcacaattgcttcaaagaaaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccataaagctaccaagactttcctcacagaattggaaaaaactactttaaagttcatatggaaccaaaaaagagcccgcatcgccaagtcaatcctaagccaaaagaacaaagctggaggcatcacattacctgacttcaaactatactacaaggctacagtaaccaaaacagcatggtactggtactaaaacagagatatagatcaatggaacagaacagagccctcagaaataacaccgcatatctacaactatctgatctttgacaaacctgagaaaaacaagcaagggggaaaggattccctatttaataaatggtgctgggaaaactggctagccatatgtagaaagctgaaactggatcccttccttacactttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagcctaaattgacaaatgggatctaattaaactaaagagcttctgcacagcaaaagaagctaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaagaaacacatgaaaaaatgctcatcatcactggccatcagagaaatgcaaatcaaaaccacaatgagataacatctcacaccagttagaatggcaatcattaaaaagtcaggaaacaacaggtgctggagaggatgtggagaaataggaacactttgacactgttggtgggactgtaaactagttcaaccattgtggaagtcagtgtggcgattcctcagggatatagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcgtgtcctttgtagggacatggatgaaattggaaatcatcattctcagtaaactatcacaagaacaaaaaaccaaacacggcatattctcactcatagttgggaattgaacaatgagatcacatggacacaggaaggggaatatcacactctggggactgtggtggggtggggggaggggtgagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaattcatttcactaaactcatttcacaaatcactaatgagctgtcatgcacagtttgaaaaaatacgctaatagagtttgagtcttttggcatgactgaattataggatagggtgctgattgtcttattcaatgacaccaaactgttggtgattctgtggcagtcatagaaagctgaagtagtctatgtaatattaagagtgtaaatggtgctttaattttcaaaaaggaaggggaaaaggtgtatttgataaactacattacagggtaacgatctaagatggataatttaaggaatcatttgtgaacattgaggatgaagtagtaatcactaatatctaacatgatttatgttaaaattagtcaaatcaaattaacctcagttaatttgttgctaagcaagtaaatcaagactatgtagtacaattttgaaaggcataaggaaataaaatgctctcttattcctatgatagagataatgtggtatagtcattaaccctagttcccttttctgctagacatgcaactagacaaaatttctgtctcccttgcagttaggtgggaccatatgactatgttctatccaaatgaatgtgaactggaaatgatgtacactgctctcaaactcctttcttaggtaacctaggatccctctcaccttatgacaacacttagcaatggtccccttatcttttttgttgttgttgtgacagggtctctctccgtcacccaggcgggagagccagtggtacaatcatggctcacttcaatctcgaactcctgggctaaagtgatccttcagactcagcttcccaagtagctggtactacaggtgcataccactgtgtctggctaatttttaagtttttgaagagatggggttctcactttttttccttcagctggtctagaattcctggcctcaagccatcgtcccacctcagcctcccaaaatgcttggattacaggcaacagccaccatgcccagcctcctttatttcttgtattatcaattgctccccctctatggactctttagacaacagcatacaggtaaaatgtaacatctccctcattaatatatccagttctttaaccttacatacatctccaaatttttctctgtttctctgctcctttacaggaaaattccattatagaactgtctatacacactgttaacccttctgatccttcaattgtccctgaaatctatcgtaatctggcactttactcttgccataaaacagctcttgttagggtcacaaatgacattgacattgctgagtccataggatttttcttttttccagtgtcgtcatctctgatttctcatgaacagttgttcagtcttcactgcactggcttcgttccagtttcttggtctccttgttcccaggtctctagtcattcctttggtctcccttagtgttcccacctctcttccctactgttggtaggccccaaggtcagtcactggatccttcgtcttctctacctatacttcctacccaggtgttttcaccaagtttcatgcctttaaatacccagtgcacacagttgacaaaatatgtctagcccagacctttcactggaacattagacctatacattaaactgcttcctgaataattttgttagtctaaaagtcaccttaaatttaacaagtccaaaattaaactcctgattctctctctgaatcacagcttctgtaatcttttctatttggttattggcatttcatctctatttgttatttattcttctaggtgtaagcaaaacaacttggaatcatcattgactaacctctttcttccacattcatacttagtccatcatcagtaaatcttttccctgtaaagtagagcccaaattcaacaactttcaaagaaatttctactgctgtcatcctggtccaagatgtcctcctctctgatttttttattactatagtaggtttctaatggatttctttatttctaccttttcttcccaggagtctgtcatctccacagcagcataaaataatcttttttgcatttgtagtcttgagaaggttggtatcataacaatatgcaaaatgatccttttaaaatttgattgtcatttttaaaatgacaaatcatatcactttctgaatttcatataaatgtcattcaattaactttcaaaaatatgaaaaagactgtttaacatgccacattaggtcaaaagagctatgggttgagctgtttaaaattattttgaaaagctattttttaacatgaatgaacatgccactagtatttgttacaatttcatcattatttccaatcctatttatttggtcttgttaacaagagaatacttagtcaaatttttggctcggtcaaatctcttaatcttctagaatacaactttggggaagtgaatattaaattaaaaataatggcattcatcagcaatttatcattacatgccctgtaattattattaatattatacaaattattatataagtatagaatatattctatattataaaaacactatgtttaaagctcttatattatgaaaaatataagattgcactaataaaaatctaaagaaaaatatcataaaaatttttgaagtctgctttactatagtcttacatacatacacccacgcatgcaactgttttcatcaaaatggacatgaattcatgaaagtgtgctcttatttatctcatgtgaaagtactgtaaaaatgaatttcctagcttctgccagaagtttacagatacttagctgggtggaaataccaataaattaagcaatagtgttttacctttataatgatgcatatgaagggctcttttcatcttcctgtaagatcacaaagtataatttgcaaaaaaaaaaaaaaaatctgcctgacatatcctttgcaaatagaaaagtcaaaattgggaacatgaaagcagacgtgcaaaattagattcatatacccactttgtttcctgtgctggagcctctgaattagacccagcaggccttccctccttgaccctgcctcaaccaggaaaaaaataatgtgcagaatcttcctttggtggtctgacccaacccttcttaaagataccttttatctactttttttgttctttttttaaatggggaagattctgtttgcttttaattaattgttttgttttgttttttgcttttgtttttagacagggtgtcattctgtcacctaggctggagtgcagtggcataatcatagctgactgtaacctcaaactcctggcctcaagggatcttcccttctcagcctcccatctcagcctctcaagtagctgggactacaggcacacacaacagtgcccggttaatatttaaatttttttttaattatagagaaggggtctcactttgttgtttacactggtcttgaactcctgagttcaagggatcctcctgtcttggccttccacagtgctggggttacaagtatgagccatttcacccaggctgatttttttttctaataagcataataaactttgaaatgaatagatcatatcaacacattttaagagttagtcagtagctttcgaaagcctaaaaaagatattataatatttatttttattttccattagactaaatatgcctattttaaatgtgatactgccaattctctcttacaccaaatcttctagaggaaagtttttatctaagatagtttaatcattttgataaaacacagcacaaagagaatgcctaatgattgaattaaacatgttatttcattgatatttcttttatatttaatttgtgcctttagccataagaattaggaagttacctggagttcatttccacaaatgatattacagaggcataatagattttcttcaagtgtctatacattatgaatgtaaggttactatgtatctgacaaaagtaatttgtatagaagtaattctaaaaactatttgacgtctattcaaaaaccattttctgcacttaaagtgaaatgactgtagaaatttgctaacctttcatgacacagtgacttaaaaatccattaaatgtttttaaaaaatgcactgcttgactcttttgtaattctaagagcaaacagctatctgacattttcaggatcattaaattaaaaaatgataaggaaggaaaatcattaactaatttatatttctcttctaatgggaatagaattagtaattacttttgctgttgaaacctcctgtagtcagtcacttgtgtcccagtagcatgcctatcattcaaagtatgggacctacagaccttaagttacaaaagttcacagctgtatttatagaccagtattaaaacaagtggcatggaatcttcacactcaatcgtccaaactaccattctcaaatttccttctcctatgttgcacttactggttttctttttatagacttcaataatgttttgcccagtaccttacctattataacaataaatattttctaaattaacacatgagtcaatttgggcatttgaaaagaagagaagcaagacaaaaactcagatgttcaagactttcattcaacaaccgtgggattcttggaagttataataatcagccattacaactcaaagttttatctaatttataggaaaacttatgagcactcaaggaattaattccttcacatttcatctgatgtacttgttgaaatgactatagaattcatggtttaaaatgaagctatcttcatttcctctatctattttctctacggcattagtaaactaactgccatatgaaagtcacatttattttatttcagttctaaaatcatattttaaattcgggcaattcatctaccagtaacattttatatgacattatattttttctaataaaagttgaattgaagagcaagttaacagactgttacccctaaacagaaattacgaaaccaatcacaaagtaatttattaaatttttaaagtaatactttcttgtcaagcagacctgtaaaattagacagtactgttttatagtacttacatttgataaaaagtttgttcatgtctctagtgatatgttattgtgatttacaggttatagaataaattttcaagaggggccaagactagcattctagtttgcccatataattccttaatagaaaaagtaatggttctggtaacctgagcttgccactaatcatcacttatttttcttaatgatagattgctacttccctaagcatagtaatttgatatgttgaaagtggttactgttaagtttaatatattaatttgtcttgactggcagctaataaaatgctatattattgatgaaaaattaatatctaaaattggaataaacggaaaggcaaacttaaccaaacttataaactcagtattgtacttttaagtaagtttcttgagcacccctcctgttaaaactagagtgcagttttaatgccactcttccatcagtagacaaggtgtcttatgccaattcccacagaaggggctgctctgcacacagtaacccgaggcctcaactttccatcacaggcagtatgccaaatataaatacccaggagtgtcctgaactttaaagtgattcctaaatacgaggctcatttacgaagaacttcaaaaacattaagcggctcttgcattctcaattagaaattctcctcatactaacagggacttctgagcgtatcaacacagagaaagcagttgttcccatgtcttaaaatagcacagattgaacatttaacctttctgctgcccagtcagagtctaattactattttatgtttaaacacacacacacacacacacacacacaccattttgccttcctcataatagactagaacatagatgaaagtaaaacaaactcattgctctttaaaagtacaaacctagaaaaaaaaaggttcctgtttgcaggaatttgaaagaatgatgtcaaaccagtcaaactcaatttttctattgaaaagcgggtccttcaaagtaactctattttaagtaattacgctttagtaaagagtttgctgacttttttgattattcattatgagagataattttattttcaaatcctagtgttatatttagcaagttactaaggctctatacaggacatggactcaaggcacttagaataaatgtctccccaagacttgtcacatgtccactgtttataagtaacccagtttatttactagatactggcaatgcctcctttcagaaatgtaaacactcaattactgaattttaatcagaaggattattctacatagagtggcattttctattttcctgagcaatatttcccaggctatcatctcctctatttcaatatcatatattaggattcaagaccatcatatttaccccttccactatgaatggagtgaggcaaaacatgtttattaaaaatcagttaaatagctcagcttgattttacaaatattatatactataaaatgttttctattttgaaagaaatttgtatgttatttttctttcatttggacatgtaaataaatgatgatggtgaatgagagcataggcttctctcaaagagtggtaggatcatgttcttgatgccaaaaacccagaggatatgtcttaggtctgtttttgtgagccctgtaaccttgaataagtcacttagctattttgaaattcattttcttcacctgtaatggcatttgctctctttttaaatagaaattacattcaataaatgagcattttaatgtgatagatttaaaaaactgtctggtaagtagatgcatcagctccttctggaagcatgacaggtgcatggtgttacactgtgtgtgggcgctgatcctggcaggaatagtcagtgacctgctgtcagagcccacggagataacctgaaggagcgctccaaatgtccttctgcaagcattacccacctggggaaatttctcatccaatgactaccgaagggtaactctgccataactctgcttttcactgtggccacctcaccacttgcacatgtttatcccatctcaagatgttatctgtggtgtttttcaacatcatcatctcagagattaaggcatcgcatataacgggagtgtttattactatgcatacatctggcatgttaggacttgtcaaggaaaattgacagcctaatagcttttttcctatatttatcatccttgatattaaaactccagttaaaaatggcacttgatgaataaagaatgctgcacccatgagcattatttgtagagtcaaaaaaaatttgcttttacataaacattaatgtacttaatttacaatgtttttaaaaaattgcaactccttagacatggtgtgtaggtatagattcttgggtggctgtgttataaattatgtaccacttttatgttctgttatttgtcataatttttcttatgttttgagactcacaaaatagttttttttttagttagaaagctttccaaccttcctaattcatatacatggcaactccctcacttctctccagtgttgctttgctcatttgtatgattggtttaaatatgtgatctcttcattgtactatacatgcttctttgagcagggattaccccttgttctctgtgcctccacaaagactattttgcgaaaaaacaaataaaacaccaatcaatgacatttttattaaattataactaaatagaaaatgtttctaatgaaacggtataacggtattttaaggggagttttttctaacagtaaacacagaaataaaacaacaagcaagcatttttaatatattatagatattaacatctgtaatatataacagtggaaaaatttggttcctatttcacaccaactaatactgtacaaaatagttattggcagctaagaactaaattatagtgaagtgataaaaaataatttaaacacattattttaaactaaacatcttttctatgtatatgtaagagaaaaaagagctattgaaaagaaataaattttctagaatgagttttgattttttccttcttctttccttctgaattctttaaatatctgggcaaataaagtattgagaagcaaatttactggttaataaagtctcaaaattgagtaattttccttctatgtatatttttttcttaaaaattttgttttcatatccttctatatacttatcagactattttgaactataaaaaatcatagattatagagtcagatattttaatcagcattactggtaatgaaatggctagaaattaagagcaacacaaagcaaaaactatatttaaaaacaactcagaaagtaccattttactatttaatatataattacttttctttagaaaactaaaaatcttcactcagtaaaactaattatctctgtaatctcaatctatatgccattgtttcactgaaatatatcacaaattaattatgtcaaactttcttctgcaatgtctcatatatagctcttctattgcattttattctcccctctttcagctgatttaagtaacttaaaataagtctctttccctccacatttgccacaatgtttctttcttcaaatcatcagattgagtggcaaataaatgttattactcagttccaaaagtactgcttgaataggctctcagtaattaaccaatatgtgatgaattgagaagcatgaaaacaaactttgtatttacatcttaattttataatgttaaattaaatatcatattgaatgaagtatattttaatgtcctacagtttaactaaatttgatcagcttgacttaatccctggaaaatgatttttgggtgcaaggcaggcatggaaaagaaacatctaagcaaaatatgaaaatctaaatgaacaagttgcaacagaaatctgactttgaaagaaagaccaattcatgagagtaatatacatgaaattttaaattcaatgtatttctcatgaaattttggttggttttctaaatatccttcatctacttgagtaaacaatttaaattttgcacacatggtttctattgaaatgggtaatcaataaatatgttagtgactgtttttcaaaagagaaacccaacaagaaatgccaatatttaatccctttgtgggcatgaatttaacttgttgcctaaacaatatactgataaaaaaagaggtttgtattaaatgccgatttcactctgtagcattgattacacaattaaaaaagaaaaaaaaaagcacctttacttaaagctcaccttcttggttgcaagaatataccagattaacaagaaaagaaaagaaaagaaacacaactgctgatatatcctagggacatattcttatatatcttatttcattatatcaaacagattttaaattgctagaactcaaaactagctgaaagaacaaaattacaacacatcaaattattagctaaatatagtgctataagaagaatattctgaaaagaagattggctgtttaaagataaaggaacatcagggtcagccgctaatgtcaaaggcaaataaatactgttccaagtattgaagataatatgcactaatagtgggttttagctggattcagtctgatgcaggtgcatgtttagcagctgtgaaagcaacacactaacacacacattcacacataaacatgcacacagagcataatataaaccagctctcttaaaatgtagagaaccgaacactgcaaacaaaaacctcaaaaactaatgaactcatgtacattcttgaacagtagctctctatctccagaagatttttcaatttctaacaatccaagattttaaagcataaatggacccatattcaggctgaaactctaggagaaaaattctttctccaaaatgcttactaatggaactttagcaaattaccttaatatttttgtatctccattttctcattttataaaataccatacagtagaacttatctcaaagccatattactaggatgacatttaaacataatatatgtatataaaacacttagctcacacttagtgctaaataaatattaattattacattattactatcccacagttgattaatagtttcagtgaagaaataaaaagcaaaattataatttattttatcagaaatcttacttgaattcataaaagcatacttgtctactaattttacagttaatcactatatttattttattggtggtcactgaccaacagagaacaattaccttcactcactagtatataattagcatttatggaaagatgggtactattttaggttagacaggaattacgtgtggtaagttttgttgttgttgttgtttatggtcagcattagtaattgaaaagattctcacagatactgtaagaatcactgactcaggcaaatggctcacatagctgagagaatatccaaatcacattcaactttaatatatgttgttctttgtattagtctggcattgctgctgtaaaaaacagcacaaacttaccgcaaatttaatggctttaaacaacacacattcattgccttacaattctggagttcacaagtctgaaatgggtcttgctgggctaaaattaggatgctagcagggttagcagggttctggagggtccggagaacaatctgttcacttgccttttgcagcttctagagactgtctgcatttcttagctcatagtccccttccttccatctccaaagccttctcatgttgccatgactctgttctccccttctgcctctctcttccactattaaggaccctcaggattacactgggaccacccagatgatgcaggataacctttctattttaaggtcagctgattagcaaacaatttcatctgcaactttaattcccttttgccatgtaacctaacacaggttctggggattaggatgtgggtatcttgaggagccattattttgactaccatctacctctcaaatgataattttaaagccactactatgttcaatgcaatttaatgtttggaagtgttttaagtatctgtataaatacataaaaactatatatacctatgacatgaagagcagtaaagtaggaaggatcatatatatatatatatatatatatatatatatatacacacatatatgtgtgtgtatgtgtgtgtatatatgtgtgtgtatgtgtgtgcatgtgtgtgtatatatatatatatatatactattatgtatacaacacataggatgagagaaagtctctttgaaaaggtggcatttggaaaaacacttaaagaaggtgaaaaattgaaacagagtttatgggggacaatttcaagcagagagagcaaaaagttcaaaggcaccaaagaggtagggtgtttgtgcacttgagatgcggccaggaggccaggacagtatggctggaatgcagtgagaaagggagagaggggaaaagattaaagtgtgaagaacaacagaggtagcacacctacagccttgtgagttactcaacccagagagagatacattcgagaagtgtcacaatctgaaaagcagcatatggctgttgtgtacaaaatagactgttggaaggcaaggttggaggtaggaagaccagtttagaagctactctaataatccaggttagaaataaccatgattgtaccatagtggaagcattggatgtgcagagacatgtaggattctgcatatatttaatataaatggagtggcaacatttactgatgaaaataatttgaagtcataaataaaaaaggaaaataattctagacgacctgaagattttgtcatgagcaattgaggaacatagctcacattcacagaaatggaacgaactatagaggaagcatgtttagaagaaaaaatcaagagttccatttttgtacatgttaatattatagatagttatgggatacctgctgtcagagtacgatctaagtttaaaagaagaaagtataaatattgatatctatgatagatagatatcataaatatcttttatcaggttcagggatacatgtgcaggtttgttgtatggataaactcatgtcatggggctttgttgtacagattatttcatcacctaggtactaagcctagtacccaatatttattttttttctgatcctctccctcctcccaccctctaccctcaagtaggccacagtgtctgttattcccctctttgtgtccatgtgtcctcatcacttagctcccacttataaagtgagaacatggggtatttggttttctgttcctgcattagtttgctaaggataatggcatcttgtcttttaataaaaggcctcctgtgttgaagttgggcacatttcttagcttctcttgaagtttggcatgtctatgtgccttagttatggtcattggtataaagaggcagtggtgtgtaccagcgcttgattgtgccattaaaataatgatatttgtgttcttctgaccttttttccattccagccactaaatgtctaacataacagagttgtcctaccagctttgctcatctacatcagcgagattaactgatacatttcttaagtcaatatatcttggggtctctttttaacagaagcttagcttgtattttcactaaatataatatctaagaaaaatatattgacaaggcagctgaatactaaatgagtctgtgtttaagggagagttaaagaatagagaaaggcactgggaatcttcagcatctagatgatctctgaagccaggggactgaatgaactgctgatgtcaatttattttcttcagacagaaataaattttccccacctttatgggtccactccactatgatcaagtaggcactgaaaagcatggcttttgccttttttttttttcctttggttactgctgtatagacccacagtactagccagaatactagagaccatataagcctatcaaacccagagttgaaagtgattatttgtcttggaagaagatcaagtcattttattttaccattccttatcttactatgcagaggccagactctttttttctttctacttggatatttaggattacagttttggtgctgaatactatgagcttcactctatcacagtcacatactgaagaacccagaagtcagagatactttgtttggtcagactatacctatttaaaaaaaaataaagttgagggacttaggtagtaagttttgtctttctagaacccacaaaaccccacaactctccatagtgttataggtcatttcaattcacacaggtatacaattaatttggcactgataggtatttaagtttgggagtttaagctaaaaatcatttttggaagaattaaaaccttatgcaaaaagttatacagcatgttttatcttgcagagatttctttactttgcacacacgggctactgagacttcatactgaaactttatagcctaaatccatgtatctttgtttctaagagtacctttattggagcactggaaaaaaaaacatatttaggtatctccttcaaatacaaggtgaattactttatacagacaacacaagagaggggaggcattagagttcaccagtctggaagccaggacctaagctctgaaagtcccaatgggccctgagcggttaaggagagcttgggtgttgatgacaggtgtaaacattcagaagatcacagttacagtgacactttgtcttagaatttatgttctgcaattagttgattttcctgacattatctttctaaagtattgtatatttggaccacaacagggcacagaactggtccctttttcttctctgacaaaggaccctaggatgaagaacaattacgtagattttctctctactattatacttggggtttcaaatctattgaggaattttggctcataaaaccttacttaataaagtccttcaataatctactgtggaaaaaatcgtatataattaaataaaatcacagacatagcttattatatatcggtgagtgtataccaaatgtatatgaatacaatttattgagccatgattccgaacacccactgaatcaggttgttctcagatttgcccagcattttatgaaacctattattcttatttgacattactgcaatataacagaccatagtgacatttgattacattccgttttattattgctttgtagcaaattgttctcaccaataagtgataaaaatgcagaggcaattgtagtacaaacatgaagacatttattcctcttttgtgttgtaagatcatccagaagcatatgaacagcatagacttggcctttatttatctcatcttgaaataactgtatcacaaataaaaaattaatatatattataagctagataagagtacatttctaagctaataaaaaaatttaaaaattatatatgttataactggtttcttatatgtaacttaaagactgattgaaaaatgtaaaatattaactgatacataaaagctaatgtcccatgtaaattattagaatattataaacaagtaagctacataccctgaatattaatgttcatatatgcttagtctgttatgatagtattcaatgtctttatagtgtgaaatattctctgcaataaatatccataagctatttcaaagcataccttttccagcaccctttttgacaaatatttcctggcaacgaggaaataaaacaatgttggttggatttatgtattcaattgctttaatatttttatttttccataattatcattaggtcatgattatatctatttatatatggtcacgtgttacttaatacctggggtaagttctaagaaatgcattgtcaggcaattttgtcatcgtgtgaacatcgtaaagtacactgtatttacacaaacctagatggtatagcctattacacacttaggagaaatgatatagcctattgctcctagactataaatccgtacattatggtattgtacttaatactataaacaattataaagacaatggcaagtatttgtgtatctaatcatagaaaaagtacagtaaaatatggtataaaaggttacaagtggtacacctgtataaggcacttaccacgaatggagtttgcagttaattataatcttgagaccaccatggtatatgtaatgtgctgttgatgaaaatgttgttaggtggcacatgactgtatgtgtgtttgtgtgtatgtaggtttatgtgtgtgtgtacactcattacttttccatttaaatactcgatgtgaggagaagataactaagataaatgacaagaatgtctaattttatctactaattaatatactttccatagtctggacaatctttctgtataagttaagtttaataaatttttgttgttgttgttgtttgagacagagtcttgcttggtcacccaggctggagtgcagtggcgtgatctcggctcactgcaacctccgcctcccaggttcaagcaagtttcctgcctcagcctcccaagtagctgggactacaggcatgcaccaccatggccagctaattttcgtatttttagtagagacagggtttcaccatgttgcccaggttggtcttgaactgacctctggtgatccacccacctcagcctcccagagtgctgggattacaggcataaactaccatgcctggccaactttaataaatttaaattgttcatatttgcagatgattagcttatagtttaattctgatttcacattaagttaaaatagttttatctttctcactatgccataaaacataataatattgtctaattttcttgtagaggctggatatgagacctttcccaagatcacgtcctttctcttcctgtgttagtttgctaaggataatggcctccaccaaaggagctggaggccattatccttagcaaactaacacaggaacagaaaagcaaatactgcatgttcccacttataagtgggagataaataatgagaacacatagacacatagagaggaataatacacattggggtcttttgcagggtggagggtgggaagatggagagggtaaggaaaaataactgaaggacactaggcttaatacccaggtgatgagataatctgtacaacaaacccccatgggacaagtttacctatataacaaacggcatttgtacccctaaacttaaaagtttttaaaaaaccgttatattcatgcttttgtcattcttttaaattaatttcctattattcagacgttatcagcactagacccatgtaactaaaatgaatttaaaattattttataagggaacaataagtcaatattattacatctcttatccttcttaaagtaaactcctttattcaaaataatgtgactatattattttacattattcatacttgacaaaacagaacagtgctaaccatttcttggtaataaccatcatctctgcctggcaacatcacagcctgcagcatcaatgtttatgagaacaaaatacatttattttgttatagatttccaactagctgttttcactagtaaatgaactcctttatttatttaggtaaggaatatgtatagtttgctctctgtatttcacaaacattctataatgggtagtaagtcaaaaataagtattaatttgaagagcccgacagtcttttttaaaagttggcttaatttctctgatgcaaacatggacatcttcattctgctacttttcataacttttttgttttttgagacaggtccttgctctgtcacctagattagagtgtagtggcttgatcatagatcactgcatcctcaatcacctgggctccagtgatccttccactcatcttctagagtagctgagaccacaggtgcctgccaccatgcccagctacttgttaaatttttagtagagatggagtctccctaagttgcccaggctggtctccagctcctgggttcaagcaatccttccacctctgcctctcaaaatattaggattacaggagtgagccaccatgcccagcctacttttcacaatttagcgtatcaatattttattaaatattttgaatggcaatatttgttcaaatgacttgcagaagccaatgtaaaatcaacataagaaataatgtgatggagaaaatggacctaaatatggaatctaaaataatctcacagaaacagcgattggtggttacagagactgggggttggagaaaatggggagatgataatcaaaggttacaaatttcagttagacaggagaggttttattcttttcttttttttttttttgagttctgttgcacaatgtggtaaatataattagtagtagaatattttacatttcaaattggtaagacagtgacaaccaaaatgagtgattgaggcataagtttcaatcactgaggtttattaagccagctttagagtgcatctagggaaacacaccagccacagataaacctgtggctatttttctaaagaggtttttgggaggtttaatatgtatgcattccttaaagtggggagaaggtacgtaggaagacaggtaggtaggcagtaaggcaaatgggtacaaccctgtgaaattttagttagtgtccagtaaatctacattttacacaagatatagtgaatgttagaagagaaaaagggagtaaaggaggagccaattatgtgcacatctttaggcaggtgaagaaatgagtcttgtttttgttctgtacctggaagacaagcttccatttggaagaggatgttgcacaattcagcttcatggctttaatttggggggtcctgagattttttttttaccttccaagagtaaatttcaaatgttctcatcaaaaaatttaagcatttaacgtgaaggataggttaataacttgatttaatcataccatactgtattcttaagctataacatcactttgtacctcatacttttatacaattataaattgtcaacttacaataaaacaaaaaagagaaaaaaaactaggaaaacattttgaaatgaaaattcaacctctgactataactctcaggtttgtattgacaaaattgagatatactaatgaagataatcaaaatattttaccccaaaatatatctctttgacataatttgaaatggctgctacagggacaacagactgaggtggctctgcaaagccatcttttgtagagaaaatttgcatctgtggagaatttccattgatgtagccaggacttctctttctaggcatttctgagatctaggagaggttaactgatagcctgacacttttaaagacctgaaaagaaacatttaccatctattctctctgagagatgctacctgtgagggttcatctatatagcacagccacttttgacaggcaggactctttctttctccctatcatcacctgtcttgccactaaaatctgatttaccagcataaatcatttggccgtgctctgagccaacattctgtttataacctcaagatggtatataagcttctgtacctcataaggggcgtggttgtcattctgaaggctcccatctgtacaggttaaataaatgtgtatacctttctcctgttaatcaatctgcctcttgtcagtgatttttcagagaacctttagggggctaagggccttggtccccacaatattatctcatgaagctgttgtgaggaataaataagaaaatctatttacaataataaacatagaatgtggccttttgaggacaatttgtacatgctttaaaaatattaaaagcaataggccgggtgcagtggctcacacctgtaatccaagcactttgggaggctgaggcgggcggatcacactgaggtctggagttcgagatcagcctggccaaaatggtgaaacctcgtctcgactaaaactacaaaaattagccaggtgtgatggtgcgtgcctgtcatcccagctacataggaggctgaagcaggagaatcgctcgaactcgggaggtggaggttgcagtgagccaagaccatggcactgcactccagcctgggcgacagagcaagactctatttcaaaaaaatatatatatatatgtgtgtgtgtgtgtgtgtgtgtgtgtgtgtgtgtgtgtatgtgtgtatgtgtgtgtgtatgtgtatatatacatagagagagagagcaataaaatttggtatagtgtctatcacgtatgggcctttcttattatttgaaaaatgaaagaactgaatgctatgatttctattgactatgagtgtatcaattagaaaataaacaaaattaacaaatttttctttgtgattaaacatataaaattagaaaaattttaaattaggaatgaacacctcaaataaaacaatagaaaataggtaatttaacaagataagatgtcaaaaaggaaaacaaaaatcaaataagtggagaaaataaaggaaagtagtaaaaaagtcaaggacaagaaatagaatttgagagctgaatgacacaaaaggtcttggaatgacaaaaaaaaaaaaaaaaaacaaggagtctgggcaggccaagtttaaagatcaataagtaaacaagtattcaaaaagaaaataaacatgagcagtacacctgggagtgacccaagatagagatataagaaaagtgtgaaattgtatgttgggagaggggacttgaatgtggtacaagctttctatgcaaagactataacatatttttcttttttttttttcaaacaaacatcagcttctctttgctgtcacatgaattccctatgtccactggtaattgaagtaaatgaaaacctagaatcagagctacaacttatgttaggagttgtaagtttcaatctattgattcttctataaaatcaaagctagaaaacatccttgattattcacattgctcattttaaaattttgatttaaagattttcttttatggtgtttaataattcattaaacatttaccaaataactacaacacaagacaatgtccagagatggagataaatcaggcatattacctctctttgaggaggctttaaacaattaagtagagagataggtggaaaattacatgttataggtggaactataaatgcatgtataagagttaaacatatttttataagtggaaaaatacacataatcaaaattgcacataaatatactttaagagtaacatgcattttacctaaacaaatataagccaaataacatgataatttgaaagataaatttaatttcctaacatttaaatgtttcactcttttaagtatttattcttatcaatattattggttgatattattactatgtatattttatggaggggaaagcagaacagaggagtaagcaacttttcaggtctacagaatgttaatatgtacttgctttctgcttaaaatcccaatcctgtttcctggaatattgtctatctttatattcaaaatttccaagattttttgttagcaggcatgtgaaaaggttagggagaagcagagacaaagatttcaggtctgaaggcaaagtaatattagcgccctcttttattaagatgtacctgtccaactatgccaattttaatttgtttcagtactctggacttagtcccaaatagtaataattctttcttacaaatacttgaggttctaatattaccaccaagccctaagttcattgcttttgatatctgtatgaaggtggtgcttccctaccattccttggtagctaatgatttatttttccaactcaaattgcaccactttcccacagcaatcatttattcccttcaataacaatcttaattaaagtttcacatcaacatttcatcctgctttagattttaaatttgtttttaaatagcacatagaaggcaaactaacagagttcaaacattacatatatatatatatatatctccaatacaattattaattatttttaagacaactttctttcatgaaatccacatccattgaaatttactatttattttagttacatatgtttaaaactctatacaatgaccaatgattcttctttacctagcttaagtaatttgagagctgaatgacacaaaaggtcttggaatgacaaaaaaacaaggagtctgggcaggccaagtttaaagatcaataaggaaataagtattcaaaaagaaaataaacatgggcagtacacctgggagtgacccaagatagagatataagaaaaagataaaaaggggaaagcttttcccctccataaaatataaatagtaataatatatgtaagtaataataatgaaagtgatagtaatagcaacattaaatatccctgttatttttttgaaatcttctaagttccaggatttatgctaagtaatttaaaaatattaacattaattcttgatttctttgaaggtttttaaatcaaaagcctgaagaaattatacatacaacttttaatagtaaactaaatttatgttgtattatttgattctatgattctatgtattcaactatgcagatgtaatcgtgtttaagttaccattttatataattataaaaaattaaaaatatctagagtgcccatatctcaaacagtagaaataagccaagtttacgctattggatgaaattattattattattattatttattttgtttatttattttgagacagagtctcgctctgtcacccaggctggagtgtggtggtgcggtatcagctcactgcaacctctgtctcccgggttcaagtgattctccttcctcagcctcccgagtatctgggattacaggcacctgccaccacacccagctaatttttgtatttttagtggagacggggtttcaccatgttggctaggctggtctcgaactcctgacctcaggtgatctgtccgcctcggcctcccaaagcactgggattacgtgcataagccactgaaccatttctaagtagtgagattcatgttaatacttcatatttacctataaattttgtatcagtagaagaaaacaaatgcaagaagtgttagaatatgtgatagaaaattaataatcatggactggaaaaatacaagtaaaaaatattttcatccaacaacatggttaaaaatatgagggtctgatttaaattaaatattatcaacaggatgtggaactcttctctcacttattgcttgtatgtatgtgaatttgtgtagccattttgcagagtaatttgaaaatatctgttaaaatttaagattcttatgtaccataaatgtgcctaaggagacacatttaagaatgtttaataggaaagacataggaaatacatattttcttcttaagaatattgataatgtattcatattatggtatataaacatcacaaaatgtagactgctaagaggaatctggtagatctacatgtgctaacatttaaggattgccaagacctgtttatgaagatgaaatgaaaaatttacaggagacctacagatttgataccagtggttacaactagggagggacccaagggaggcaaggtggccacggctgatgtgaggattttaaagccaagatcctctgcaaatattctacggggaacaggtcaggctataagtgccataagacagagttaaaatgttctcagatggtttgctgctcatgagggcttcatacacgtgttctattttcatcctcctttggaaattagatttattggtaaaacataatttccatataactacttctctctgaaagcataaattgcttattccccatgctgtgtgctacagagatatggaaaaaaaaatgacgtattttcccggctcttagggagctacacagtggagatgggtacagggtggggagaaatactatctcatatagctgacatttagagagtgtgcaagcactgttagagattccctatattaacttatgcagtcattaccacaacagatgaagaaacaaaatatggagacattaagcagtttgttcaatgcccaacagtaaatgacaaaactgggatttgaacccaaagaagtctggtgccagaacctgcctttttaactacaatcctatacagcctcttaactataactctattaattatctatacagtatagtgctaaaaaatgctaaaagtgggtataggactggaataaagaaatttcactgcatgggatggtttgaagaccaggagccgtaataaagagagagaaaggaatcaaagctacttgagtcagattctggatgacatttgattgcactgatgggttttgcctgaactgagcattcactgaagggttttgaggagagctgtgttttgatctcacctgagttttacagaagttactatgctggtggtattaaccccttatatcgtagaggcaagaaattacagcttctccacttaagagtccactgggggaaccatgtaaaaaggaaaatgagactccaagctcttgtgagaatggagagaaaacatgaaatatgatttttaagggaccaacctgacagaactttgaaagtcaagatgaagccagtggctggattgaagatgattctagcttaatggaggatatcactcttcaaatagatgggaatacaaatggagctgatttagcacatgagaaagctctcagggatcaggtaagaagttaatttttctttttgtatttagtagttcctgtaaaagttctctttggaaaagtaattaatacctggtttacagaactgaaagtattacttatttcaaattttagtgaggaaatgggcaaggaactataaaatgtaaaatatttaaaacttttttttatgtctatacccttattccatccccctgtacactacaagtcagaaatttcttaggcattcagtttccattagaaactggtctgtaaccttctacgtgatgtttctcttagagtgaaaagacctttacctacactgtggtgcaccagagtttaaagttggagagttcaattatatgaaatttaactgtaccctgtagatttcgagagatacgttttaatatcagttggtaggatgtaataccacgtttgcggcagtagtccctctagtactattctccatatacttcctatgtaaacctagtaggagtgtatttccccacatctctgaagttagatttggccaatgccatttctagtgaaatgtgaaatagatatgtctgtcgcttccagggaaagccattaagagctggtgtacaatttacaaaatttattttcccctactctggacccagtgacattcacaatggtggagaatatttttgcctgcatccttgagaaaggacaaatgtggaacaaagcttccatctcattcttattactgttaaaaatataaaagaaatatagttttaagccactgagattttggtgatttttgtcaccaccacataatctagcctattctaactgatatactaactgctgtggtttttctccttaaacttgcccttgacaggtttttctggacaccgttattatcctttctccctcccccagcccatggaggtctatcttatttcccagttccttacaaatatcttattatcctaatcatgaataaacaagtaaaaatagctttaactggttctgtgaattatttcatctaagattcagctttttatggggcagtttccaaagtaattaaaatatttagcagtttgtcaacaatagaaactagtaaatccttcctcaaggtttccaagctccttccaaatggggaaaaaggttaaatttgggagaaagtggataaagtgttcttccatgcagacatctttacatgtgattttataaggctttatacactttatacaaaattaaatataaatagtcttccccaaatatagagtttataggatatcttacagggagaaatccaaaatcaaactaggaaaacaaatacaaaaatagtagtagtcacttaaataaaaattaaatccaatgaaagaatgaatggaagaaaaagcaaataaccctagtaaatgtgcatgaacacgcagagttcttatttaatcccatcaggtcttatggtatttatcctttggggctcatgaaatggaacagtttaaaatggtcactgaccacaggcaggattagcacatttttatatttgtaacccaaaacatttagtttttggattttatcaggcataatataaaagtgattagtgttatggcacctcagaagttagaagttgtttatgcatggtctgtgataaacagaccccagaaagtagctggaatagggccgaggcaggcaattcaatatgtagacatactttcatatgctgcaaggaaaaattctatgacctcttccaaatccattgatcgcaatcccagaaaataataactgttctgcaaaatcttcctataaaatacacaatatttaaacaaccactaatctttttgaattgtacagaaaactattccatctcacatatgacccctctccttgtatatgtgtgtatatttgcaacaaattacaactttgttttaagcttggttctaaattaatgtactgtggtaaaaaacaaaaatctggcaaaaactcccattgttttaaaaatgcaactgacataagcactgtcatgaaaaatgtcatttgatttagggtcaccttacaggcaagtaatcaataaattatgtagtcaaatatgtccatctctgaaacagcccttttggcttattgtgcgtctgagagcataatggatttgttactaaattcttaccttgtactacaggatttcgcctttaataaacatgcaagtctagcttatctttgctatatagttttattttcattactaaaattgaacctatgtatcatctttcttcctatgttacatgatagatctcagaggtgttaacaagagcttctactcatgcagtgaaatgctgaaaggtggtacttttactctgagctgtttattactcccaacatacagccaattatttttgtaatcaaagaattttaaaacctccaacattaacataaatgcattagtaggtcacatttcaaccttgacaagattactgcaagatgtgtttgccaatatactacacagaactccccatctgtatgtggtaagcccttttattcacttgaaaaacaaaaagccagtagctgatattaacaaactgttgatatttcttggagagctgtgacttttttttttttttttacagtgttctggctgtaattttgaactgacttaagtctatgagcttttatatgcctgcagaattatgttttcttttctatttgccaggtgatatgcaattagagagtcttgtttattatctcatagccatatccctttgaacaacagagtgtgttaaagtacagagtatagagctactgaaaatacatattttgaattatgtttattaatactggaatgttttatatttgacacactacaatctacacaaatgtatattttaagcacaaatatatataatattcagatataaatgtttttaagatgaccaataattttatctgtataacactggataaataacacttgatgccaaactttaaaaaaaaatcttgctgtatctttatgcatattcaatttcccaataaacactatcacttcttactacaaattactaagattggttcctttctttgtcataacaggcaaatctgtagattgagcttcagttgtaacagaaattgcttttattcaagctttcctttttccctctctttcttgtcattaacctttcttgctggctaacatgatcccctcattccatgaacataacagcttggagtgttggatctgagatgtaccagctatctgaagagtataagctgaatgtggggttaggataagacttgttttttgagcttaaaaaaaataggaaggatcaaaaccaaaaacaaagccaaagattactcaactgacgtgtaagtctaaaactcgagttagaaaaaccaacgtctctccatccagctatccattcaacaaatttgcatcatatcagtgaatgagagagagaaggtttctattctcttagacaaagattctagagagaagaactgaaagacagtaaacatgttttaacaatgacatcaaataggacaattttacatagagtgactggttgaaggcaggagagggagtgctgggttattttacataggattgtcagggaaagccctctggagtcacggcatagtttttgaactgacaagtaaatgatgagaaggaagtagtcatggaaaagagttggaagaagaaagaagagtcatggataatccgttaccttatttcacctattctaaggtgcacaccttttcatattttaatatccatgaaattaaggtacatgttattttaataattgctattagctggatggtagttgtgattttgtagtaactctcagcacgtacctgttatttccagcagcatgagggaataatatcaatgccttgacatttaagctaacaaaccattttaaggactatttgaggaataaataggagttgataggagtttgttttataaaaaacttagactaacatcatctacaagattaagaattcaccagcattaaccttgtagaatgtttgtcagcagtgtggaagaaagcccaagaactaagtgggtacgcccttttgataactgccctatcaccaatgctcttaacagcacagcaaatgcaaatggagaactgaaaagtgactaccagttacattataaatgtaaggaagttttaagaatagcttaaacagtctattttgctcattattttgtattttcatgtatgaacaagagtgacgtgaaaaattcctgtctaaatgattctaatatcaaaagtctctctgaatatgtaggaaaaaagtcctaagtaacaagaagaattacattatagtttatcaactttttttttctattttaacagttcataaaatactatcttaaaatggatggtgtcttagacaataagaaatcactgcactttccaaggcactgttaaatagtggtgaacaagggtcccaacctttactgagttttctttctagtgggaaataaaaataatataactgagtaaattaatacattgttaattgtacattgtgttaatttctaagaaaacaataataaaaacaattatgcacagtgcatacaactgcttacgaggaggtagaatgtgatggagaatctcatttatattatggggtggtgtggattgtcaaaaaaaccttgtcagaggatataacctttaaactaagactttgaagcaaggggagtcagtcatatgaaagttagtaggaaagtatttcacagggaaaaaagacatatgcaaggtatattctgtttagtatattctgggaatgaaagagtgtttagtatattctgggaatgaaaagatttgtgagattgtgaataaatgtataacaatagatgaagtggtttggaggtgagaaatgaggttcaggaatttagctttggagatgttaaaatagaatatatgtcagttattccacgtaaattataggtgtacatttggatttttgagtctgagattcataggagaattctgatataatactggggaacttttgcatatgaatgaagttggcacaatatttataggtctgctagaggaagacaagacggcaaagcagacttttaaaacatctgggaaggagagaagggaatttaaagaatgtagaattacgagaaggcaggagagaaaatctcgcaacaaaggataaataacttgttgacagatgatgggatataacttatccattggatgtgactacatggaagtcactgatattttttaaaaaagagtttggttaaacaatgttaagatgaaattgaatgaatatgggaaaatgatgaccaaatgtgcagatgaatttttcaagaagtttggttgtaaaacagtgaataggtatgggaaaagtaagagcaatgagacataaattgcttatactaggcaagacttagagcaattcatcttcatgagatggtgttggagattatgccttgtgctgccttgctgagtgcagaaaatgaaaaggttcaagtagaggggaaaaggttcaactggaggataagaagtggtgtacagagatgcatcctttcctcaatttccacaagtagatctggctttttagaggttgctcataatctaagttgtattgtattgtattgtattgtattgagatggaattttgctcttgttgctgagactagagtataatggcacaatctcggctcactgtaacctccacctcctgggttcaagtgattctcctgcctcagcctcccaagcagctgggattacaggcatgcaccatcacgccaagctaattttgtattttgagtagagacggggtttcaccatgttgatcaggctggtctcgaactcctggcctcacttgatcgactcacctcggcctcccaaagtgctgggattacaggtgtgagccaccatgcccagccataacctaaattttaaattgaatattgttccaattaggagaggttgtttcaagtttgccattctcatggaaaccccacactagatttctatgccatgactcataataggaaagacttgtccctattagtcctctaaagccctgtggcagctatggacatccaaaggctgttgctaggagtcccatagcacacactaaaacttaaaggatgacacttttgcaacctagtagttttccaggggttggcatgataacatggaatttcaagaatttttactcagaaaaggttatagtacattcatttggtatccagtaaaatttagatattaatactacctattgggtacaatgaacactatttgggtgatgggtgccctaaaagcccagacttcaccactaagcaacatatgggtgtatcacaactgtactcataccctatacatctataaaaataaaaaaaaataaaagcacataaaagataagttatttgaataatctgtataatatttttttcatcaagagtgttagatacacgtcaaatcgatcacataaatatagtaattggctatagattatgtttagagggtgaaacaaagataacagatctcattctacacagaataaaaaaggaaaatgaaaacatacaacattgtggacagcagccagggatgtgagcagaaataagttggtagtatttctttgttcacggtcacataggtaagagtcacgtatttataccaataaaaattgatgtacttaatatatagcttttttaatataaaggaagtgaatcaaaaatgatcttaaccaaggaagaaaaaggaccaaggattaaagacgtacgtttatccgcatccatccattttcctcttcaggctacttgtaccattattttcaaatctttgtatggatattttaggaaatactttttttccccttggaaatagtaaagtgtctgagctccagagggtggttaaagaagattgataagtaatgactgctgaataatagaacaatgaatgttgtgaagcatttccttttcatcacgtaatcaatgagtctccaagtcaaaagctttgcagttcagaaatactatagttggagacaatttgttctagacacaggaagaaaacaccagctagtaacagccatccacttaggagaaaaatactttttctttataagaactgccttgctcaaacaacattagtattagttgagactttaccaacagataaaacctagaaagaataatttagcatttttgtcaaagatataaacactaccaacttattcctgcttctatcatttttgaaggatgtaataaaatcatatttgaaacaaaaacaagactgcttttttttttttttttttttttttgagaggaagtcttgctctgtccccaggctggagtgcactggtgtgatcttggctcactgcaacctctgccttccgggttcaagcaattctcctgcctcagcctcccaagtagctgggattacaggcacccgccacacctggctaatttttttctgtatttttagtagagacagggttttgccatattgtccaggctgatctcaaactcctgaccttgtgatccgcccacctcggcctccgaaagtgctagataataggcatgagccaccacgcccagctgtaagactgctttttaaaactacggaaataaatatatgttgatatttagtattatctaagattatgaaacattttgttttaacaatatgtacaatatttcacaataaagaaagaaggattgtgtaggaaggcatttccatttcatactttttctctctttttttttactgttttgtgtctagagtgcaatttattttaattggaggaacagatcacataatattctgtatttaaccttaactctactcccttgccccaattaagtagaaccagataaaactgaaatgcagtagtaagaaatttcaagcttcacagcctgctgaaaaaggcaaaggcccaagaaaattgtgatcttttgcggaggaaaagacaaaaaacagctgaagggaggtggttgcgtcagttggctataactaggaatgtctcggagccacgttaagcgccagtcctgacatggctgagagcataactgtaatcagcaggagacacaaacacacgcattatttttctttctctcccccttttattagttaccttttcaatttgttctgactgcatcctcaggaagaagagaaaacagatactgatgagcactaattgtctccaccacgcctactttaaacatctgatttggcaagaatttaccccagtctctgatatttctttatgtctcaatacagtgtctgccacactttatcgtagtacttttacatatacttccattctacttgccctaattaaaacatattataattgaaaggagtggtaggttgaatggtacctgtgccaaggatggaattttatagacagcaacacattttatctcagtaactagcttaattcaatgtttttccataaaaattcttttcctaataacccatagaaactgcctaaagacttgctaagcagggaagtgtgattacacaactgctgttacaagtatctcaatgccactgaactcaccaaacccctaaaaatgaagaacttagaaaaactttgctttgtgtttagatcatctctatctatacttctctattttgaaacattttctccaaacccaatccagcttcatgcccagataactttatgcctttattttgctcaatggggccttcttatgtcatcatccagcctggttctcccctctttgaccagcataccagatatttcctaacttacttcctcagtgactgcttaactgttttatccactatctcctcaaaagctgtcctatcctcggttatacttagtcaatgtgatattaatctttgtcactgtgtactaatacataagacccgtcaaacattggaagtattactctagtgagaaaaatttcataagccaaacatgagaaagtcaaatgaatttctctatgagaacagaggctttaagctaaatggggtacaaaattttaatagagaagatctttgtttccatgatatgattgtaaatgactatacaaaggacctaaccaaattatatctcctaacataagcactgaaattattgataggtttaggttttagaagacataatggtggacagcaaggtgaagatagtgacttattggttaaaacatagtctgcataatttttaaagtaagttcctggccatagatattttgtcattaataaattaaaagaaatgactggttaatgtgaaaactttaatataatatggatatattctgtccagttacaaaaatatattttgcctaacttcattaattaaaagaattcaacgttacagtttttttaggacacaaaagtataacactaccaccaaagcaatgaaaaggatgtttgttttcattctagccttggaaacaatgagaaggtttcatctgctgccctatttatgtaaataatgagattctaaaataaacagaaaatcatcaggctccacattaacagaatgccttcaagcaaaaaagcatgacagccacatatgctttaaactttgggaaacacaaatgtagagtgaggaagataaaaccagtcaaacaatcaggttctacacttaactcgcaaaagtttttttttttaagtcatttttcccatatagagctcagtttattggctagttggttggttttcattatctagaagttaaggaagtttgtcccttccatctctaaaatattatacttacgaggaggttaaatattacttaattagcatagcaaatggcaaaaatacaacagtaaataaagtatacttttctataatttcctctcaaaaaacagcttaatctttctttataatacatacaggggtacatcagtgacacttatttttcacgtaattctaaggcaaccagacagagatgaaagagaaatttaagtaccatattttccatcctcctgaaattcaggaaaggtctgctttcagaaacaacaccatttaacgtaggtcacgcacctggaatattcacacaatcccaatagaagcaagaatgattcactaaggacagaagcagggcactgatgatttgttaactttcactgagacctttgcgtgagtgaacaaatcttgttaaatttcatgccctgaacttcatctgtatgtaggattatatttttgaatttcccccgagaataatcattgtaaccttttatcaagagtgggtttgttctcagcagaggcatcaacccacccccgtaacccactcaccgcagggaataaaacaaccattgtcctatggagaagccggcaacgtgaacaccagaggactgcacctgtttgttcactgttatcaaatgccaggctgggggctacccctggtaagagggctcggacttcttaaaccacagagcaacataaactctcctgtagaaatcttttgtgtgcaaacagaagtttagcagcatgctttcttcctgggaggaagaaagagcacgccttttaccatcgggccttcaagatacattcattctttgcaaactgtctgttatgaatactaagcttcccatgagtgtccagcttcagtttaaaaggaagcaatgaaagactcatgaaatgaaaacgatatgaatatagcatcaaaactatgtctgtcttgtgaagaagtaattacttgagtcacttatagaaagttgaagtgttcttgtcaggtttaaaatttcaaattagctttctatggcatattgaaaagatagttttgcagaatactttgtcctaatctaaagctccaaaaacaatgagctaggtgtaagtttggggtgacacaaagcctgatttcaacctttaatgagatgttaagagttcaagggagtgggctattttaattactcccatttagtaggaaaatatatatgtctcctaatagttttaaataattaaatacacacagccataccaataagcaaatgaaaatataccttcatgggtacatgtaatagctcttcacttcagtgccatcttttctttatcctgccctcagtacagtttgtgatctcaaattctggatatgcaatttcacaaatcctaactgctgactgtggcaggtatctccacagatacaaacatagaacttgactgtttatctttggaataagtgtgtgtgtgtgtgtgtgtgtgtgtgtgtgacagagagagagagagagagacagagagaatatgattgcatagttcatttgtaattactcttttactctttctcttggcagtatgtttcaaaagaaatatgtatgttttaaaacataaaaaataaaaagtaatcaaaaagaaaagaaaaccaaaagggtttcttgcaagacagaccctagagcaatttgaaaacatcaaataaaacccctccagcatgttctccccatgtgatgcctttgtacatacacttcagcctgtgggcacatttcccatgacacacaccatgtttcagtgccatgttgatagatataaacacatatggattactcatttgccattctgtctattgagttccatacggttttctgtaaaattaattttatataaaaataaattattgggagccaaatatcgtttctgaccatgaatagagaaatagaattataacaatttgagtgtgtttctctttggatgtgtcagtgacacacaatgtgcatggctatgcataatagttagatattatactcatatagacatataaatgcatctgtgtatgtgtctatacatatgcatctatacacatgtacatataaatatatgtatatagagaaaaacaacatgtgtatacacacatcctctttttctgttatatatttattggctattttgctatatctctctctggtcttcttatttgccttttgctcagttccaggtatgtgtcaatatttatttttctttaggaaactttgaaataggtatgacctgttgacatgtatggatttattattacaattattttacagaaaacagattttctatttttttaacatagttatgctttaaaaaataaaataaaatgacagagtaatgttttataaacaacttttctctaagtcacagaatttaaggacttgaagcaaggatatagacataattgttaaatatactttcatgcccagcaaacaagggagacatatagtcattatttgctttctattagaaaatccatggtcttgtatccaagcatatgaaaaccatttaaaaacttttacagtggttctaagcaatgtgagagtttaagctgtcaattaccttatttacggagtaaaagaatacaaacaaacatgaagtaagtctaaacacttgtgaaatgctactaagatacctttcttaaattttcatgtttggagtaaagattctaattttagaatgcaacccccaagcttcctgtggttaccgagtctgcaaaccaagtctattctgcaggtgtctcacatctccactgttttgacaacagttgcttcacttctttttaacacactgacagagacccagccgtgttatagcaattgagctactgaaaacactatcagcgatagcctaccctttctttagaagttcaagttttcaagcaaacagtaactgggtattttaattatttttaaaactcccagaaaatacctaataaattagatcttagccaattaaaataagttatcaaaatattcttaatgcaagttcatcaagtaggaggggtaaaaaatatatttggtactgtttctgcttatttagaactaattatgaaatatctaggcattcaaatcccattttattgtggaatggagatttaaaagggagcaatgattaatgactttcaaatacagtataaaagtaatctctggggaaacaaattcttagctgaattggtagctctactcagcagggacatttgaataattccaggggaactaagaaattaagaaatgaacaatgaataggattttcttggcaccactaggaagtcttgtgttaaaggcttggcaccactgttaagccttggcttaaacgcaatatttaaaatcaagtaaattggttgtgttgcccagttcactttccttttttccctccccaaaagtcatcaaaagtttttcctttctttgttttgctattatttagccttagcaggaaaacaaaataatttatttttaaaaatgaatctatctttaatgacacatagctaagaataaacacattttgttactattattatagcacgttgttatctctatgccagaaaataaatacacacagaacaatcaaaccctaatagaggtccctagatatgcacatagagttgcattttttaattaaatgcttgaacttcagttcccatgtgctcagaaagcaaaactacagcaccgttctctgctgaattggaaggggtaatgtcatgtcctcacttgttctaagcagaaaacttgaggactaagaaaatgtgactcacattttgccttagaacttttccaagaagataggtagtaggtaggtattatcaaataatgaaaggaaagaaagaaaaaaaaactaagaaaattattctttcgtaattgaaaactcagtgcaaaaggtattaggtgatttatctaaggtataagtggaatgagaatacgaatcttctggttgctagtgagcctagactactaaaatcaaccatatctgtcaatgaagaaccaataaagaacacgttttacatagatgtggcaaggattaaccaataaattaatattcttaaatattgttactctattgagaactgcataagaaaagtggacacaagaagggaactaacatatattgtgttctaaacactatgctaggcagtttgcatacattgtttgcatttcattcccattttcagatgaaaactgaggcacagcacataagtgattgtgactgtcctttctttgttgcagtgcgagtattaagtttcaaattgtcaggtttcaaaactcaggcttttttctacaacttcatgttgctagggctagacgagaatattttggaaatattgtttttataatctagaaatatgccttctcatctagaacacataggctgggtttgaattcaaataataaatcaaaattctcaggccaaatttaaatttctgcgttaagaatctttcaagcattttatctctgagctctgtttttatcactttgcccttccaaaaccatttctgactttatgcgtaagtcttagagtgttttttggatacaagagctacttaattttctgattgttttacattttttcatgggtaaagttctaatcagacaactataaatgacaataatcagagtaaaaaattatatacatttatggattgtcaactgtttgccctttgtatctcaataattttattattttttccaaaggacattccctatttcaccagctagttgatttaaatagtcatttgaaattataattagaaatattttagaaagaaaaccatttgaggggggagtgtccatcattctatgtttatctatacatgtgatatttagaaacacactcatggcttaaaagttcccatttctgttaatttgataattatatattaccattgatttcctctttaaaaatacaaaattttgtaattccaaaggaaaatgtttcaaagatgtctttggcattgaatgtttcttactaagtcatattttaatggattaaaatgtaaatgaactttaaagttacactaaatctctccctgatttaaattatattagacattaaaattaacatgaaaatggctccataaacactattgttttaaatatttttacattattttatatttaataatgaaccaaaagtaacagaagtcactgtgcatagtaatagtcttaaatacataaaacgattgaatagttacttaaattatgcactggtgatcttcaataaaatcacaaaggagttgataacctacattgtgacccctgatgtatttattttgcacaagtgatagttaggttctcgtaatttttaagaggcgcttgagccaagacactaattcttgattcacctcttttccctgagcaccataggactgcatttgaagcatgatacaattttaattacaaagatttatcattacgacatgcaatttctaagtacgtgaaatgacagtgtaatgcacagatgtgaagttcagccacacattcactatgtgaacaatggtatcaatgacacaggctgcttccttccattctatatttctacccatgctttataaaagatatatctataggtatgttaagtactgcttcattatcttctccatcctttccttgcaaaacatactgcccagtactctttgaacaagactatgaaattcatatcaaatttgataatctattgtagatatttgatgactttagattacaattcggttacacatgaattatggcatctatattgtttattttcttcccactgatcaatgaaaatgtatacctaaacatatatagattggcatatgttttctttaaatctttttgttaccttcctctttctagtatcttgaatcaaattatatttttggaataatatagttgaaaaaggactcgactaacagtaggacaagaaaaaccctcatcttaagtaaattatttattctctctgggactcagtttcgaaatgagagaggggttagacgatctttaaattctctcttaatatcgcatctacgatcctcttcaactttgcttttatagaagaatagattaagagatttttattgctctttatttccaaaatatgtgctaaatttaagtgtagtgtattctttgatgtctaagtctgaaatatacttgtttcaataaataaaatgtgagctcaaaataaaacaacataaaatgtgtttatcttaaggccatacacaaattctggaaataattagttagagggtttctaaacctaaaaggaattacatgcgtttcaataattttagagtctcctccatctttttatcaaaagtaaccccgaatatgttactattcttcacaaagggaattgagtctaataattattaaaactaaaatatatattttataaaactctgctgtaaatatgtacaaaaccaaatgtagtttagggaggcaaaaatcacttactgtagctatagaagaaaggaagtcataaatattttatttaaaatatatagatcaacttagcctgtccatttatacttggatatttcaaaatggtatatatttataccagttgccaactagggagtaattttagttagtattctggtccttaaataaaaaattcaaaaagtggagtggctataatgtatgaataaaattaactataaaatcacccttctaatatcttcctttaataagataaaatatgattttcatgaaatcagtaattagagtcatctcatagacttgagatctttttcgagcctgccatttttctcatattgattttccttccttccacctcatccacaaaaaattctctaaaaaataaatactagagtaataagatttatagaagacatcaccccatgagtaacaaaataaaacacgcttcaaatataactaattgtctttttttgtcttctagtgttaataaagaaaaggctatgaagtccgtgcccaattagggcatttcaatccactctgttattatactttattattttagttccctgtgtctgtagaaataagcttaagtagcctgatagcatacttttcaatgtaagaaataatttaatcgaattatacaatctgtatctcttttagaatcatttcatttcctaagtaaaaaatctacactaagcaaagtctcattcagctaaaaaaaaaaaaaaactgccttgaagaggtgacacctggaccacatgaataattttatgcatcccctgctcattcacacatagcagaggatgacaaaagtttagtgtcatgtgatcccctttcttctcagaatccctatagcattgtgataaaaagaaaatcagcagttatactacctagcttcaaatctgaactctataaattattgtatgccctccttgtggtatattacttaatatttttaagtccagtttacttatcttcaaaatagaaagaatcatagtaacctacagtgatggttaactttagacgtcaccttgactggattaagaaatacccggaaacctggtaaagctttattttagagcatgtctatgaaggtgtttcagaggagatgagtttgtgagtctgagtagagttaagtaggtaagatatgctctcaatgcgggtgggcaacagccaatcttctggggaccaagaggaacaaaaacagaggaaaggtgaatacattcatctgaagccagtacacactctttctctcttgcgggacaccaatttcaggctccctggtctttggactgcaggacttagaacagtggctccctgcaccctaaggcctttgatcccagactgagaggtacaccattagcttctctggttctgaggccttcaaacttgaaggccaggtcaccagcctccgaggtgctgagccaggtcaccagcatccgagggtcttcagcttataggcagcctgttgtggaacttctcagcctccataattgcatcaaccaattgtcctaatgaatccttctcaaatagctattatcgttatctgtatctatatcctattggttctgtctttctggagacccctaactaatacacctactaatcgtggttattgcaaggatgaagagagatcatatttgcaaaccacttctacatagtaaatacttattaattatggttgttattattgttattattaacaatagtatctctatcctgggctgtactatgccataaagatactttgctttctacatttattatcctaaaaaggcaagtcatcaaaaccaaaggcacaaagcctaaatgaattctagttatatgaataattttttaaaactagtagaatttattattgtgttcttatttgtataccagcagatatataatcctacccagtatcatcctattcaacattaaagcagaaagttcagagaattcagggcaccatcaaaatcaaaatgacatacttatttaccagaatatttgccagaatattctgagaccgccacttaaaaaaaaaagaccaaattaaaacttgaagtccttctatttcatagtaaattgaaaatcaaaaataccctttttatatcagcttttttcaacactactaataatataaaatcaaacctttgattttcaccacagagaaaatgaaactgagtaaattgaatgctcttagaaggaagaaaaaagttatggatcaccatttttcacttttttcttataaatattcttcaaaattgttatagtcattatgattcgataacctaaataattttacatggcttacaataaaattatagctagaagatatgaaatatgttatacagacggatcataaaatattaaggaagaggggaaaatagtaagagagctagaataacttgcacttctggtaaagaagacagatcctctttccatgctgatgtataataacaatcttcagatctatttgacatattattaagagaacaaagtttaagaaaaactcccaaaataagtattttttctgcctttgaactatatttccatctcttttccccgtagaagtgataaatcaactagatctcaaaagaaaacaaaaacaatcattaaaatttcctggttagtaacatttattatgccaaaaagtgttgggccatgcaaattctcatttatctatttcctgatagatacagataaatggaaaattctattcatcatttacaaaacattgaccatttttattgtaacctattttatatgcttccacagtacacagtttcaccattacaatagctatgttataattctagaaaagtaataagaggtatattgaacttctagcctatttgaatgtactgtattgtattaattctaaaacacatacagttttggatctaatatctttaaaatcctggttccttgtacaatcttttacatttatgttggtgcttttactttttctctttttagaaagtgtggactacaaacaaaaacaacagtttgtttcctacaattgatgatggcttaaatttgttgaaatatggcagatagctatttgagaaaacattttataaaagggtttttcgtgttaccttgttattaaataaatgctataatttttttaaaaaaacttttaacatgaactggggagtcctaaagataatcggcagtgtctattctagaaataattcttaacagatttttcagaataataataattatcttctattaacacttacttctttcagtgaaaccattaaagaaatagactttttctattagtccattctcacattgctgcgaagataccacccaagattgggtaatttataaagataagagatttaattgactcacagttcagcatggctggggaggcctcatgaaactcacaatcatgggagaaggggaagcaaacacatccttcttcacaggccagaaggaaggagaatgaatgagtgcccagagaagggggaagccccttataaaaccatcagctcttgtgagaactaactcactatcatgagaacaggaaggggaaaaccaaccccatgattcaattatctccacctggtccctcctataacacatggggattacgggaactacaaattcaagatgagattttggtgggaacacagccaaaccatatctctttgagacccatttctaatttcaacagatacttatactgtggaaactaaaggtgaaagtaaaaaatttcatttttaaagtgtcatttatctgaccaacagaaaacccaagtcatagcagcttaaaacatatttagaagcaatgcatgccatccagaaccctgctgactcaaatataaaatatggttaaggcccaaatcaaaaatgacacattctgtattctacaatttgatgatataagcctaatatgctttcaataattataaaaatacactgtgtctatttttttaccaaaatcaaacttctcctcaaaaaataatcacatttatttccagaactgcatttaatgttcaatatgtacttgataatttaacttttataatcatcttacaactgagcatccttgttatgttcatttgaagataaggaaactgaggcttagaaagttgaatcatttgcctcagaatagaatttgactcagggagcccagattctgagcctgtcttgtgattctccacgttattgtgcttgtaagtccttgcctgctggattggatttagtaaaagtctggtccctttagtgctgcactgtccaatatgattgccattagccaaatatggctgtttaaattaaaattaattaaaattagataaaaataaaaattcctatcttcattcacagcagtcttgttcagagggctcattggccacatctggctactggctcctctgttgtgtggcacatattgaatattgctatcatcccaataaagttctattggacagtgcagcttttgagaagaatagacatgcttgactataaaaataataataataattggcttcacatggcagacggagggtaaatatttgtcagaaatatagtatttactgagagaagacaagcatgtagagataatttagaatagctcatatctcagcacaatgacttgaatgtacaagtagaacaaaacaaagctaataaatatttgaattgacattactttccaaaagaatcctaaacttttaccagtaaaattaagtctattaataaatgtttgtgcattacagataagagtttagcaagcaagcttgatttttaaaaagccatagctgaatgacagtggctataggatgagtaatagatttttaaaaaatcaaattcagtatttacaatattgttgtattgcacgtttgcttgtattttattgtcaacttaccattcatgatatattcaagtattatataatgatcaaaacaaattctttctaaaatacagccttaagacctattgctcaagtttggattgtttacttttttcagccaatttaatggttcactgacaatagttttgcctgaagaaattgtcttaaacaatttttgggagtgacatatgaagaacgggtaaatagatctagattccagcacaaggttcacctgattagccacaagaccttaggcctggtttccttagatgtaaaattataataaagatatctgccaggtcagcattacagggctgtgtctgaaacagatttttttttttttgaaaggaactgaaagcagtttgcaaggtgcaaacttccataacatatgggatattacaattatcatgcctttggtaaacgctggaagagaacaacatgtagcctcatttctgaactctgactgagggtgttaggttctgccaagcttgaggctgcctcctctaactaaacttgatgatgtatttacatattctaaaaaattactatagacatctgtcaaaaatagcatgcactcttcattccctctaaaatatagatttggtggccgggcatggtggctcacacctgtaaacccagcacttcggaaggccgaggcgggcggatcacgaggtcaggagatcgagaccatcctggctaacatggtgaaatcccatctctaatagaaatatacaaaattaactggacatggtggggggcgcctgtagtcccagctacttgggaggttgaggcaggagaatggcatgaacccgggaggtggagcttgcagtgagctgagattgtgccactacactccagcctgggccacagagcaagactccgtctcaaaaaaaaaggaaaaaaaaaatatatatatatatgtatatagatagatagatagatagatagagatagatatagatttggtttattcttaaatattattcctactgtttccagtcctctgccatgaaatcagaaagtgcaacaatccagtgattctagccccagcattgttgtgcctcccttggtaactgggaatggatgcagagaatttttcaatactttgcagttcagggtctgaaagccagatgaagctaatgtcctggggtaagggtggagaggtgggtattgatatatttactgttttcctcagagcaaaacgatggagccattgttgtattaaaactaatcaatttctagtactacatttgggactctgaggagcaaaaatgttcctctttttctaaacaccaaagcaaacaagcatgcttcctcaatagatgagctttaagcaagggggtttgtctcccttatacatttttttccttaggatatataagcttcctctcttagggaagggagaagacagattttactgtatcttaagaaaaagtaagaatgatcacaaaggtttaaggttccaagtagggaagtttcctgagaaattccataatgctaggcttcccctaatattttctaaaggatgctctagggattaaatagaatgttcttcaaagagtgaggcatctttaagattcctgaaggggtcataaattaagggagctgaattatatgccctgagcagatcatcttgccagtcatgactgaaaacatgtgagcagaggagaaaggatgattctattccctgaacgcccaaccccaccacttattttggcttatttctcctcagatttctctccttattatctctgattcttggtacagcaggaggagaaattctcatttccccttcattcagttctataaatccactcatcagttctctaacgaatcagttgtctgagaataagtcccagcaaaatttgctgaaatggccattataatctctgatcccttaattataacatttcctcttttcgaatatatgtttctatcgactggtattaatacattattggagttctcctttttctagtcaatacacagtctgacatgacaagcaaacaatactctttaaaacactgatgagagtatcatttccagaaattgtggacctgatctaaaaatggactcttccgaagaatgtgccactcttttcactgattctctctgactcacttaagcttcactatagattagttttgatctaatcattttccaagtaatttacccttaagctaagagtactcttagatttttttttttttttggcggcaaatatcacaatatgctgaatagatcttctaatgtaaatgtttgtagtacttttgttaaacattctgtttaacaacaatccctgaactagcctggttgaacccactcaaatattaccaagacctttcacagggtagttgaagaatgcttagcaactcttgtgtaagaaaaagaactcagaatgaatatgtctcttgtgtaggtcaagacaaatgtcagggccaataaaggatgaaacatgatgatggagatttgaaatgaagggctggggcaacaggtgcttggcatgaaacactgaaagacaggagagaagtgctgtgaggtagcaaagacagcactcttcctgagagtagacaaaggccagcctcaggcttctcatcaccagagaaacagatcttaagcacaaagtagttagaagacacactgaaatttggaacacttttttttttttttttttgtctaaacaggtcacacccaaagccccaaggaaacaacaggaatctatccgaatacgcagaaacaaatacaatagttttctcaatgtggtaaaacaaaggaaaactataaacaaaacagatacaaggaaagaacactaagatttctaaacacccccaatgtgaaagatgctttaattgacaagttccctgctttctttctttaatgctcattacaacactatgaggcagaattttcttcacagttttcaagataaagaatctgagtctcagagagacacccagactgtaggtggtaggccaggtctttgcacagagattttttctgatttcacaatttcatatcactctatgacatatattgagtcaatgacaggtgacttgtccttttcgatattaggttatttatttgaccataactgaataatgccaaagaggcttgagagacttaaatgtgaaaaggtactacattacttggatgtactacttaaattaataacttatgcatatttgaaggcagacattcaagtgtaatgttcagatatcacatctttcaaattttacaacatttacatgttgtagtttctggatgaagcattttatttatttatttatttatttatttatttatttatttattttgggacagggtccctctgtgccatccaggctggagtgcagtggcatgatcatagctcactgcagcctcgaccttccaggctcaagagatcctcctgcttcagcttcctgagcagctgggaccgcaggcatgtgccatcaagccttctattctatttttcatctaccagaatccagcaaacttcatatattattttcattactattgagggcttctaggtataacttcggtattctactttttgttttaaatttttgtttgtccatacctcagataataatcaaatcaagatgatccagtacacagttaacaaaacaattacaatgtccgtaaaatatcaaataaagactaaaacatatgaatatgttggtctgaaaatatatagcgtattcagctaatttttggaaaacaccagttgtatttctgtatcatcccaaatatcgccttctctaaagatattctcataatttataaagtgaaaattcaaatatctaaggtgaaatgtagtgtgataaatataggtatatgtgtattaaattcgtacctaggttatcattgcatatcaagatgaaaccacatttatctattttatatggatatacataaaatagatatgaacttaagcatttatctctccatttaagatataaacaaaatagataagaacttaagtatttatcttcccatttgggatataaatagatataaacttaagtatttatgaaagattcctttatatctacaatataatatatagattaaattgtatcacattaccaaccattagtaacagatgaggtgattttataaattatagaagggagaaaataatagtgggttttatggcccatataattccttttagggtttggccagactagtgactaaacaagtagaagcttatagaattaattaagattgtatatatactattaaatgtcgatttgaataggaatgtttggttaaaaaagaggtgattaaaaaaagtcagcaggacatcctcatcaagagtgattaataagaaccacagccatgtgcaagtgaccttaacggaagacatgatgtcccctgtccagctatggacttctctgatgcagtagggaccttcccaatggcctcaagatagagatgattatatgactgaagggatgcactgatggaagtataacctctccactggcaagaagaaagtaaggcagtgttaacaggacacctagagcatgccaatgtaagttcctcactcctttatagattgtgtggcctatttttagtctaggcacctgcctctttccccctctacttatcatctaccctgtgcataatgagaaatgtgagaagcagcagtaaaacaagtttttctatttggccagaaaaataggtttaaatccatttattgtctcagtcacaaccaacatgaaagtatgtaaataagatctgcagtaattttttaggccatgcagcaacttttggtgaacattaagctagttagtaataatttttaatgtgcgaattaatctgtatatgtctaagtgacatccaaccattagctagtgtataatgacagtcttcatgttaactaatatctcttttacacaaagtttgcagaaagctaatgtgctgttctgaacacacactattctaatatcaaacagtgaaaaagatttaagtagaaacgcaaaccatatatatatatatacacatggttacactatatatatatatatacatggttacactatatatatatacacactatatatgtacactatacatatacactatatatatacactatatatatatactatatatatatatatatatatactatatatatatatacacacacacacaaaaaaaaagaacacttaaagtcttcatctcaaaactcttggttacaacactctgtacacttcccatccccataattgttactggttatttaccctgtcgaaagtacttaaaaataaaattttgcttaagaagaaaattcatcacgaattattattgtctttttaatggtttatcattatacaaagttgatgtttggcaaaatgattatagaaaaactttattcccagcatcttccttatctttaagtcattttatacccaagtttctatccaggatcccagtgtattattttcattttcacccgaacatgcagtgtatttcttgtcatgaaagcaaaaccttatctgttcctttcccatcccttcctttctctctgcaagatgacagatgaataaaaattatttgcagcaaataagtgtgaagaattcaactggatattgtgctaccatttcttggtaacataccattaattagagtagatcttctcaaattgtagtaatcatcaacatcactagagggatacttaacacacaagttgctgggccccacccccagagtttctcattcagtaggtttcaggtgaggcccaaggatttgcatttctaagttcctggatgatgctcatggtgatggtccattaagaatggagttaaaaatgtaatacagtatggtagattaggcagtgaggtatccgactaatcagcagatttgctgtctcccctcattttataccaggtataaaaaattaaggccagtccagtagctctgcacttaatagaatataaaaatgttgttttaaaaactcttgctttgtataacacaaaagcaagcaatataaaacaaatatttttccgaagcacaaaaacaatcttacctgaacttaattacggcacttatttgttgctttaatcgggttacctagaacatttagccttttaagattttgccatagagaaaattttatcccatattcttccatgtgaactgttaggtgtcttctatcatttcttgcatattcttgcacacaaacacaatcatgcatacatgtaacttctgattcttacaattggagtaacactatcaaccagaatacctaaagttcaatgaccctagactgtttcccttacagaataattttggcacataacaaccacctaataaataaaatatctgaaaaatgttcatattagcctaaatttctaccattttgttgcactttcttcaattcatactcaaaaaaattaataacttttgaatgagtatgtatttttctaaacaatcaactcattctcttaatcacttattaattatccatttgtactatggcaaaagaaaatctcacagcttctaggcaaagtgaataataatattcttgaaataatagtgttatattttggtatgcacaagttaaacaactgtcacaatcttaagtaatacaagttatgcacttactcggtatgaagtatgtttaaatgtggcataattttgattgattaaataattctgctctaataatttagtagtactggtattaaatgtgaaaataaataagggaactatttaaagactaattctctatgtggaaagatttctcaaacagcacatcttatggaataataacaagattccagtattatacaaaagtttgaaagaaatttattcatttttttctttactataatcagagggaaatcatgatgaaaacacaatgcttcctatgcaggttttaactggatcatattacagtatttttagattcctaatttcaatcgttcaattgttctctacacatttcatttccaaaattctttctcctatcattatttctatataagtagcaatttagtaaaaaaactccattcttcagtaagaaaactatctttgaaagaaataaaagtgaaaatgttgatgaaggaatctataaattctgaacaatttgcattcaccattatttcatcaactctatagcaatcatgtccaaaataaataacacaatcagtattcctttcttcacccaaaatatcccaattttatttcatatgtctggttaactataaagctatgtctaacttaaaactagaaatttaatatccacttcaaatataagaaacaaatgatttcaatattctgacaacattcatcttgctttttgttatattctaaggacatatctctaaactgcttaatttttcaatgtcaataattattaccacttattgtactcaaagtacatataaaaccactacaggtttggatgcaaaatatatagattattttaatttatagtaaattaaaagtgtaaactcctttatcctacagttaggtactaattatttactaattagctctctttttttttttttttttttttttttttttgagatggagtttcgctgttgttgcccagggtagagagcaatggtgcgatctcaataagcagctcattttgattacaggtatacatgaagtaaaattcatgaagtaaaattcattataccaaaaagcctcccacagaactttcatgcaccctgagctatgtgaactgaaaagtaacagtgggatagcaagaaccagcttacaaaataaattcctatcgagtgtttttcacagaaggatgataattttaggttgcttacatcatatatttccaatcttaatgagaaaaacctactctgatgatctgatgttattgaagtattctgagaaagaattgctgatgggatttagtgagctactgaataagagaaatcaaaactgtataaattagatatattttctaaaaataaggtgattgtgcagaaaactaaagattcatggaaatagatataacagcttggatattactaagcgctaatgatagttatctcattattgcaaggatttgatgatatggtccactgttcacctgaaaccaccaaacacagcatgtttcatatctcagttttcagtcacagagcatttccagagtttactcctgttcagctgagatacagtattatggtatccttcacactaaacttacaaaatctataaagaaaagcaagggcatcacagggcatcattgcttataaaacaaataaatcactgatatttaaatgccttagagtgttcctcaatgtaacaaatatgacagtaaccctacatatacaattgccttatattgataatgaaagcatatttgccattttggatatattccttacctgtcaagttctttaatccaagttcttgaagtccaaagtttccatcttttctgtagtttaaaaatattgccaaggcatatcgatcctcataaagttttgtcccacgaataatgcgtaaattctccagaggcaggtaacgaaactgattaagagccactaacacgtagcctgtgacttctcgaacagactgaaaagacacaaacagttgcctgtgttataaaacgaatttgtcactctgtatatgtagcaatttagattaaaatgagttattaaactctaattttcagtttttagtttaatacattattttccatatcatattctaaagaattggcttcataataaaagatcacaaagggttagaatctcatttgaagtataagttgtgtttcttttaaacagttatgaatgtgcttatactaaaatgatggattttgtttatgggaccttcttcatacctgagatttgaatatagttaaaggaataaaggtcttgcttatcaacagactacaataagttaaggacacacaaccatcagtcaaactttaaataaaaaagcatattggtgagcctaagtaaaacaaagccatgttagtttgtaaattgtaggataggtttaaaatggctctattggtgtttggtgctatatttatcaaataacaattgccctgtacatctctagggaacacaaacataaaaaacatgtattaaaaactaattgttgtggccgggcatggtggctcatgcctgtaatcccagcacttctggaggctgaggcgagtggatcatgaggtcaagagatcgagaccattctggccaacatggtgaaaccccatctctactaaaaatacaaaaaattagctgggtgtggtggcaggtgcctgtagtcccagctacttgggaggctgaggcaggagaatcacttgaacccaggaggcggaggctgcagtgagccaagattgcaccactgtactctagcctggcgacagagtgagactctgtctcacaaaaaaaaaaaaaaaaaaaaaaaaaaacctaattgttgtctataaattcattccaaccacatttttaatttttactgcccactgtttaaatttagttgtctataataagttaattatttgagggtttgtgagacattttaaagcaaaacagtgtcatgaagaaagtctgagtttcatctaaatattttttcaataaaatgatgataaatagttgtcagaatttaaaaaaaactaaaaatgataaaaaaaatactcaagtatttggtattattttaataccaatttcatgttattctaactaacccttttcatttcagatgctccaaggctgtttttggtacttccccccaccctgtctattctcactcccttggtgatcttattcagtttcaaagttggtgatctccaaacatttatctctatactttccccaaactccagatttatacccaactgtttactcaacatccttacttggatgtctagtatgcttttcagatacacctatcaatggctgaactcttttcttcctccacccctctggcagccttcctcatctcagttcaggttattccatcttttctgactttcaggccaaaatttcagtcatctttgactctcctctgacaccccaagtgtgatccatactatttgttctacgttcagaatgatcagaaactcaactacctcttacgtcatccatggctcccacctgagccatcatcattcctcatctaggttattgcaataggtctccttgagtctattcctgatccctatggtgtattctcaattcaggctagccaagatattttaaagacataaatcaaattacaacacttcagtgcttaaaactctgaaacatctcctaagtcactcagagtaacagacaaaatacttttactgatgtatcaaaatctttatgccattcagtgcaataaccactagtcatatgtgacctgagcaactgaagtgtagctggcataaatttagatgtgctgtaagtacaaaatacactctggattttgaagattatatgatgaaatgataacatttgagataaattaagttaaataaaatgtattattaaagttaatatcagttgtttctttttatcttcttattgtggcaaaacattttcaattacattttatggctcttattataattctgttggaactgcagtgtatgatctagtcatcagttctctttcacatgaaaagtatagttctaccttaaattgtgcattatacccttaaaaacctgagtttcctttcatcttgttatcttcttggcaaactccctcactaccttcaagtttttgctcaaatatcaccttctcagttgaggccaaccctgataaacctgttgaacactgtagcccctacacttttacctgcttcaattctcatattttcccattacttcttaccttctactacactatatcattcatacatttatcagatttagtattcgtaacctgtctctttttcccagaatatagccctataagttcaagcactttggtttgttaacttgtgtgtctcatgtgaccaggagagtggcagtaagaaaccaacaagtatcactccggcccttctctggccacacccttcaccactgtacaatgcctgtggagtgaagaaaaaggcccatttagattctgcactctccccttccagaccctgtgatcccagaattccctttgcaaataaccccaagtctttacccagaaactgtaatgtcatcttccccagttccatccccagagagcagattgtgccaccaatgtgcatacatttaggaaggaataggtggtccaggtgtcaatgtctgatgggaaactgtacagatcctggacatgtaggctagagtgttcaaaaacttgcatgtaagacctctcacaatacaggatagaagtgggtggaagagaggctatagactggagccacttctctccatgccaacatattcctgaggactccaaaagttctaacattgtacctggccatccaggttgttataaagatatatctgtcaaaatgggaaaatataacattttatttagtaatctctagttggtttataataaaaaataaaatatgtgagcctctattcagactctttccccccagtcacacaattcttaggaataagcatgctacaaataatcaatagaagagtagaatcctaatggagcaaaagtggagaggaataggaaagggatatatggaattactcatatctggcatcaaattgggaactctaagccactatgagtattcctaagacagtgagtgtcttggggtgaagggataaatgcctaggacaatagaaaagaggggtgaaactcagcagtgatatgcattgttcgtacacagcaatttgtttaaaattgcaccgcgtggaaaagtctagctctagggctctgtaattcctccttcaaacactgttctaatggttgagctgttacctctttgaatgcccttatctacctctttgagctcttaaagagagattatacatacattctgacatcatatggtctaaaaagtaaaattcattcattattaaaaagttttctttaaacttgaatacaataattatttagtgattagatcacaatgataaatgtgttgatggagggtgtattatgactcttttgcctacaacatatgataagatccatcattccaaaacaaacttatcattagcttccatcccactcaggaagtgactcttcttatcaaaaagtgtaaaatgtcattggtttatctcaagatggagaaacacatttataatgtcaacagagaaaacacagatgaagcatattcaggtaaaagaagaagtttatttgtaaaagagtaacattaatagtaatttttcagtgtcacttggcatggcatttggatcacatattaccacaagctgcaaataatctgcaaataataagtgctctagaatgtgtgataggtatgaaccaagaaaaatgctgaacacataaagaaggaccaactaatgcagaagaggatgctccaagtgctcttatttactagaaaaagtaaaatataactaagaaaatctttgtatttgcatattactaaatatatttatatttgaattaattgtgttgtaatatttacatacttctcatttcagggtgtgtattacattattctcagacacatgtgtcttgtcttcatggaaggtcagattaaaagcaatagctactcccttgtaaagattctagaactggagggatttgctgttataactgaggttctagtgtccaaaataagtctctgtcattattcattctgtttattaccctctgttcttgcaaaatagtatgcaaaaactaagcattagcctaacaaatatccttttcttatgtgaactctggacatcattccatgttaatgctgagaatgcatgtctaagccattttgaacaaggccacccataagttggtccatagtaaattattttatgataatgatagtgaagatcctatttatcttaattgttacgtccctttctctgacccagaaaaataatgtaaataatagaaaaaaaatcatagcaaatctctcaacccaagatgtgttgctctaatcttttatatgtagagggacacatggaactgaagcattttaaaaagagttacaggagataaatataaaattcttatatctaaaagaaacacatcatgccttattttggtctctgtattctggtattcatagtcacattctctcaggtattcctatagtctttctgtgaacaaatatcttgaaacatctcaaaaggaaactccagtgcagatcatgagccatgtgtactgactacaaataaaaacaattacaggaaacaagttaataatggtaggagtgcttaatgatgaaaaagagtaaataacgtggtttgagatgatattggcagatctggataaaaagtgaagagatatctaaaagcgtaaattatatgttataatgtctgataaggccacacaaccatgtcagttatccattgttcctctcctttcagccatcagaaagaatctcagtagcacaacattttccactgttttagaaaattttgagagaataaaaacaacttttaaacatatggacttatctatgggaaagtataacggtaggaaatgtgggcttgtctgccaggcaaagttggactccaaacctagcctttgtgcttactagctttgtggctttcatcaggttgcttaacctcatttagcctcagtttcttcatctttaagaaagagataccaatatttctattataaaaccgtaataggggttagaagatataagaaacctgtctggcaaatagtaagtatttaacagatgctaagtattacaaatattatctctgataatagccaggcagatgaactgcctgcagacaatctgagcagaaaaaaaaaaattataatatcattacataagaactgttgcttttaatctctctgttatgtaacctttggtacatttatatcttgcttatgcaatttgcaatttattcctaaatttcagaaatggttccttatactttatgtgtgtatattatggccctaaatatagactctggcgctgaacatttaataatggctgtggaatggaatggaatcgaaaagtggaaagcaatgcttaaggtctttttagatatcgttttccaaggaaaataattttatgaacttgccactaatacaaaacattgtttgaacaaaacaattatgaattatgtccaaggaccacagtagtaaacagaaattataacaatgccctaggggagggatagcattaggagaaatacctaatgtaggtgacgggttgatgggtacagcaaaccaccatggcacatgtatacctatgtaacaaaactgcacgttctgcatatgtaccccagaacttaaagtataatttaaaaaagtaaataaaacaaaataaaatctaatttctgagttactggcgatgtctttgatattaaataaaggtttttctccaaaaaaaaaaaaaaaaaaaaaagaagaagaagaatgccctagcaaagacaaaatcctgactctggttctggctcagtaacagtttagttctaggaagtcatcccattttgtcaaccaaagagtgaatatgctcctaaagatatatcttcctcctcatggtgtaagcttccgctcagtaaaactgattgatttccattgtcaatgtaggtttctacagttgctttgttcaagtagtaaatacaatcggatattattaaagccttgaatgcttcaaaactcttctagcccaagggacaatttgttttgcttatgacatttgatgatagaaatcaaaagataatggaaaacaaaaaaataatttcccataccatattagcaataagtccaggaaaaaaatcatgattttttaaaaatgacaacaaattttataagcatttctcctgcataatattctagagacaatgtgaaatctgcagttataaacctggaattttcaatggatgtccctcaatcaaagattagatgggacggtattggctcactgggttatccttttacctctagatcatttcagaaaaatcagtcttcactatttttacatttatgcttcattccacaactcttttaatagctattaatttttctgtatttgatataaatccctaattcttttcttcttagttgactttttaaaaaatttgatccttaatagaaatgaagactagttccttaaatgtttcttcatttaccttaagattaaagtgattacagtaacacacaattcctaaatatttaataagtgtttagaatgattttatgcacattaaaagcaattacatgttcctagctaagtatgtaaaactcttattcctagattttttcctactaaaattattcatcaaatccatgtttattacttatttttctttaaaattagcatctctttgaaaatatacctatccatttttgttaaaaccttctgtaatcagtcaaaaagatccaaattcttaacttctactccagtgtcttaagaactcatacacaattagatattatccacaaaaatgctaatacatttcatcaggtaagaatcaacaaatataatgctgattacttaaggtcaatagactaagtcaaataaacctgtagtatcacagagaagagtagggaacagagaactatggtggtaagagggggggtaatagaaagtcccttctgctggtaatgactgcagaatttatgtgttctctgacggtgacaaatgtagtagcaaattgtagcctctccatcagtaaagctttccattaaatttccctaggcaattaatttctgtccctgcccttcacagcatgtctgagaatatctaaagcagaaaacattcttaactatgacatagcatgaaaaagtttaccagaataaaagtacattaataaccacagagcaaacattacacatccctgctgcttgtagagatagtatgtttgctttggaattctgcgttcatttttcccattgtttttaaaactctaaggattgtgccaccctggcaaggagggactcaaagtctcatttaattagatttgaaaaaaaagtaagtaatgtgaaatgtcatatactgactggagtagagtggaattcatactacttacatactgcgtgaaataatactcaagaggtaggaaacctggtaagatcatcccaacaaactgctaactttcagccatttccagctagtctcttgggtgctagtgttgctatgagttctactttctaagaatctgcaggccatttcactcatcactggccgcttagccagctctcaacccatgacttcttagcagtgaacacctttagttccattgagaagaggactccttagctcacctccctagaattaaccatattttttttgtcctttatattttcctgagctggctggagggttaatagtcccccttcagatctctacattcccaattgattcttcatctcctgaccttatcaagactgtattcctgtatcatagacttattacactagagttaggtttgtaaaattaaattaaattggcccaaagttgtctctgtaccttgagtttctatacagcaaactgtgacctaattagtatataaacaaactgcaaactaacttaagagtatattctcataacaagtagctgaatctcagccaatcatagcagccaggcctcagtcaatcacaggctaccaactgatcacactatgtccaaataagacaaatgccacgctgtaacaatttaaactgtttctgcataatacttacttgtccatctataaattctgcctgttcacattgctgggtaggaatccctgaactactcctgatctgagtgctgcccaattcatgaacattctttttttaaataaactctgctaaatttaatttgtctaaagtttttcttttaacagattacacaaactaagttggaagctttggtagattcatttacataataacacaaactttcaattgtaagtatacatatttcaaaaaattcataagttgaagattctatcatctctaaagtgtgtgtgtgtgtgtgtgtgtgtgtgtgtgtgtatttgttttctacatatttatacaggtaggcttatattttgaagcttgtatttcaaatagacattttaataatctttaataactatttaaaatataatactgagttcaatttttttcctatcagataaacacattaagctccaatgacttggggaattgacttttaactgaaattagatacaacgcataaatgcaaaaatagtaagaatgtttggaaacctttgaattaaactttgtttagatatagatagagctgaagtaaaaagaaattattagttttcggcactttcgtacaactgaagctatacctgaatcaaagcgtcgtaatgtttattaacattgtccatatgatgatgagtattctccacagagagccaaactggttaggacgatgcagcctagtgattaaatttgggttctgtagtctcacaatcttagtttgactcctgtctccatcacttattgaccttgcgcaaattattcaatattacgttcctcttctgcacaacaggaaaaattcctgctaaatgctcaaaagttgaatcaacaaaagataatcaatttcatcatattataattagtgcaattatgccaaaatatttgtaaatattttgtataagtttaggaatggtaaacaatatataagcaaaaacatttaatattaaaattaattaaacaattggtactacatagctcataaagatatagcttcagtcagattatctattgttggctaaatatgaccactccctaaaataaatttattcatgtatatatttgtttgtttatgagacagattcttgctctgttgcccaggctggagcgcagtggtgtgatcacagctcactgcagtcttgaactctgggttcaagagatcctcccacctcagattcctgtgtctaggactacagctacacaacaccacaccaacctaattttttttccagtagagatgggggtctcattatgttgctgtggctggttttgaactcctcgcctcaagcaatactcctgcctttgcctcccaaagtgctaggatgacagatgtgagccactgtgcccagccaaacccccataatgtatacgctgaagtcctaacccatactacctcagaatgggactgtatttggagatagggtttttaaagaggtaattaggctaaattgaggttattaagtcgggccctaatccaatataaccagtgtttttcaaagaagaaaagatgagggcacagacatgacaagaaaaaagaccatgagaaaacacagagagaagttggtcatctacaagccaaggagagagatctcagaagaaaccaacgctacagagcccttgatctcatacttccagctccagaattgtgagaaaataaatatctgttgtttaagccacccagtctgtggtactttgttatggcattcctagcaaactaaaacactgcctaagttcacatcctagcttttagcagtattatgttgggtacattatttaacctttctgtgcctcaggatctttatctgtaaaatggggatgttaaggtctccaaatcctaggattattttgagaagtgtatctctatgacttgcttaacagaaggtctggctcatagctatcactcagtattagtttctattgtttttctgaatccagaactccttttcaatatgttccctgtgttgcacagcatatataaaactgtatttttctatttctaaaggaataactacacatcaccaaagtttagatgagaaaactgcttgctagcatttcaatgtacaattaagagtgacagtttcatgtctgaggtcttttataaatgtgatgttttcccattcaaaatttaacgaaagaaaatgggcctctatgaaattatggctgacaacagctgcctctgttgaaaagcatatgggaaataccctttgaggatgcaaaagttagaggtgactgattctgtgactagtctgttgttatttttaaatgaaaagcatgagcaatctcagaaataagagagccaaagtatcaggcctggatttgacaagcctgccaagacacacttcaatatctgtctaaatatttggccataaaaaacacaaagcacagccttaattaatttataaaaaaacaaatatttgctttagtcatctcctctagtgacaacaaggtctgatgttacttatgatgctcttaatattaaattcaaacatacgcaataggcattctatggacatctgtggatacaatcaggactacaaatataacaaaaattgaggccatggacttgtagacaagaaatttaaatgtttttcttatttaagtatccttatgcaagtcacaactttctaagtagctatttactatttcaaatagtacaaattttcaaataattacattaacttctattaattagtgttttctgtgtgtgaggcattcttatgtcttctgtcacctactggtgaaatcactctgactattacctctgttttataaatgaagtaactgcagtgaaataacttgcccaaagtcatatagacaaaaagtgatggaggaaatattaaaacaacaacaagatcgctcttattcccaagatcaaaatcccaatccctttgaagtattttttcaaaaagtggtaccaattacttccttggttaaagtactatccacggcaaaatggtctaaaattttgatttaagaataacattctctttctaaggtttatttatgagaaaaatattagctaagaaagagtaatttctcaaaagtaactgcagcatgcttcagatatttataactgcaaaatctgctttaaaaggtactttaagtatcctaaaagtctcaaaatcagcattctcttaggtgccttctcttaggtgccttctcttagatgctatctgaccttttcaaacatacatagaatcaaatgagattctgttcataaattaataatgcaaatataaccaaacaatcctaacgtaaatgtatttttaaatttgcacttgacttttcttcctcaaaaaagtctttaagtctctatgctttcaccctcattcatccatccatccatccacccacccatacatctattcatccttccagccaattatctattctacaaatgtttattgtccccctctatttgagaaacattgttcaagttgctggagacacagtggtgagcaaaatagacatggttcttaatcttacggtggttacttcctttatcatctccaatcttcgtctaatgacaagattgccactaagaaaatgatggcttgccaagaaagatttacaataacttgcaagtgaatgcctgtatctttgtttctttaagagtaaaccatttgttttaaaattttatgcattgaacatctaatcttattataaagctacctcattttctggtcatacattggcaccttccattttggaaaaaaaaatgcatttttcttttgacataattgttacttagagaggcactttgtgcctatgtttgtgtgtttgtcttcaggactttcaagtaaacaacttaattatgaaacatttttctctatgtttcccctctataggaattttacagagaagcaatcattatagtaccttctaaggctgcatatagattacttgcaaggtataaaatatattgattttaaatatcttcttaaaatatcacctttttgcctattttggtgtcattcattcagcaatctgtacttgtagtatattcaaagctattccttgctctggggacatggagatgtataaaacatgacctggccccttagtagtttacaaccactgtgaaagacaaacatggaaaggagcaaaggaataacacgtttaagatgcaacgatggaaccatgattaagattctgaatattagaaagtaatgaagaccataatgggggtatcgacagcaccctgtgtgtacacaggggtgaagtggatacatttgcctgaggaatattggagaaggaagttgtaggaacagacaattgcctaagttctgaaaggttgttaagtgttccacagggatttagcacctagattgtggtcttaaattatagttttacacaaagagaaaccaggaattcttggagaaatttcatattctaggtatgggacaagaaatagataagatgagcctgaaacatcttatcatagcagatagtgaggaagctatcaaaaactactaagttcatgtcaaaagggctcaagaaccaattggaagagacccttcctggccaatgatgaggtaacttaaatttcaaaaataattacaactgattataatccataaaatacatataaacctacgagttcataataatattcaatgacataaatttctcatctttggacaataatagaggaccaattcacttttttgaaaatgtatgtaaaagaaaataagcattcatccttttcctttatgagttgtaacaccaggtaacgaaataacagatgaaaggtagtgccttagtctgttcggtcttctatagcaatttaccacagactgggtgattcataaatgccagaaatttgttactcacaattttggaggctgggaagtccaatatcaaggtgtcagcaaattgagtgtcttgtgaggacccactccttgaggccagtgtcttgctatgttttcacacagcagaaggggcaagggatctctctaggttcttttttatagagtcattaattccattcatgaggagtctactcttatgacttaatcatctcccaaaggccccacctccaaataccatcatattggggattagatatcagtctgcatcaggcactatgtcttgtaaggtgttccaacgaataagtgaaaataattttaaaatagtatgaaccaattttgattcattaattgtaataaatgtgtaccataataatgtaaggtgttaataataataggtgaaactgagcataagctatataataatgctgtattttcttcacaatttttctgtgaacctaaaacttccctaaaaataatatttatttttaaaaattggagcattgccactctgaaagtctttatgaattaatggttctagatattcagcatcattggctagtaattgcaaatgatatcacaataatagagaaaaaaatgatgggagacagttctgcattgttcctgcattggtgtgtaccagcttttcttcagacttatttttttttccaagaatgtttgtatagtaagcagcattggaatagtaagacagtttctccttccagggtggagggcagatttgttagcagccctttttataaaaatggagtttcataagctcagagttctgcaactgtgacacaaatctcttttgatacagtatcgacctgtttgtactttccaatcacttccatgggacttgcctcaggggcaatgggaacccatgtaaacatgaagctcatgctgactgctgtgccattgagtcttgtgtcttcttctaacacaagtgacagactaacttgttagcttgcaaacactctaaaatctcagacatttgacattcttgacaacaacaagatattacgtgcctcccactgaatgaacacaccaccacctatggtttcatcaaagagactgaatgtaagtattataaagtctctggatccagctgccatttgttggaagtacaaaagacagagaaacatggtgaatttgatcatgaatatgcaattaacaaaacctagccttcagaaaattctacagaaaaatgtcccaggtgtttgaataggtaaattataagaagagggaaaaaaggaggaggaggaacttatgtcacatgtcttaaaggaaatttggaaaaaatactttaaaagcaagttatagtgtccagggatgcatacttgggtgataaaactataaagacatacaagaaagcaatttctatacaagtaagaatggtggttacttttggggagaaaagcatttgagattgggatagggcacatagtggggtttctggggtgggtagcaaagctctatttcttgatgtagattgacagttacaaaggagtatgccttttccaaactacttaagctatgtattcattttgtgaagttttcaatatttgtataatgtttgcttatatgtttgcttatgaaagtataaaaataagccatcaagtggaaaaaataagaaaagacataaaaatgtcccttgccttttcacatctctccaattgatatatgaaatcagaaaccaaacaatttcatatgcatagtgttccttgctatcaaattctctctattcatatgcaggaactgaatatgttagtaagaaacatttgcacaatttaggcagagagaataatatgtctaatgtcaaagtgtcttgagagagcctagtgttgttcacaggtctaagactgctgaatggaaaatgagtcagggaggagagggacttgattggaaaaagttaatgtaggagtctataattttacaccaggcaatggggaattagtggcactgtatacagagaatttaggctttgatttattttgtagaattatgttcttagttgcagggtaaaaatggagtaggttggtgagaagctggtggagagagaaaagttagaaacttgttgccaggcaagagatgcggaaggcagtgaatacaaattagatggctctaagatccaagccatctttttgaggtggaatacaaaaatacttcatgacttactggatgtgggaattgaggaagaacaagcaacaagaaatgactgaggtttttagcttgggagacttggttgatggcgctttaaaaaaaccagtataaggaacaagtctgtggaattttcccaagtactatatgaactttcggttatctgatgttaaactaacaccttcttttttacaaattcttttaaatgacattaatatctgtatatctgttaaatatggatagcaggtacatgtacctaatatgtttttctgtgtgcttaatatgtttttaatcttcaaataaattatgttagcacctgtgatttcatatatcttgatgggtgtcaggttataatattgttcacataggtccaaaacagtggttctcaactggggtgttttgctttccagaagacatctggcaatgtctggagatatttgtggttgtcatctttggtgaggggtggagggtgatactggcatctagtgggtagacatctgggttgctggtagacatcatacatgcaccagacagccctttcttcccacctcccacacccaccactaggcaaagaataatcaagtccaaaatgtcaaggttgattgacttattaatttgaggcaactgtttaattttatagcttgtagagttgccttagtggttttctaaaagtaataaaaacagtgcctgctagtataccatcaatacaatccataaaatatgtatacattatgaggaaaatttaaattaatattcttgtattaatatatatttttctaacctgaatttattattgcacatattactggatggacagtggatggatagataaataaatatctatttataagggtaaataggcctctctccctctctttcctcttttctctttctctctgtttctctctccattgtaacctaattttgcagtagcaaaattttctatgttgatttgattttttttcattcactgtttaaaagcttgcctaatacaacttggggatattaaggctaagttgttctatttataagcaaatttataaacaaacaaagtcagtcatttcctttataggcataattcttctttaatctctgagaaagtatcttttgtttgaaagaaaggttatgttttatagtctccaacctgtacccagtaaccaaactattttaaacataaaaaataacaatgtctcacagggaggaacaaatgaaaaaatgaatagtctctttgcaacttgttacaggtacagtagacaaatgcttgtgatgaactctttagttattgtattccctgaaaggaaactggacaaagacacatggtatttctctctcctgagtcaacttcatcacctttctcttgggaagggatttatcaatcatactagacttcagcagtggttaacaacattggattacactcccagcggtgaggtactaggttcatggtatgctcattaacacaagtgacatcaatatcccctcctcttctggagaatgaatggggatattgacttctcattccaatcctcttcatcaacatcatcacagcactggtattttatatgcatactgcagtttacaaagccatttcatataaatatcacatttaacctccaatcaccattttctgaagcaatttgctaactttcaacagatgttttttcggaattacgttaaactagaaaatgtattgtggttttaagttcatgaactacaagaatattcaaaaggaactgatgttaataaaaataatgacataggtgacatttcatttaacactcttgaatttcactacggaataaactttcacctctcttgtctagaacttgttctcttaatcctccattaatttccttaagcaggttccagtactaaaatctgatataatctctactagctgacacacagaaataaaacttaaaaaataattcatgctaaggtctatttagctgacacagttacctcaaatccctgttagaaagtgttagtgtacaaaaagatagataaaacaaattaggtcatggggattaagattctacaggacatttttctactactcaaataaatttctgctactgtaattgaaaacactagaaatactatttttttactatcattattaccactcttagaacattacttttatgaatacctactatataggtggcactgtgctcactgttcttttttacttagaatataaaatttaatgttattatttccatgttaccttttaaaaaatgcctaatttgatttgttcaactataggacagttcctccacacagactattacctatacggcacaaacacaaggcctttgttgatacatgattacctaatttgtataactaattgcctctgcaataccatgaaataatgtgttgacagcgtcgtatcatgaaaagaggaaaaaataagaaggacagcatgtgaaagagctttgtgcttcaagggtaatactgaaaatattatgctttttgatattagaccaatattctcagtatgttactgaaaaatatcttctacagaacttaggaaatgtgtaaaagtaaatattcatttgataaatggaaatagtttaaatcactgacaataattttaataaaacatgaatgtaaaagatcaatataatctatattcattttttaaattatcataaacatataaatatgccatcttcataaaagatttgcctgatatagtcacatttgaataaatgctctagtgttgaaagatgcttgcctaagtaacatctccactttcttctattttacttcaaagaccggagtacaagtaaaccaactaaaattaaccaagttgttatatacacaatttttttatgtgctaaggtaattcaaagcagaaaatgaaagtagttgatactatttccagaggaaactagaaaaataaaataaaataaaatagtaaaacagaatttgagattctgaataattgatctaacattgacttgaaaagaaaatccttctcacagaacatattttataattaagaaggccattgatttctatatatttctataaacttaaagttatataatgctttacctttatttatatatgaaagccataaaatacacttgtactaaaagaggaaagggcaaagcatatttatctttatcacatttgagaaatgtatgtcaatttttaaaaatatttcaatatggttgggcacagagaatcatgcctgtaatcccagcactttgggaggccagggcaggaggcttgcttcaggccatgaattcaagaccagcgtgggtaactcagggagaccctctctctacaaaaaaatgtcaaaatttagccggacattgtggcacatgcctgtggtcccagctacccaggaagctgaggtggaaggactgcatgagcccaagagattaagactgcagtgagccgttttcacgccattgcactccagcttgggcaacagagtgagaccctgtcttaaaaaaagaaaaaagaatttcaatattattattattattattttttgagacggagtctagctctgttgcccaggttagagtgcagtggcacgatcttggctcactgcaacttctacctcccaggttcaagtgattctcctgcctcagcctcctgaagagctgggattgcaggcacccgccaccacacccagctaatttttgtatttttagtagagacggggtttcactgtgttggccaggctggtctcaaactcctgacctcatgatccgcctgccttggcctcccaaagggctgggattacaagcgtgagccactgcacccggacttaaatttgtttaaaccctaaaatgaaaaagattaactatctctcttagcaacaggaagctaaatgatttttctaatgttagaaaacactctactttatactggtgtttatataccattacatgtttatttttaagtctatatattttaagtattatattaatctttttgaaaatgctacttggaaaaccaataccctgtagttctctagaggcagtatagcctttagaacacattttactcaatttcctctgaactttattacattattatagaaaagacagatcaaatgaatgcccatggagataaggtaaattttagtgtcattactacccaagttgtgtataattttatctacttcacacaataggtcaggagcttcaggtgagagaatatgtatctcttttttataatggcaatgtcctctacagtgcctaacgttatactttatatataatgtggtaattattaaatatttattaaattgcattaaatgggctgaagatcccatttataatcctgaacctcttacacttagcgtacttaaatgacaaatgcctgaatgtttttttctgagtgaattctacacagaaacaattgctcaaaatcttacctttgttgaatttgttcaaaatagaatactccattccctcatttcctcattcagtaagtatttaacgaatgcttgctaagtgccaggtttgggctatatttggggaatatctaaatgaataaaaccaaaaatctctctaaaaccttgatatgtaatagggaactgcaattagtatttaagaggctttacttaagatagaaaatgttatgtaaatttcatggaaaatggtaaaaataaacaattttgagaatttttaggtgacatatttcagcaaattatgatgcaatcagagaaaacttaggtattttcatttccaatcttttaattatcattggtaagtgtggtggataaaatgaagagttactcaagaattagcaacatcttaaaacttacgagaaatggccccaagaatgatgactttaataaaaatccaacagtaaacaacaccctgtgaaaggaccaaaattagattcactaataaagaattacatagaatatatatgcaggttattttgaagattataataaccatacaatgcaatggtatcaagcatcaatgtgaagggtcaagaggaacctaagttggcataatctagaattcagttatattgttttttcattgaattataacatataatcttattaatttattcattagttaaaattctgcaggtaatcattacacatagtatatattattttatatcctttttgaacagtatgccaagttaacagtacttaagttaatcatttagaatacgattatgtcttttctctgtggggatgttaactgtataaaacaaggtagaatctagcaaagtatcaaacaatttttattgaaactgcatttagactacatagatatatttagtaacattaattacatttttaagattcatatcttctatgtagaatattcatattaacttacatactaaagtaatgtaataaacttttcaaactactttaaaaagccattttcttgggcttttcccttcaaactgaacattctttcacttttttcatctcacaaacttgtgattccaaactctttaggcatcattggtttttcagatgtacagcacaagcttcaataaaaacaccctcaagttttaaccatgaatggtttaggggcatagttcatgaaaatcatttttcttgttctggatagtgaagcaaatgaagcatcatttcaagaattgcttggccagtttccaaatattctacaatgagaaatattaagagcatatgttttaatgcagatttcagctgtgaccaaataggacatgattaagataaaggcatttttaatgaatcaaagcagaatatgaaatacataaaacagagattgtctcagactacttcaccctatcagtttcttattgctttaacaactattatttaatccaattgttgcagatatattttatttattgctctgttctctttttattcatatgtactgaaaattgcaaagcataaactgaaaatgaccattggcttggataaagtcataaagtcataagggaattctatgtttccagatcacaatacctattaaagtaagtaaaatgagtcacttcttacattatgcattttcttcttttttatttcagccatatttttattggggacgggttacatttatgtaccagtgcataagtagacaatgatgcttggtgactatatcctttttattttctaccctctcttctcctgcccttgctctcttcaatttgcaaaaggaatatcattacaacccattgaaggacctattcaaattgaacccaaattcaaattagtaatgtacattttctgaaaaatgaaagaatttaagattaagttttacttttttgccacattagttacataacaaatagagaataagcattaaaaaccacaggacacaaaattcttgaatcaaaacagagatgcagagaagctttatatctaagtcatactgaaggtagaaagtaaaataaacatgagcatttttaaagtgtataaaagcataccccctttaggaaagcagtgacaaaagttaagacaactgcaaatgacaccagtaactccaataaaggaaaaaaagagacattatatgccgagttggatgcacagaagggtctgagcaatgttaggaaaacaggatccattcagagttgaatagacatatctctttgctgaaaaaacgttccaagttcttcaatgagaaaagcctgaaacactgtacataatctatggtttatcatatgtaataatatttatgctaattgtatagtgaactacatatacatactttttttcttacaagaatggattaggtctttctccacataatttatgctttaccgtatttataaagttgagagttgcagaagctctttaagtgtggttgaagatgaacatctgaattgaatactaaagcagttcttaccctattacccagcatggctttaaggctgggaagggtgctctttatgcacagtttaagggcattgcttaattagacttctctctggataagtttcaaattttttatttgcattttaaaaaaccataaaataggtatttctgtggggtcagtggtaatattcccattgtcattttttactgtgtttatttgaattttctctttttctctttattagtctagctagtggtctatttattaatttttttcaaaaaaacagctcctggattcattgattttatgaatgtttttcatgtctctctcctccagttcagttctgatgctggttatttcttgtcttctgctagctttgggatttctttgctcttggttctctaattcttttagttgtgatattatgttgttataataacttcagatctttctaactttttgatgtggtcatttagtgctacaaatttccctcttaacacttccttagctgtgtcccagacattgtgggacatggtatctttgttctcattagtttcaaaaacttcttgaattctgcataattttattgtttatcatgtcattcaggagcaggttattcaatttccacataattgtataattttgagtgaatttcttagtctaaatttcaaatttgattgtgctgtggtacaagagactgtcatgatttcagttcttttgcatttactgaggagtgttttacttttgattgtgtaatcaattttagagtaattgccatgtggcaatgagaagaatgtatattctgttgttttgtggtggagagttctatagatatctatcaggcccattcaattaagtgctaagttcaggtcctgaatatcttaattttctgtcttgatgatctaatattgtcagtgaggtgttaaagtctcccactattattgtgtgggaatgtaagtctcttcaaaggtctctaaacttgctttatgaatctaggtgctcctgtgtgggaagtatatagatttacaatagttagatcttcttgctgaattgaattttttaccactatgtaatgaccttctttgtctttttttgatctttgttggtttgaagtctgttttggtaaaaattagaattgcaacccctgccttttttctgttttccatttgcctggaagattttcttccatccctttattttgagcctatgtgtgtcatagcatgtgagatgggtctcttagaggcagcataccaatgggtcttggttccttatccagattgccattctgtgtcatttaattggggcatttagcctatttacatttaaggttactattgatatgtgtggatttgctcttgtcatcatgtttagctggttattgtgcagacttgtttatgtggttgctttacagcatcactggtctgtgtacttcagtgtgtttctgtagtggctactaacaacctttccttttcatattcagtgcttccttgaggagctcttgcaaggcaggtctggtggtaacaaattccctcagcatttgcttgtctgaaaaggatcttatttctcttttgcttatgaagcttagtttggtcatatatgaaattctgggttataatttcttttatttaagaatgctgaatgttggctcctaatctcttctggcatagagaattccagctgagagctctgcagttagtctgactggcttcccttggtagttgatgtggcctttctctatgctcataaactagaaaatctagagaaatggatgaattcctggactctcccaaaactgaaccaggaagaaactgaatccatgaacagaccaataatgagttcttaaattgaggcagtaataaatatcctacaagcaaaacaagcccaggaccagatggattcacagctgaattctactagaggtataaagaagagctggtaccattcctactgaaactattccaaaaaattgagaaggacctcctccctaactcattctatgagaccagtatcatcctgataccaaaatctggcagagacacacgcaaaaaagaaaacttcaggtcaatatttttgatgttcattcaaaaatcctcaatgaaatactagcaaactaaatctagcagaacatcaaaaagcttatccattatgatcaagtaggcttcatttccaggaaacaaggttggttaaatatatgcaagtaaataaatgtgattcatcacataaacagaactaaaggcaaaaattacatgattattaatatctcaatagaagcaatagctggaagcattccccttgaaattgtcacaagacaaggataccctctctcactcctcctatttaatacaatatcgaaagttctagccagggcaatcaggcaagagaaataaataaacaaatagaaagagaggaagtcaaactacccctgtttgtggataacatgattctatatctagaaaaccccatagtctcagcccaaaggcttcttaagctgacaacttcagcaaagtctcaggatataaaatcaatgtgaaaaaattattagcattcctatacaccaacaacagtcaagctaagaacaaaatcaaggaagaaactataatgccacataaagaataaaatacctatgaatacagctgactaggtaggtggaagagatctacaaggaaaactacaaacccctgctcaaagaagtcagagatgacacaaacaaatagaaaaacattccatgctcatggataggaagaatcaatatcattaaaatggtcatactgcccaaagcaatttatagactcaatgctattcctattcaactaccattgacattcttcacagaattagagaaaactattttaaaatgcatgtggaaccaaataagacctgcatagccaaggcaatcctaagcaaaaagaacaaagctggaggcatcatgctacctgacttcaaagtatagtacaaggctacagtaaccaacacagcaaggtaccggtgaaaaagcagacacatagacaaatagagaacagaatagagaacccagaaaaaagaccacactcctgcaactatctgatattcaacaaaggtgacagaaacaagcaatggagaaatgactcctgattcaataaatggtagtgggataactggccagccatatgtagaagactgaaactgaacccattccttatgccacatacacaaatttattcaagatggactaaagatttaaatgtaaaacttgaaactatgaaaaccctggaagacaacctaggcaataccatttaggacacagacacaggcaaagatttcatgatgaaggcacccacagcaattgcaactaaagcaaaacattgctaaatgggatataattaaactaaagagtttctgcacagcaaaagaaactatcaacagagtaaacctacaaaatgggagaaacaacctaaaaaatgggagaaaattttgcaaactctatatctgacaaaggtctaatgtccagtatctataaggaacataagcaaattgacaagaaaaagaaaacaaacgaccccacaaaaaaaagtgggcaaaagacatgaacagacacttttcaaaagaagacatatgtgtggccaacaatcatatgaaaaaagctaaccatcactaattactagagaaattcctttttttcttttttgaaatggagtctcgctcttccacccaggctggagtgcagtggcgggatctcagctcactgcaagctccgcctcccaggttcatgccattctcctgcctcagcctcccgagtagctgggactacaggtgcccgccaccacacctggctaattttttgtatttttagtagagacggggtttcaccatgttagtcaggatggtctcattctcctgacttcatgatccacttgcctcagcctcccaaagtgctgggattaaaggcatgagccaccgtgcccagccgggaaattaaaaactaaaaccacaatgatatatcatctcataccagtcataatggctattattaaaaagtcaaaaaaataacagatgctggtgaggttgtggagaaaaaagaatacttatacactgttggtgtgaatgtaaaccagttcagccattgtggaagacagtgtggcaattcctcgaagacctaaaaacagaaataccattcaacccagcaatcccatgactgggtatatacccaaaggaatataaatcattctactataatagcacatgcatgtgtatgttcattacagcattatgcacaatagcaaagacatggattcaacctaaatgcccatcaataatagactggataaaaaaaatgtgggacatgtacaccatggaaactatatagccataaaaaagaataaagtcatgtcctttacagggacatgaattaagctggaagctatcatcctcagcaaactaacacaagaacagaaaaccaaacaccacatgttctcactcataagtgagaggtgaacaatgagaacacatggacacagagaggcgaacaacacacactggagcctttcagagggtggacggtgggaggagggagagaatcaggaaaaacaaccagtgagtactaggattaatacctgaatgatgaaataatctgtacaacaaacttccatgacaaaagtttacctatgtaacaacctgcacttgtactcctgaacttaaaagctttttttttaaatcataaaatttgagcttttattgtcagtgtctctttatcttcataattccagtgcttaagatagttttagagtaatggtaaaaactccatgcacatgtaaaggaagcaagaaagaaagaagggaaggatggaagaagggaggaggtgacatggaagaataaaagaaaagagcatggtggaataaccctgagctccttcctaaaaccctcagttgtggttcaaattgtgtcaattagccatataacctgggtaaattatccaaaccttcttagtctttcatctctaaagtggaggaagtcttggagtccacagcatctccaagactccttccagttttaactctactgtaagaaatctttattggccaggagcaatggctcacacctctactccatatactttgggaggctgaggtgggagcatctctggagccctggaggcagaggctgcagtgagccaaggtctaagattgttccactgcagtcccacatgggtgacaaagtgaaacactgtctcaaaaaagaagaaaagaaatttttctcatcatagaaaaatatccatagtagtttaatgtttgctcatctaaataatattttaatcatgcagaatataaatattcaatcactgttgaaatacatgcattcatgggatccctcataagaaactaatataaccagatttaatttttaaaaaatattcttcataatgctcattaaacttgaatcaagaaatattatatccatcacttttttttttgagacagagccttgctctgtcactcaggctggactgcagtggcacaatcgcagcccactgcagcctcaaagtcctggctcaagtgatcatcccacctcagtctcctgagtagctgggactacaagtacactaacatacctgcctaatttttgtatctttttgtagatatgagcttttgccttgttgctcaagacaatcttgaactcctgggctcaagggagctatccgcctccaccgcccaaagtactaggattacagccatgagccaccaccgtggctcccccacgcttaaataactggcattaaggaaaaacaattatactatcataacctattctagtgttgtccaatcaatcctgacctgattgattcaaaggtacaaaattgttaagtgtagctttacattgttaaagctacagtttaataattattgctccacagtttgaattttggagctatagctttctttcttcaaagaacaacttcacttggaaagacatatggttaaaagaagagttagatgacagacctttcagaaggacaatttataagtaaactacaagtttacactcggcgaacttagttcatattgtttcaaattatatattttgaagggtaagctgatttgctactaaggaggatattctttggcaatttatcaatattagaatgtcttacctgagaatttatgcctcattactttcattcatttacgtcttgtatacaatttttcaatatgtcattagtaacagaattcacaggaaaaacatcttataaatgccaatgaatttattatcagtacacatgccaatctccaaaaaaagccagtgtttgggattttaaaatacattattttcaaccaaaacattccctcaagaagaagcaactggtcaattattctttactaatattattctatttaaatgttatcctaacattattttctgtacttaaccagggatgtttaacaatattttatttaaataattcttgtataacatattcttaataatgcaaaccattatagttcatttcattcttactatgttgcactaatctgtggaaatgggcagagaagttttattttcttctattgttgaaattaaagttaactcatgggaggtttacacatttacataatatgttctttgcatcagttattccactggaattttatatccaagctgaatcaattataatagataaatctgtaataaagtataactctaaaccagaatttcatcacccattctctggggaatgaggaaagatacctgaggccaaatttacttaattgttcagtgataaagactgtgtttaatcacagactgcttcaaatgaattcccgatagttttaattaattagcttcatttcttgttcattcacagaattgaaaatattttacattatcttatcttagcttaaaagtcaccacttattttattgtgtttttttcttaagttgcatgatatcatagagttcctacaactgggaatggaaggtgaatcaagatctatagaggttactcagaaatgagtgagccattcacagcttcactgctatgaaatttaatcaaaatcaaattaaaacaattaaatctgcttcaatgatatatatgattcatgccctgctatttgctcttttctataactataaaatatatatatttatttttcatcttgtcaatgatatcaaatatcatttacattataaaaatcagttgtacaaaaaatcatatccaaaataaaaccagttttagccaacaagtccgaggcaacatctacaatggctaagctaaaaagaatttaaactcagggcaagcatctaaaaataaattatgtatatatgacttacacgttgcaagaaaagagaataaacagactgaaggagtaagaaaatatcagtttctatctgtgtgatcttagaaagttgcttaattccactgtaaaataaagatgttaaatagtgcctatacatataaaaatgttaatgacatctttatgtaaatatgatttaagatggtatgattgtcaatacaatcaagaagaaagggaagaagatgcaggaagaggtatattccttacaaaacccagctgagatagaaatgacatcctatgtctcttcccctatggttaataaactgataagtgccagtgggcatactgcctgacacaggaggcaacttttctgaggtggatagagaaattgagccttcataacatgatttgcaccctcaacacagagttaagttggaagtctttcccttaaacttccagctataagaatatgtccctttttggcttgaaaaagaacatgagactgtcagaaagaaagatgatgaagtagtcttgtgtattacatatattaggtttgtaacttttagccaagtcctttgctaaaacaaatctattattttttgtttgtttgttttgacaactttcccaattctttgccgtaacttctcagagtgccttttttccctcttggcactttctcttttaggccttactttgttaagatattgactttaaaaaaaaaaaaaaaaagtaacttggctgggtccggtggctcatacctgtaatcctagcgctttgggagcccaaggcggtgagtcacctgaggtcagtagctcgagaccagcctggccaaaatggtgaaaccccatctctactaaaaatacaaaaaattagctgggcgtggtggaccagctaattttttaaatagctgtaatcccagctaccctggaggctgaggcaggagaatcgcgtgaacctgggaggcggaggttgcactgagccattgcaaccagccatgccattgcactccagcccgggcaacagagcgaaactccgtctcaaaaaaaaaaaaaaagcaacttgaaaagagtactcagttagaggttataagagcaaagaaggaaaatatattcatatttaaattatttaggctatttcaaacatgcctatccatcacacccacaatgcaaacatttctaaaaacagtaaatattcatcttgctgcatcctagatgtataataattctcttcacctattttacttaataattctaaattgagaagtgtagtaggcattttgtacagtgacatttagtctttatggtccctgggcaccagaatacataaatttccctcactatgaaagagactgcagaattgctccctgggcatttcctagcctctctggcagttgggtaagtgcagggcaattgaacatgggtgaaagtgacttgtgtcacttttcctatttgggatcctctctataatttccctagcaaacagccaaacacagacaactccaaggaccttagggaaggtggagccagaaagtgaaaggagtctgagtctgtctgtctgtctgtctgtctgtctgtctgtctatctatctatctatctatctatctatctatctatctatctaatttaatgagacagggtttcactcttaagcccaggctagagtgcagaggcttgatcatcactcactgtagcttctaagctgaagggatcctcccaaccttagtctcccaagtagctaggactacaggcatgtgccactatacccagctaaattgtctgagtctttaaatgactatcttctgatcaagaatatctattttagactttatatggttaagaaacactgtgtaaaggcattcaatttttagtgttgaactgttaaagcacttactgttgtttgtcctaagtaccatactcaattcctcctctggtgacctgaggatatgtcaccatcataaattggtgaacatcaaggtgttctctaactacaccaaagagccatccatcatcttgtaccagcccagtctaaagtagttaaatattacaacattttagacatcaatctgatttttaaatagtgtttttttcctgtaattcaacttctagtatcagaaaatcatctaatacttctcttgaaagtccatagatatatggaaaaagtgaaacaaaacattaagacaagaatggatttctagttcttagaaaaatgagtgtttcagaatttcaaggattttcatgacagtagcaacgtagatgctcatatcaccaactccctcttccttaacactaccacggaaacacaatagaccaaaacaaacaaacaaaaaccatctctccacagtatatgaatatcgcctaggaataacatgagttatgtttatacaaaggggaattttgggaattactagttatacattcaagacagattttagaaaactgaagtggctatctaaaatgattatcttaaaaaattggcaagaaattgtcacatttgctcaggcaaaaatgagcaaattgcctatagcaatttgtatatcaagtttatgtattttcatttgttttttaaccacattatctcttgaggtataatataaggttaacagctttagtaactactaaaaagaatgattcttcaactctctttcctatgcttgtctactctttagttctacttttgacaaaattatgcttctggtaatccttaaacttaattttaaagaaaagtatttattttcaataggtatttcttcttttacatttttctttctcctgggccactttaatcaggtgttgatagccaagagagtagaagtacaagttagttgtttgaaaagtatttagccttccctgccataatacacattatactgttttattaggttcagtgaaatgtttaatcatttgttcaccttttaaattgaagtttatccttccatgaacacatgctccataaaagaagagaccttgtttatctgtttacctctgattcttactatctggatcaatccctaactcaataatgttcattaattggaatattagatgatttatacatctatgcccattatgaactcaccacatagttactgaacctccattttcttttcaaattacagacatcaaatcaattctgttttgcaattttctttaatatatgtcttcaaatatagaagagttgctaacatgctgagagtgagattcctcaacgtgacatttaatcgcaaccttattttgaagacactaagatataatgaggtcattttaaaacataagtaaatttgtatagacctattatttggaaagagtattctgtctcttgaataaaaatagaattgaggcttagttttgaaaagaaaaagacatatgactaacttgtatgctgatcaatggaattagtacaaagtggagtattaagaaatacacttgtgcaaaagaaatgtgtcaaactaagaattaacattctagaaaattgccaagaacttttgagagattcttgaaagccctgactttcagtgcatcaatataagcagttgagtagaccgaagagatggtaacataaatggttaaaaaatttttcatgagattcatactctgaatgaatcttttcttgtcaaactatgatatttaatcaacatgatttgcattacctcatgtgtttacttttacaggcccctgggagataatttctgttctaaaggctgtttgtttgttttaaataatgtaagtacagtcatcccttagtatttagtgaaaagatttttgagcatgcctccctgatatgtgtacctgttgttatttgtacattttatagatgctctatttcaccagatatagcaagacacctccttagattcagtattgtatatcttaaacattcccagaaaaaaatacatacatctttattttatagatgctttgtttgaaaatgttatgcagattttgaaggtcacatgtgattactagctcatgtctcaggacacattgtacagttaggtcaaagttcataattaaatatagtataaggaaatccatatttcatatggccttcttaatcatttgaattttcgcccctttcttgtcagatttgagtagatcatcactgctttttaaccttggagtacagtgaaagaacagcagggagcagccgtgtcatctcgataccgctccccaccatctgtattataatttctcttcaatccaatgctttcttaaagaatgttcttaaacttcctatcttgtgaatgttcatttagttaaaattaacaatattatctacagaaaccacttaaccaggaatgcaacctgtgatactcagcaatatgctgaaagcaaaccaataagtgagagaggacgctgttgtctatcctctgcacaatggggttcccactcttccctaagagcaccacgtgctagcagtttcatctggtacactggacctgcgcacagactaaataagaccatcaatgaggaaagcttacttcattttctattatcttcgattaaaaggtatatacagagcaaaattctaaccgatgaccttgtagtgaagagcactttgggaactgctgtgttacattctaataaattctaaaaatccaaacctacttaaaactctttagtggctggtttttgcctgtaggtttaggtgtaaattcttttgtatggcattcaaggccatttggaatctgtctctggcctctaccttaaatgtatgctatgctgcaatgacactgaacttgtttcattttcctgaaatgcatcatgcctctgtggtttgttcctgcccattcctcagtatgaaatggcctcccttacatcctgatgtgcttttgaaaccctcacatcacttctagcaatttttccctgtggacacttttgtacataccaaagcagaactaatcattttatcttttgctaccactgtggccgtttctgaagcctactacagaactcataaatatttgcatttgcctctgaaatccacatgagtatgtgcacatgagctctctcagattttgatgcctgaatttctactttgtaacacagtagctgtttgatacctctcactgaatggataaaaatagctcttttatctgctcagtgagaaatgcaccaaatttcataaattcagctggttagtaagttttataccatattttggaataaattagtgtataagataaacttcaatatatgcttactattgatataatttttaaaatactattatttatcattattatattttaaaatgcagcagcaatattgataaaaacaataaataaatataaaccttcaaggaagattttaataaatttataaatatatattgagcttcttcaatatagctttatagagattcatgagaaaagagacagtccctgtcctcctataatttttcagactaaaggatagtacaagcagtaatcaagcaattacaacttagtaacaatcagtgttactaaaacgatgtcctggaatataccaaaggaagttctaagtgagtcagtgtttcctagaggctgccttgagaaagtgatcttttaaacagagacctgtagaaaacaaaaaaacaaaaagtacaggaagaaatgttccacaaaaaggggataacaagtgttaaagctctgagaacaaggagagaaaaaaatgtttgggagtcaaattccagaatggatggagtacagacaaagaggatattaccagatgaggaggatggagagctagagcaagaccgcacagccttgcaagccactgtcagtaaaaattgtgaaagactttggacaaaaggaatactgggagtcctttcaatagaatgcagtgtgttgttcctagaggagccttcaggttatccgattctatagggctctgaccctttatccttggccaggctgttttgccacttcatagaggtccaagttaatccatggtgaacaaatggaggtgcaaatgattcctatttataaaaattaaaatgaattttttcagtaataatattagtcatataaaaagatgattataaatgttacatttttgctctttgcaatacagttttttatcattaaaatttcatttcagcattccttattgtctatgtatgtctatcctttacaatggttcaatggttgtagcatcttacattacaaaacatttttgactttttaaaaatgttatatattgacgtgagtcatgacttttaccattttgccaattctcctttataccatatcatggaatctcaattttatctcaggagcaaggggaagtaattgaagggtgttgaacaaggaatgaaatggttggttgtaaaggtagaggatagtttggaaggtggaaagaatttatgtgagaagacaagttagaaagctgtattagaaagccaaatgagatggcagtggcatggatggaggcagaggcagtggggttagaaagaaatggagtgatttaagagatgttaaagaaggaaaggaaaccctggtattgttgttagataaaggagagggaagaatgaaggctggttgactctcacatttccagaatgataaattggggagatggtagttcaaattactgaaaggcaagcagatttggtgagaagcaaaactgtattttcaataagatcattgtatagctatagagtttattcaatcagtatcccagtgacatttgtttaatgctagatcattttgtcatgcatttgtaaagtactcccatgatttatccagcacacacaactgagaataaaagcatatcctgaagataaatcaaaacagaatcatttgtactacctatcaatctataaagtgactgattccacagcatgtcatatttagaaataaaagaaaacactgacatttggtttaaagtgttagaattgtagtttaattaaacttgtaaacccaagcatttagagatggtagtcatttctagtcaactaacagcttcattgactttcaagtatttgaaagaattaagaatagagatctgctacaaaactgaatattgtggaagttatcaataacattccttatattaatgataatgtataaaaatgtctaaaatcctatttcctattatgacagaataatgatctattattgatctataatatacattattatagtaaatgtcatggttcattcaggttgctataacaattatcttagaatggataatctataaacaagagaaatgcactgctcatagttttgtaggctggaaaatctaagataaaatccaagagtcaagaaaatccaaatccaagatcaaggtgccagcagattcagtggctgcttgagggcttgctttcttcatcaaagatggtacggatggtgccttcttgccatgtcctcacatggtggaagggtaatgagagccctttcatatgtcttttataggagcacttatgccattcaaagagtagagccctcatgacttaatcacttcccaaaggccccactttttaatattatcataccaggaattaggttctaatgtatgaatcttcaggggacactcagactatagcagtgaaataattaaaataactaaaaatgaaaaaagtatctttataatagcatattatgctctgaaaattgcataatttacagtattataataagccattttcaaaggtacagcaaaagtttggaaattccttcaaagtaacactaatctaaaccctgtaccttaggctgtcatgtgtacatgtgcccgtgtctttaattagattatgaattgctgaaggcagaaattcaggtttgtactcaacattgtgtcctcaatgcctagtatgctgatggaataaagaaggtatctaataaatgctaaccaaaaaaaaatgaagaataatgtatagctatttctatcttattagaataaaacaactttcagccatgttcaaaagtttagcatataacattttttctttttttttagatggagttttgctggagtacaatggcacgaccttggctcactgcaacctccgcctcccaggttcaagcaattctcctgtctcagcctcccaagtagctggaattacaggtgcccaccgccatgcccagctaattttttatttatttatttttttagtggagacggggtttcaccatgttgcccaggctggtatcaaactcctgacctccggtgatccacccacctcggcccacggcgcctggcctggcatataacacttagagtgttattgttttcatggtaaatgtaacataattatattttgaaaagctaagaaaaattgtatgcataatccaagcatgctaacatactcactgacaaacatttcggttttggcaacaagactcttaccactgtcggaaacctatttaagatgttaatccagaatatttaattgtaaaaagtacccagatttgcacactggcaatgatattgatagttttctgaatgtgatagactgaagagggaagtaaagaaagaaggaagggagtaagagaggaagggaaggaatgaaaaaataatctattggaaaaaaagtctttttctttactcttaatttactatcgaatcattagatttttcggtatttgtaatacttctgttaagtacagtaaattcaagcataaacatgggaatatgcctaagattgctttctagaacaactccagcagaacagcttcaaagcctcattgaccaaattgaccatcagtaaaagggttcataagtggcaaatacagaactcattacagatgtgagtagaagaaattattaagtactaaaaacatctaaatgccaagtcagcgaagtcactgcaccagttccataaaactagtgtctcttatgtattagaaggatgaaaggggaaaatataatttaatttaaattattataaaataatttattattttggatatttttcaaaaaatatccaaatgtaaacaaaaatttatttaaaaatactcaaataattccaaatcttatgggcagtcatactaaaaatcttgcttaagagaaaattgaaaatactactaaagctctaaagtcatcacattttaaaatgttgtatcgaagggatctttgaaataatcttgtctgtactggtttgaatactgttcccaaaatttcatgtccacccaggacctcagactgtgaccttatttggaaatagcagatctaatttgttaagatcaggtagtactgaattagggtgggcctccatccagtgatttaggttttcataagaaaagaaaacagatctgcagagacaaacacatatggccatgtgaagatggaggcagaggctgagtggtgggtctacaagtcaaagaaatcccaggactgccagcaatcacagaagtcaggagaaagacctggaacagattctttctcagagtatcaacaaggaaccaatcctgcatgactccttgatgttggacttccagtcttcagaactgagagaaaagaaatttctatggtttaaagctactcgatttgtggcactttgtgaagacagccctaggaaatgaatatactatccaatcattttttgtgtgtgtagaagaggaaaatgagatcttgagaggataaatgatttactcaagatcatatagctaattattgttagaactcgtattagaatctgttgtccatgaggcagtttttactaagtttatgatttattagactcatggcaactgagattatattgaactaaaagcacacgtgagaggaagccttacatcaaaattgatttcctttcacattcaagttaaataattttaatttcacacttgagagttagcatagcctattggttcaagaacctgggctctagggccagatttcctagccttggaattctttactgtaattttctctgtggcataacaggtacactcaatgcatagattgttgttaggattcaattaggtaacacttgcaagcatctagaatagtgcatggcatacggtgaaggttatatgatttggggctgtttaattgctgaaaatttttactaattacatctaaatatttaaaataactgactctgggtgaagtaaagtttatttaatatttacaaagactctggtggaattaagaacaagtgatacttcatattcaaacagatgttttaacaaagattccaagaatatactaataatatataaagtatgaaaacacaaaatataaatattaatgtaagatactagttccagtcataaatgtaaagaaatctatcacacagtgggtgcagtggctcacacgtgtaatcccaaaactttgggaggccgaggtggctggatcacctgaggtcagaagttgaaggctgacctagccaacatagcaaaacctggtctctactaaacacacaaaaattagccaggcttggtggcagatgcctgtagtcccagcttcttgggaggctgaggcaggagaatcacttgaacccaggaggtagaggttgcagtgagccgagatcgtgccactatactccagcctgggtgacagagggagactccatctcaagaaaagacaaaaaaaaaaaaaagaaagaaatctatcacccatgattattttattttatttatcaaaaattatgttgctaaatgtttcagtaaataaattgaggtcttttaaaaacaatggaaattacaactggattcagattaactcaatgttcaggttaaacgaatcttaaagaaaaaaaggaagggaacataggagagagaaatttaatgaaggaagggaggagggtgtaagaaaaggaaggaaagaagaggaatctattgcaatcaaaatcaattgtgatgaaggctggtttcctaattttttacatttttcctacctaattttatttacacatttttattttctaaggctaaagaaagtgagactggaacaggcaaaaaaaatgcaattgtttctcatttatttccaatactcacaatgtataattacaaagtatattgccaatcacttaaacattctaatgcctcaaataatgtataaggtattcagccaaaactaacctttgaaattaaagaaaaacattgtaagaggaagtttttaatatcttgtccatttaaaggaagttttacttaaagtaatttatacagttcagaactcgccactaaagttcaacatttctaagagctatacctttctgtgacttcatttttctcaagtgacattacaaatttctggtatttataacttttaaaatgtacttgttagggaaaataacaattaagttatttttaatgttctttgcaaattttaattaggacttttttattatcaggcttgattaaggaaataatttattagagcagaaaaaggttttagagagcaaatgtttatactattaattaatgtcagttagctatgtgcttacaataaatttttaattttcagacctattgttattaaaggcacggtggtttaagagtgagttccaaataacaaagagtacttaagttcaagttcacaccgcttactagttttataatcttgggcagttggattctctccaagcctcatccccttatccataaaagcaggaatacaaatcctagctacctcaaagtgctgtaaagggtaaaatgatataagaaacattagcagcagtacagtgtctgttatatagtaagtgtttagtaaagaatacttactgataacatataagcaatttctttccatttgtgacagttattttgatgccaaatattagaggctagatatgctttacctttgcccacatctaggctctctctgagctactgattcaagtttctaaattattctttacaattgaagatgggaataagacaggtgtcaaacattttaattcactccagtgagcccagttaatgttacatcatctacccaagcaaaagactatgctcttctctctttcatttgcttctcattctattttccctttccctcttcatccacttctctttaaatgtaactattaaagctacttttatcaatctttgcatgttttccaaccccaaggtcattggagcttaagttttcctgataatcttttttaagggatctaagtctcttttgcttatgtgctcctacgatcatgcataaaattgttctggcttatttgcaatctatttttttctaaaatgaaaccccatgaatgaattttaacagcatttctcttctttaacagaaactctaagatggtattgtcattttttccaaggttcttttttgttctatagtcccatttatgttttatttttggaatagaactatgtccttaacaaaagtcctctagattctttctctgttttttgaatgacaacaattagaagaaggtaagacaaatatttaccagatgacctactttgattataatgagtttctaaaaagatgttaacattgttgaagtccctataaatctttactgtgtcttcttgcaaaaaagaaacagccaggtcctcaatcttgccaagtattttataaaatattccctagcaaagcatttgttattttctccttcttgactttttctacttgcttcaatggaaaaattttcccaaaatccaatacattgatcatttgaattttacaactatcaagattttagacaactgctgcccaacactgttatttaagattcatcctatgtttcaataattataattgtttctctataatattcttaaaataaattttattcatataatatttcttctgtttaatcaatttaaaatagtaaaggtaaaaatcctttttcttgtcccctttttcaattatgctatgcattgaaactcttttaccaagaccaccatcttatttcaagtatgcactattagtagggaccaaaaattaggatcacccagtaggtgatttgctatgatattaggcatattgatgatcctggaagggatgcaatctaatcatattccattcaatgaataaatatgagtttttatgaataaaaaatgagtcttcagtgaatgttgttaatagcactatataaaaagaacacagcattcactttcctaactccacccatgtcttacttgaatgccttcctcaggaacacagctctcattcatcctattaatatgaatttggtgtataaaattagagcaaaatggaatcattcatcccttagcttgcattcactaccaaatttataatacaaattaccaacatcaataacagtaatatccacaagcaaaaataatccctgtaaataagtataactaagttaggaatgaaaaaaaaaatagacagaatattgatataaatgctcattaaccccttcctgaattatttaaaaagtaaaagagatgatttatcagatcatttcctatcatgaattaaacaatttctaggcatttgaatagatgtctactgaggaaatgtgaaagtggatttttgtgtaggtgacgaattataaaacacgatagaaatctgtattgcattattataataaaaaagccattaaaatatctggggggattaagatagttaggtctgtaggagttactgccacttcaatgtacttgtgtatattgtaggcatcccacttattttttcatacagcactataaatgttccttgaaagctatcttaacattcagattatttgaaataactgtacatttgtcacaaaatccaacaagaatattgtgagtgcttactatgtgcatatcattgcaccacatttgaaggaaataaccaaaataaaaataaaaataaataaataaataaataaataaataaataaggaccattcaggcagttcccaatttagaacaattcaacttctagcaagtcgttaaatttaaaatagctggttacacccatgttttttgaagctaacaaataaatttagaacaagccccttgatttgcttcttggatgctcaagtgaaaagttcagcctggaacatgcaaatggtatcctcgaccagcatctcttgaggatgttggatgttgcaaaatttagaagacaaaacgtaagaagtaactaataaaaatgagacagtgactcaacaggagtgccagattagatgctaccaagtttagatttcttatgtgactggaacattttcataacattatactaaaaatattttaaatagaaaatattattttcataattatacaattcttcaaacgacaaaattcatctaacatacaaattttagcatacataatttttaaatagttttaaaaaattagtatatataaaatatactatggtcaatatccaacagtaattcaaaaacaagccattaaaattcaattctagtgatgtctatagctgacatagtagggcttttgttgtggatttcatattaatatattcaaccaatatctattctattgaatgcctctgttgtgtctattccagacaatgttccagaactgaagacacaagagtgaacaaaatattatagacaaaaaacaaataaacaattaaaatatataatattgcagatgatgattaatgctgtggatacaaattaagcaaataaaattacaaaccaattacctgtatttgtactgtatttgaccaatgactaaagcttttacatttaaatacataaatatgatgagggacctacaaaacaaaacgaagcaacaaaaaaagagatactgtcatctagcaatattcttaaaggtaagaatgcaaaataataggagtagctttcatataaatattagaacaatgcatttcaatattctctataaacgtgtttttctggaataaagagttttattgtcccaggaaaggagatatatacttgatatttttttccaagataatagacttagaaggtaaatccaggggagaacgactattgtaaaaatgtttaattacacttggcctacctaggatagaaaagatcatttagttgctcatttaggcttatcccattgtttgaataggaatgagactaagataaatgaacggaaaggaagttggaaaaaggaaaaatcagagacattgaagagaagcattttcacatgtgcctggcgtctggatttctcccctaagtcttcggctgagttggtgtctgttttcagtagaagtacaatggggtgacacagtaaaacttaagttcacaggctatgttgaggcacagcagattatttgataaagttaagggagggaggggacaggacaatgtgaagcagagtcttagcaaattaaaaggataagagaagtatagctagactttcccacattttcctgtcgtcttctgaaccctccaaactgttccaacctctgcctgttacccagttccaaaatcgcttccacattttcaggtatcttttcagcaacatcctactctactggtaccgattcactgtatccagtttataaaccaactaatgtcttttcatcaaaacacaccagagactgggaagaaaaagaggtttaattggacttacagttccacatggcttaggaggccccagaatcatggcaggaggtgaaaggcacttcttacatggcagcagcaagagtaaatgaggaggaaacaaaagcagaaacccctgataaacccatcagatctcatgagacttattcactgtcacaagaatagcatgggaaagactgccccccatgattcaaatgtgggtccctcccacaacatgtgggaattctggaagacacaattcaagttgagatttgaatggagacacagccaaaccatatcagagagggaagtgagggaagaagagagggagatgagagacagtgagagagagagagagagagagagaaaaaaaaaaaaaacatgagtttgtcaggggcagaaatcaatgataaatatcttctaaatagccttagcttaagactagaatctgctcaagcattcctatggacccagactctccactcttcaggtgagacagaaagaaaattgtggacaccgcatgtacctctttactcggataccaggaaatcatttgagtttccctcaccccatgccccatacaccagtgtgttgcagaggaggagaaacttgaagatatgggctccaaagacaaagtcttatctgacatagttgtttggctttattccaatttaactaacaacaaaaaaggcgaaataatttttagccttatatattacctaaaacccagtgggtgggagtttaaaaggaaaagaacagtaataacccaatcaactacctgtcctctgctcagtcatgtgtcagtgagtaaatctgatagcccacaacatctttgcatgctggcgagccagcagttttgagagaaacccatatcatctctgttatgcactgagttgttttccctcagaatcttatattggaaccagtaccttatattgaagactctggcaccttagaatgtaactgtatacggagataggatctttaaggaggtaattacggttaaatgaaatcctaggggtgagaccctaacccaaggggattgatgtctttacaagaagaggaagaaacacttgagattcatgctcacagcggaaaagccatgtgaagacacgacgagagggcagccatctgccagccaaggagagacgcctcaggagacacctactctgtgggtaccttgctcttggacagccagcctctagaacttcgagaaaataaacttctgctgtttaagccactcagggtgtgctattttgttactgcctagctaactgaggcaatccaataatctgatttacaaagaagaaaagataggaagaaggatgacaacgttatcaccccagatttctttaagagacttccccaaattgctattttttttttcatcctagataagatatatttttctaatgtactaaagaaaattaaaaaaaaacagggatagtaaagaactccaagcatactataatttttaaatattggtatgacatttttgcccccggttatctattacaggcagaattatactgggaacaattagatttgattaaaatatttaagatcatttctgcttttaaaaaaaagaaacttaaaaaaaaaacctagtagattccagtgagaaacaaaagtacttgcatatcagtgtttcttagaaaaaaagaattagattcagtgtgctacaggataaaaaagataaaacttacttttttataattatatgtttaataattataaacatttttatatgttttataattattagtgtcttttcccatatattattttatgtattagtaagtaataaagtcatcaaaaggggcatacatatgtacattattttaatgtttatgttttggacactcactgctttaatttttatatagtcaaatctatctatatctatatgtctatctatctacctatcatctatctatctgtctatcacaagcaggttctcagtctgtcactgagactgcaatgtagtggcatgatcatggttcactgcagcctcaaactcctgggctcaagcagtcctcctacctcattctcctgagtacctaggatgacagacacatgccaccacactcagctaattaaaaaaaaaaaattgtagagacacagttttgctatgttgccaagtctggcctcaaactcctgacttcaagctctcctcccccattggcctcccaaagcattaggatcacaggcatgaaccaccatgcctggctcaacgtaactattataacttacattatgtccatttttagaaatgttttatcatctaaaaatacttaaatatttatctagattttttccagtatgtatagtttgattttttatatttaccttctcaatctatttggagttgttgtttttttactttatagtgtaaagcatacatttacatttttatccaaacaatagttttattccagacaatatttctgaacaactatatagaattcatcagtttagacatgcatatcttctagacgtgagttgtacctatcaatcctctttaactcaaagcacagtccaaagaaggagccgtagatatcacattgaagggaaaaagaatttacctgagagagcaacagcaaaaacagcacaattaacagagaaggcattctcagggaatagatggaaattattttgcaaaaacacactccctaatgcttcatgcagttgtgcacaagaacctgaacatctaaaattatagagcctaggatcaactgaacttcaagctattaaggcctgacattctgggaattctctgatgtgggtgttattaaactctctcatggatcaccgccatcattccaacagagagcagcatgcaacatggaacacaacaaaaaaccctgagtggggaggatgcccagagtcacgtctcttagacacatctgccaagaggattcattaatttcttattttctaggcacttaatgtcagatcagaacaaaatattttgtaacagctttattcaataatgtttaaaatataatttttgtttcactgtttaatttctcagttcatttttctgtgctctatgaaaaaccctgagttaaaataactgtcctggctaatttgaaaaatacatttaatattttagttagaggaactctaattgatgattgcaatagttcttatgtgtaaattcgtttaaagtttctcaacggcttttcattcattggatttaaatccaagttcctcaacattgtttttaaggaccttgccttttttaaaatacatagaggtggtgtctatgctgaccaggctggtcacaaactcctggcctcaagcgatcctcccatctcagcctccgaaagtgctgggattacaggtatgagccactgtgcccagccatggcccttgattttttatccttctatattctctctcaaattatgcaaaaatactgaattcctaataattattcaatgtgtcgtgcttttcataggctcttgcgcattactgcttgtatctcaggtacaacatctaatgcccctgacttctccacaccatcttaagtccctccttacacacccagttccttcaggtctcagttgtaatgtgacttcacccagcaaagctttccagctgctgaggctggaataagagatcctttttatattgtgtattcccatattctatctatgatagcacatatatacactagggatttaatggatactgttgaattaattagccattttgaaggaagctaaaaaagtgttcaacatccagagtggtcagcttaggtcaatcggcctagaatgatgccttaaggtattcttgtttggggctataatatgctgtacaccaggtataacatgatctttgccttgcagtcctaaaggatatgttcattctacagaaagcatccattttaaactttgaagactgttaaggtttaggtagatattaattagtatcattatttcttctcaatattctaaaattaatttcaaaatagtcttaccatatagatttttttatagaattttgtcatttgtcatgcaagactccatatcttttcataaaattaaaaatttggtttattttttttttcagatggcagaaacctgaaatcaagtttaaacattatccttgttttattattcattagtctttagtaactattgatactagaacatgtttctgtgttgggcaatattcaaaatttaacaaaaattttgaatttccatcctattttaagaatgaaagctgatagagtatttataataagaagttaccttttttgctggttatgactataagggagatattaccataacataatcaaccagggaaatcccattagaaattaaaagcaggttaaaatctcattaaggttttccccaagctatgagcatacttgcccaattaaaaaaattaaaaatattttagattgtaagttttaaaagatgctttctagatactgtaatgttctatgtgcaaaccttgattactcaggccttcggtttgttccctggctttgctgcatgagttgtttacatccatatccaaagaattcttcacaagtttggttcactcatcagtaaatcctattttggtgccaatgagtaagagaaacatctccctgggaccacctttatggtcatacacgtttaattttaatcagtcactacatgaaacaaatattttgctaaaaccaaggtggactttggatgccagaaaagaccaaaagagattttaactgcttttgttgctgacaattactcttggttaaggacaaaccatcacgatgaggactaaaggtttgtgatacctctctggactgcttttaactgcgaagtgaaggataacagcagaaatagaaacagaaggtctgcaactttcactatgaccaactgaggaaacaagatgaagagagcattggtcaatgtatctagtgtcttgcatttaaaccccgtttgccggattaactgcaaatgtagatgagtgtctttgtcctaatatctatcaaaaagataatagtctataattccttccttttcaaaccttccagaattcataggaagcatcaggaacgtggattcattccattttataaaaatttcctcaacttctattatgtttcctctcttaaacattctctaaaccctctagtaactttcacttgttaaaaaaaaaatacttctgaactatttactgaagcaagaaacctatccaaatactgtaataaaatgttgatgttgtaaacacattaaattaagggaaaactatgtacctaaaataaatgataaattcaacaccttaaatgtttataaataatatcaaataatcattgaaagatattatgccatttgtataggatttataacttcagtcataattatatgtttatttaatgttaattcatcaataattttcccaatctcagtctctcacatacacacttaaattaggtgccacagcttaaatagattccctctttcccgctccctctccccttcttcccctctgtcctttactgaagaccaatgtaacttaatgcaattactgagccacagaaaaaaccatgttgactgcattacttatattgtcttgtttattccttagaataaggtaacactgataaataatatattaatcattccacttccacttcaaaatctaaatgtaatgaattatttcatatagcctatcaatcatgagattatttttatacacacacacatcacacacacacacacacacacacaaatgcctgagtttaggtagaatgcaatacgtgaagctgaaaagtactgagaaattacagataaggtttctattagaaatcatcccacaacaggccctggtgtgtgatgttcccaggggagggatagcattaggagatatacctaacgttaaatgatgagttaatgggtgcagcataccaacatggcacatgtatacatatgtaactaacctgcacattgtgcacatgtaccctaaaacttaaagtataataataaaaaaaatgaaaccaccaagaaacagaatataacaaatgaaatattctgactccctgcttatctgtcttgtttccagtccctcatttctttgatctttatagtagtgaaatggttctagtctttaatcaactgttgaatttttttacagggaaaatctattgagtgtgatgtgttatgttttgtgctaagagctttatgtacattatcttacttggtccttatcacagatctttctgagataaacacaattattaactcaatcttattgttaagtacactaaaattcagacccaggtatatctgactccaaatgttaaataaactacttaactcatactgccaaaaaaaaaaaaaaaaaagaaataatccctccttgacctgaaatcagcgtatactttgtaagtaaatttccctttttgttttaaatgtaagacagcattttgttttcttgctcaaggtatgaaatgataatagttctttaaggtgagatctctgcaacaaatgtcaatggccaacctcatagctctttgtaaacaaatcagaagtttacttgtgtaatttctttgaaaaaatttcacaaccatgataccctagggatgatttcagtgattaggtgagatataattatattacttattatactgtgatgcattacagaatatttttactatacactggaaagcattagaagtcactactatgattacctttatgtcaatttttctttactcaataagaaacaaaataacaacaatgctagtatcattcaagttaatgtttaatcatttaacaaaaaagtttcatcatattccatgttttaaaatatttttattattttatttcttagaatatttttattttaatcaaactagaacatgtctctcaataaaggcataactagatttttgaggaatatttaataactgatagtttacacttttctgacctataacagactttaataaataggaaaattagttttcccaaattagtcttcccaaataactctatgtctcttgcttatctgactgccttaattaacatggcagaatatattagtaattgattttgtgataaaataaataattataattaattggttttaaaatcattagcatcaatcaattttttgccagttctcatatttgcatttttagaattcatgctcttggggcatgatataaaacacagtagtgtgaattcccttgactaaataggtatacagaattccctcatttttctcatttttgcaggggtatcctgaataaatcttaaaacattctgaatagttcagactctggagctatgtttaatttcagttagctacagatgccttgaactaagaatgacattaacacattattgaaaattaattaactaaacataaaagaatcaaatgaatggaaataaattattgtaaaatcggcatgggcacaaaagttctcagtgtttactgctttgtaattaatcatgctcattcataaactaaattaattgtagctacaaatgggacatcttgcttgaatttcttttacctctgtctataatttttgtgtgtgttgaagattgatttcctttttttcaatttgctaatattttaggtttaaaaccatcttacctattcattttactgtagaatatttccttaccaagtttagtttgatggtcagcaataggtcaatcaatgattcatttctgtctctttctaaaaaaaagtcttttaattttagaccagtggttattatgattatataaaataaaatatgttataatggtgtctctagtcacggtataatagtaggtaacagaacatttgagggattcggtaattcctttctaaagtatattgtcacagtttctaatctttttgacattgtctgaaaaggaagattttataacctcactttgtaaaattaataaaggtattaacactaccatttagtttcatgtttttcacatcaataagcaggaatgtatcaaatatatattattttgatattcatcaatattgcctctgacaacttttgaatgctaagactaatcctcagataatacagcccaagagttattacatttaccctgaatttccgtggccagatacataacattgacttggagaaatgaggaattagaaatcacacagtttttcctatatcagatggagattactaaagtttagaaatgtgtttgcaatattaattggatgctacttcagcagatttcttatactgatagttaagaaaactggtttggtggtgaaaacaatgtaagaaagccagatggaggttttaaggaaaagaaggtgaagttctatatcccctcatttagtaatcatttaccctctgttttatggcaaataactgcgttagaattgaaactaattatgaattaggagcctataagaaaaataaagtaaatattacaaggaaatttagctagggacgtgaaaaattctcctatagctgaaatttaaatggacttaaataccaagttaagaacaattcataaaaccctaacaatattgttaagaaggtcagaaaaaatgtctaccaaaatctataattagatagaatcatgtatatattttaattggatattatagataatatatttagttacatgaatctacaaggagataaacttcatgcagtattatctcaggacattacaaagagcagaaaatttacatttggtctatgtgtaaagaaaaaaaataaattatatccaacactgaaaacctattcacatttaagaaagagagaacattttgacatctctcatttttatattttatatctcagtggaaaataaatgttacaaacacttagaactcttgaggctggcatatttgtttttctaatatgaaatatggtttcccaacatgtaaattttgttttaaatatgccctaaatattggattatttttaacaggttttgaatattaatttaaacttgtatatttacactactagacttaaagagttattagcatgtttccttcagcaacagtagtttcaggcttttatttaaatttctaaatatgggcagtggttgctgaagttattgcttcatttcataccaataggcaatacccttaaacttcttaattccttaaagtttagctatgtagttttattgcccagtgtgtccttagattactatatctttcctaagtaattagactcctgtattttcttcctttgagtctattgattttatagggtgttatacttgctccaggagaataatatttattttctgtggccattaatcaatgtcacttgtgctaaaaggctatgcgaggatttctgcctaatagccaaggaaactatatttattggttgggaaaaccttagctacagctactaaactgccattagtggaatccttaacagctcattaccacagttagatgtgctgtgtacagcatagcttgaatgagaaccacactttttaagaaaagtcttttgtttattctgctctgacagatctcagtccagcagaatcaactccaaagtgatggcaagaaaaagaactgtgaaaagatgaaatagcatctcttttcttgatatgaaggaaacattatgaggcatttaaaataatatgtacaaattgctttatccccaaattatcaatatcttatgaggcaatagcctctctacagccagtctcagaaagaaatttgcacgtataatgtttcaataaagaagtaaacaagataaatttagcttcatattaatagcgtgaccattaaattacacaaacttggtagtattgagaattttccacttataattttggcgtacatttatgtatccgtttttaaataaatgcacatatttgaatgttactgaacagatgctggtaaaatgaaacttacatgaccaagaataatgtatcaagatggcagactgagctcaatgttcactttcccacttccagctcccattatatgaccaaaaaatgatgctaagattaataagtaaatccaagataagactgatattggcaaagcaaaatataccaaaagtttccagagactagatggaatcagctctagtgagagaccataagaagccagaacctaaaacacatgcagaagaggggtttcagaggtggcagttgttcagggtatctaaaagatggatcagctgatacaagatacagaagttagtacaagaaatttcttcagggagattaattgcactgtatttggagccagttacagccttatgattataactctattcccagacctattctcttgtggtgggcagaggacaacaggcaagcttgtcatgagacaaaaatgaaacccagatgtaaagcatagcaaaaataaattctaaaaataaaataaacaggtaaaagggccacgttttgaaggaaaagcaacccttataatacaggcaacaaacaaacagtactaacatcaaaagaaactgatgatgatacaaatagaagaaagtttaaaataaacacagtaaataatattgaggagagtcaagagaattttgcatttccataaagcaatatgaatttgttatgaataaatatagaagtcttagacgtttgaaaaatgaatgtcagctgggcggggtggctcacgcctgtaatcccagcactttgggaggccgaggcgggcggatcacttgaggtcaggagtttgacctcagcctggccaatatggtgaaaccctgtctttactaaaagtaaaaaaatattagctgggcatagtggtgggaacctgtaattccagactcgggaggctgtggcaggagaattgcttgaacccgggaggcggagagtggactgagattgtgccactgcactccagcttgagcaacagagcgaaactctgtctcaaaagagaaaagagagagagagagagagagaaagagagacagagacagaaagaaagaaagaaggaaggaaggaaggaaggaaggaaggaaggaaggaaagaaagaaagaaagaaagaaagaaagaaagaaagaaagaaagaaagaaagaaagacagaaagaaggaaggaaggaaggaaggaaggaaggaaggaaggaaggaaggaaagagagagaaagacaatacaaatgaatatcaaaacaaaaatcttaattgaccagctgaatggtaaaaaaaaaaaaaatgcagctgaaaagcaaataatgatttgaaaaactgagctaaagcgttttttcgtataactcaatatgatggagcaagtaaatagaacaacatgaacaaaagagatacagagaacacaaggcaggagaatagtgtctggagccagggaacctaacagccaattcgtgctgacttcctagaactaaatggaatggaaaacaccacctctctacacccaagtaacaaaaggatcagaggctacaccctttacaatccccatctcctccccaccgtattgcacatgaaaaatattctaagaaataaaataataaaaatattttaaaacatggaatatgatgaaacttttttgttaaatgattaaacattaacttgaatgatactagcgtattaatcgacctgttccacagcccagtccagaatgttcccatgattgatagggcaaagtggtccagtgtgcaggtttaggaaccaaaaagactaggattcttgttctaactctgtgactccctggccagatgaccttgggcaagttatatattttctctaagctccagtcccctcaacgtatatgcaataaaagtctctatatcctagtgtcatttgtgaagattaaatgagataatctacataaaacaggtagtgaatacactgcaggtcttccataagtacttgaataatgttaattattactagtagtataactactactgataaaattattcacaatgttgcttagtaatccagatatgcatggactgcaggaatatttttatgataatagataaaataaactatgggaaatggaaacaataaggcaaagagatatttgtagagctaaaaaaattgtatcaaggaaactattcacaatattttctatacattaattgacagcaaattttgaatctttatctttcaggcagtattttgagacatcaagttgactccctcatcctgcaaacttggaagcctatttggaaataaactatccatcaccaaataagatacccacaaaatgctagaaagaaatctccttttgcttctcccaaagtgagtacatatgttagcctgaaccacattagacatcccgattcctattgacactggaagttgtttcaaatcttgagccataaaatcttctcatctctgactaattccctatccctgtcaattgggtttgcaataagtctgccaactgatttctagggaatgatttctaagccagtcttccaactttacttttttattttttaaacttgactgattgattccaggactttgagacttccattacctggcattgaattgtaaagaaaaaaacccatcatcttttgaggtaaggagccatgggagaaagactctggtctatcacactacagagaggtattaatcaattaaagatttcttcaatgctgccacaccccaaaatatatgtattaatatttgatttatattataaaactaatcccctttagcctaacttacatatatatattgatattttatatatgtaaaaatatgtatatatagcttttgagattgatttaactaaattacatgattaattatttcagtaaggtaggaatctggaacattgtcaataattacctttccccctatttctcataggtccttacttaatccttcatttgcatattggctaattgtttctctaatataagctatgttgatattagctatatgattgaattaactttaaaaggtatacatcaaattatcaactacagagaaataaaatgatttccactccataaacatacacaatatacatcaacatatataggtgtttgagttcaatatgtgtatatttttaaaaagatttacgaagcaggaaatctttttgaatcccattgagtgagagtcactcctgctagctggagttagccataaagcagaactcgaaattttgccgcccggacctctagagggcagacctggaacctctctagtaccaccttcaatagcacagcaatggggaatgagatgcataaatcatttttaactatattcagacaccttttggggacagctacaaagtgctaagcacaaataataagaaaaaaaatccacatggtcaaagaaaggaaattacaatatgatgtaatgctctgtaatagcgggaggttatgaggaatagacacaaggttccttgaaggaacaaggaaggctttctggaggaggtgataacaaagcaaagtataaattcgtcagatatggaattttgggagagtgttccaaacagtgcaagcagcaaatacataagcttcaggtaaaatatattgtaggaacactatatgtagttcagaaaagcctcttgtaggaaagcaacaccttacagatttaaatggtaaaaatgtataaaagtagctcaagcattaaatttttgccagttattgagccaatttttattttccatatttctatttttcaatatgttaaagataactctaagctgggctcagtggctcatgcctataatcccagcactttgggagtccaaggcgggagattgtttgaatccaggagttcaagaccagccaaggcaacatagcaagtcctcaattctacttaaaaaataaatacataaataacactaaaaactacatattaggattgcaaaaatttgcttctataaaactatggcctgccactgaaaaggagaaaaaaaagaaagaacaaaattgccaacttaatttaaacctgtacaagcatacaaacagactcaagttctgaaatagataatcaaaaatgttcacctaaccaatgcatcaagtgaattttatctgaatgtgctgtggcataatagtgtttggaggtatttagaagatggtaaatcccagaatctttctaattattctttgagaaaaaataacttgcacattttgaaaataaatatttcaatatataaataaactttcagtgtataaaaacaaatttataaaacaagtttatctacctctttcattatatatgaaaggtttttacaaagacctttttaataaagattctaaattaatcttaaattaaggttcacctcaacgttcttaaatatgaactaatgttcaagcatataattatatttctagttatagtctccttgacagcactgaaatcattccagataacatgattcctattataatatacctagggaaaataacccaaactaaaaattattagggggttggttatttaaatacattattttgaaaatggcatcgagtatagcctgaatttttaattctaaaacccaaaactcaggcaaataaacttattaatagagctttgattggccccttggctaatgatccgtggctcagagcatcaatataccaggtttcagatcatgataagtataccaaatttctatagattgtctggcaaagcagatactatcactatcttgtgacaatagtcttctaggcttacgtatcttgccggtttaaaaaagaaaaaagaattccattgtcaatgtatttattaaaataacactgtattttattgatttaagctggacatccctttacattttaacttcactgagattgggatgcataatgaaattaatgataggaaaacattttgctagagttcaattagcagaatttttctttattacctaaaataataattcaacttcaaatgaatggctgcagatttgctaaaatatggttatactactattactgctaatagtaaaaatggtaatgataataagtagtaatcaacatttactgattgctgtcaatatgccaaaccttatttggttatattatttgtattaaataatttaatcttcaaaaccttcaatgaacagagaagttaacaaaagtggggtggaactgatgataaatctgtttgattacatgtgctagaattcagatacattcttctgtttgtaaaggaaaaaaagtcttttaaaattaaataaggaagatatttgtgctatatattactgtcttaaaattatcaaaaatatcaaaggactattaacttatatctgttctttaatttttactctattgttcattacgataccataaaatgactatataatgcccgttattatggtaaaccaccttcttaacatttacatctgaatataattacatatgaaaggaaatactcaaaaatcaatatttttattctgttttttaatcaataaagagaatactcagcaactttttaaaaatatttactcgtagtcatcctataatcctttgcatttaaaaacattttcctatctgctaatgtttttacattattggacataaagtaaatgcttgtcaaaaatcaatagtctccaaattcataacttatatttatctaatccttaagcactacacagttctaaacaaatagattttatactcacatctgtgatattttgaagttacctgagaagaatattaatgagggacacaaataattactaaaaatactcctttgatcaatttcatagttatctgatattaaatttccaagttaaaaaaatttaaacataattttaaaaagtcaagggtcttccttattcaagaaaattggtttaattctttaacacaaaatatttcaccatatggtcataaccagcactattggcaaagggccttacatatattggatagtcaggaaatatttgatgaatgaatgaacagatgcatgaataagtggataacaaacataagcatattcatctattttatttctaaaaatgtctcaagttaacatttttcatttgaaagatattttcaattacttactgagctgtatttttgcaactatgcaaatgatagcactaactttaattgtattcatttatctttaatcagcattattttattctactagtctacaggggggttttacacattacaaaatgcaaattatgatacatctcgagtttaagagaatgtcatttgtttttggattcccctacgacacagtcgagatttatttatttatttaagtaatcactcattggccaaatgtgttctgatttgtttctgatagaaacaaatgtcaaaatgacagaaattcttccttatcatattatcattacgttggacaccaaggacatgaagatgaattaaatatgtttctcacccttgatgaactcctagtaggttgtttaatgcacatttgttgaataaatgaatgaacaaatacaaaaattttgaaagcgctgcacattcagtcattgtatttagcaatatagagaatgagaagacagtgactatactcattttaacagttcacaacactgtactctattcataaaaccacacatcttaaaattactgacaggctcatagactatgctggctacattagattaatttcataggagcatatttagtcttatctacaaaattagaatgttcacaggggtaaacactgctttgaagttcaagagtgtgaatgaatagaatcttttcctaagagaaaataaggaaattgacagcattcagagaactatatttgttcctaaaataagtctattcattcagtcacagccatgtaaattggcagctgctctgacttagagaacaagattcatgctttacatgacatttatcttagcccctgtggacagagttcacatgagtaagcctatattgaccatggccctttttaaagatttagagtatctatgaaatgaaatgcttacagcaaaaaatgtttttctaaacagaaattttagttatatgtttttctaaacagaaattttagttatatgtttatcaaaataaaaatcattaaaacttattataacttctgtagtatgttgatttggtgtcccccaaccccccaaaaagatatttctacctggaacccatgaatgtgatcttctttggaaaaaggatctttgcagatgtaattaagttaaggatgttaagatgaaatcatcccagattattcaggcaggccctaaatccaaaaacaggtgtccttatgagataaaagcagaggagatttgaaatactcagagaagaaaaccatgtgaagatagagaaagagactggagttaacacagctacaaccaaggaacacttgggggctactagatgttggaaggggcaagaacatattcttccctcaagccattagaagaagcaacactttgattttggccttatgaccaccagcactgtaagagaataaattcctattgttttaacacatcaagtttgttgtatgttgttacagtggccacaggaagctaatatagctaccaaatcaaaaccattttcaaaacagtctattttaagtggtataaggaagttgagagtgagagagttacttaaatgagattgctgggttttaggattagaattacacttgaagatgtagcaataaattgagctaatcattcctcccaatctttcattatataaataaaaatcaatggctgaaatttggtttcctgagacagtttttcacccccatctctttgacaacctgttgcttctaaatgtcccggacatttgtatcctcccacctgtctgtactcctactaatcttctttagaaatataacatctcttgtctaaagaaatactctccttccttgagccatatctgtattctaattcacctatccctcataagccagaataatcttcctattgtttccataacttccgttttaaaatcctcaatcaattcttgttaacagggcaaattttaccagctttggaatgctcttcaagatgcagccccaacatgtttttccagcctcgttttttgaccatggattgcccaagacagtgttaagtgcctccttgttgctcgtggagcatcctgagactgctgttacaggatttatcacaaagctatataaccctctgcctctcccactagactatgactctcttgaagacatggataaggtattatttaccttttaaccctcaaaaactagtactgcagcaggactatcaaatctaagcttctggtggtctaaacataatcaccaggtgtgtatatttgcaggaaaacaagagtattgtaattattattattttatttgtttatttatttatttttgagaatcaaaacagcaagttttctattaaggatttcaaaagggaaggggtataataacagagagtaagtacaaagatcacatgcttcaaagggcaaaaagcagaacaaagatcacatgcttctgagggaacaggacaaagggcaaaagcagaattactgatacgggtccaacaaagatcccaaggcaaagggcaaaagcagaactactgataagggtctatattcagtagtgcacgtattgtcttaataaacatcttaaacaacagaaaacagggttcgagagcagagaaccagtctgaccacaaatttaccagggtggagttttttccccaccctagtaagcctgagggtactgcaagagaccaggacatatctcagtccttatctcaaccacataagacagacactcccagaggggccgtttatagacctctccccaggaatgcattcctttctcagggtattaatattaatattccttgctaggaaaagattttagcgatatctctcctacttgcacatccatttataggctctctacaagaagaaaaatatggctctttttgcccaacccagcaggcagtcagaccttatggttgtcttcccttgttccctaaaaattgctgttattctgttctttttcaaggtggactgatttcatattgttcaaacacacatgttttacaatcaatttgtacagctaacacaattatcacagtgatcctgaggtgatgtacatccttagcttatgaagataacaggattaagagattaaagtaaagacaggcataaaaaattatataagtattatttgggaattgataaatgtccacgaaatcatcacaatttatgtccctctgccgtggctccagctggtccctccgtttgggggtccctgacttcctgcagcaggactaaatgaatttaaaattttattttaaatttagtcccatgtgtttagtggccacagtattggacagtgcagatatagaacatttccattatcacagaaagttctattaaccaatgctgagctaagctagactcaatgtttttggaagagcatttcagctaggtgcagtgactcaggcctgtaatcccagcaccctgggaggctgagacgggtggatcacctgaggtcatgagttcaagaccagcctgggcaacatggcgaaactccatctctaccaaaaatacaaaattagccaggtttggtggtacatgtctgtaatccaagccactcaggaggctgaggcaggagaactgctcgaacccaggaggcagaggctgtggtgagctgagaccacaccactgcactccagcctgggcaagacagcgacactctgtctcaaagaaaaaaaaaaaaaaagcatttcacaggtagtgatgtgaacttccttcagaaggcatataatgtctggatgtttctctttgtattaatttagcagtcatttaaggccattgcctggacctattacttcattaggggttgcaaagttatgacattataattctatcatctccaatctattttattgactggaatgcttttagaaaaacaaaacaaaacaaaacttcctttatcaaccatttcggttaccgtgaagaataaatttatacaggaaagttaggatccaaaggtgaccaattagggttgttttttagtataattatgaacttgtgcacttaaaaatatttgatatgttttaattcattgcagttattgttcttattactactcaaattgtcttatctctagccaggattgtctttggaatccttttcacatgaccccagaagcttttgataacatttttctgatacaacaagatattttaggctcatcctgtacatttttccctcaaacatggaatcagccacacttccaaaaagtcattgtttattttaagacgaaattatatttaggtagtatggtctgggccctaaggggtgccaaatggtactgggctggtcattgtttctaagccttttcagtggacaatgctaagaactgcatttttttttttttttttttttgacggagtctcattctgtcacccaggctggagtgcggtggcgcaatctcagctcaccgcaaactccacctccaagctcaagcaattctccgcctcagccacctgactagctgggaccacaggcgcttgccgccatgtccagccaatttttgcacttttagcagagatggggcttcaccatcttggccaggctggtcctgaactcctgaccctgtgatccacccacctcagtctcccaaagcactaggaccacaggcgtgagccaccatgcccaaactttttgttgttgttgttgttgttgtttttattttattttatttcattttttaagacaggtctttctatgtccctcagcctggaatgccgtagtgcaatcatggctcacagaagtcccaacctcacaggcccaagcaatcctcccacctcagcctccccagtagctgggaccacagatgcatgtcaccacacctggtcaacctgttgattttttgtagagacggggtctcactctgttgcccaggttggtctccaagccctgggctcaagccatccccctgccccagactcccaaagtgctgatactacaggcatgagacaccatgcccagccaagaaatactttccttttttttttttttttgagacagagtctcactctgtcgcccaggctggattgcagtggcatgatctcagctcattgcaatctccacctcccaggttcaagcaattcttctgtctcagcctctcaagtagctagggctacaggcactcaccccaacgcccaactaatttttgtatttttacctgagatggggttttgccatgttggccgggtgtaattattattttaacattccgaagaagattatgcacctttgaggaggtacaaagaaggcagggatgattagtctagctccagaaatacagacttgaaagagagcttgatgataaggtagaagaatttatcataagacactgttttaaggcctgggtaaatatattgaattggatagcattccctcaaagttcatgcccacaggaaactattaatgtgaatgaatgtgacctaatttggaaatagggcctttgtaaatgtagtcaaattaagataaggttacagagggttagggtaagtcctaaatccaatattactgttccccttataaaacagggaaatttggacacagggacacagtcacacagaagaagagatagagattggagtgattcatctataaactaaggaatgccaaggattgctggcaattatcagaagctagaagaggcaaggtttcttccctagagcatcttttgtttttccaagcaatcctcctgcatcagcctcctgaatatctgggattacaggcatgcaccatcatgcccagaaattccctagagcctctgaaggaaccatggccctgccaacactttgatttgagacatctagcctgaagaaccctgagagaatacgtttctattgttttaagccacccagtttgtcatacgtcattactgcagccctaagaagctaacacagcaactaaacaagatattgaatgtggggaacagcattttcttcatttctgtgtagaacatcacttggatttagtgcccatgaacttgataatttgtaactttggaaatactggagaaaaacctctcttgactcaaactcagcgttgtcactgtgcatgctggcccaaatagcagttgtgagatgccattctcaagtgccttcaagaacagacagcattaacaaaataaagccaaagtggaagattatagaatgttaatctactcagcctatgtgacactctctgggatctccccagaacaagtaggtgagattttttaggggagctgctcaagttttaaggacaactccattgcaaactctactcttgcctgcttagaaagtagttcaaaacaacttgctttaaagtaaaactattcacataaatgtccaactctaaacagacacgggctttgtgaaaatgacttaaaatgaaactggatgattaaatttgtattattcaagatgtaacatggagatctgtaggtagatgctaaaaaaaatagcttggatactttatgctatcataaacggagtggtcaatgacatttagatatctgttatctttagagtattatttgatcaaatctgggcatttatttttaatttcttttattttactgcttcaaacacacctctcacattgctttatttgaacatggagacatagcctcttttctcactaaataaatcccattacccttcaaccattcttcctgtttaaaagtacatagtcaacactaaataactgaccctaattcttaaacatgtagctggcatttaataaaatcatggctgaatgttgagtaaaaaaatgtacataatattgtttacttgtgcaccctttattggcatctagcttgtatattataacctcttttcctcttttaagtatttttcttcagccaggcgcagtggctcacgcctgtaatcgcagcactttgggaggcgaaggcggatggatcacgaggtaaggagaacaagaccatcctggctaacacggtgaaaccccgtctctactaaaaaaaaaaaaaatatatatatatatatatatatatatatatatatatatatatatatatatatatatatatatatatatataaaaattagccgggcatggtggcgggtgcctgtagtcccagctactcgggaggctgaggcaggagaatggggtgaacccagcagacagagcttgcagtgagccaagatcgcgccactgcactccagcctgggcaacagagcgagacactgtctcaataaaataaaataaaataaaaataaataaatcttttccttcctcttccaattcactgtcaacagagatctttttctaaaatgtaaatctgttttttgtcttcagtgattggccattgtccttgggatacagtttgaacctatatcagggctttcaaggcaaacaagaaaagtcttagacaatgaggtgaaggaccaactctcagacaaatcttccactcaaaattttgtgcctgggacctgtttctctgaattgcccttagctccactcccctcctggcatgttcctactcagcagtccctctgtcaatcatttggcatgttatttagcaacatttttcaaattgctttgtaattatttgtttctgtttccaccccctacccccacctcccaagtaatttggagctccctgaatatcactcaatgcatcaactcacttgggggtagtgcctacaaccaccaatagtaaactcacttcagctctctccattacagtgtctagtattttcaacaggaggatgacccactgcccttaaaatgaacttccaagtgccagtacttgaggccctttgaccttgaacagttttagaatgcaaagtcacaggggtgtgaggtactccatttgcattccacactctaatgagagcacaactcatttttacatatttgattgcatcatatgttttataccaaaatagagcattccctaaataaagagaaatatctataattagatttttatagcgtaggactactgaccagaaaaaaaaaaaatgcattggtgcattggctgccaggaataatgtattagacaaaacacaatgtaaacttcaattgttgttaaacagttctttccttttgacaatgactagacatatatatatatatattttaactttttttttttcaatttatatgccccctacttggttttcatcaagttcacatcaggggaaccctgtgataatcagacagaaaaaggttcagcataggaaaagctcaataagcagtgggaagcagacctgaattcataacaaccactgaaaagtggactgaaacccaggtaaatcaactatgaaaaaagacgaattatgagaaacagaaaacaattcgagataatcactgttaattacagagaaataagttcatattaaaaactgtcttagattgcattattctgtaacatattcatatctagcagcttttattttaaatttataaaaaatctactggcatatcatgcaaattttaaaaaatctagtatgaaatattagttaacatgttttaacttttgttctctaaactttatgaatttttaagtacaattggtttttacttgatttcaacatttgtggaggagaggggtggacaaatctatatttaatatgcaagatgaaattctagaaaaataggacctgtattttatattttcagttaataagctttttacatagtggtgttacccacatattaattacaaataaataatgatagtgagataccttaccttgcatagtatctctgaataaggtaattaactcctcaatgcctcattttctcatccataaaatgggcataatatatacatttgagcattatttggggacttataaaaagaaagatatgaaacactgcctcatagttgtcacttaataaaaggtagttgtcatttttattattataaagtgccagatgcatggaaaacatcaaatgattatactcattacaaattatttttaaaatgtcactaaaattttttaaataattaaatatgcagcgtatttgaaatgtgatttactttgagaaaaaagagcacacacaagtataacaacagtctttcaatatgataaaaacatatcaggtgtggattttgctgcacttgtattttcaaactagaatactacgaaggtaatagaatgcaacttccttgagtgtacattatctttaaataatttcttggaaaaatacattgtttttattcttaaaaaataagtggtatagagaagagtaaaaaagctaataaatgttatttataaaccttgaaacttctcattttgtgcaagtggctttgagagacacacaactctatttcagtataacccaaaactcatttgttggccaccagacagtagaatgaaaaggttgaaaagaatctcaagtatgaaaagattgagaagaattccctggaacataatgtaataaaacttattttcaattaaaaatatgcatcttattcagagacactatgcaaggtaagataaatttcgactcagttgtgaatgcaaaggccatgctctctcagtatacaatgttgttgcatataaaaattaatatttattccacatctaattttccttgggcatttttaggaagacattcatgaagttttgcacatcagccaagactcttaatacctggaagtgactattgtatattaaataataatttccaagtaagccatttgatggtgcctccactctggcctacagtggatatatcttaaaagagcttgcccaaatagatggtttgcctctggaagtttagtgataactattactactaatctctaatgagtattagcaaaatgattcctgagaaaataagcatgccacactgaaaattttctatcttgatttctaacataatctgacaaagataatgttttaatgtagaaaaagaagctattggcattatccttgatgattcatcaaagaggacaaccatatgggagatcaacattatacttagcttaaatgcagagtcttgaatggaaaatataatttagggctaaagaaatatggctaaactataagaaattgttgctggccctgggaacacttttaggtaaagtattaaccaccaccccaggaagaataacaaatcctaccagatgtttcattaaaagtataagtatattgggaaaggaatattgtgaggagggacttacagagtcatccaacaagccacagcaggactaggatatcacatcttcaataattctctcacctttaggtttaacctgagataaagaatacaagggtctcagcagctatcctgtttctattttggatagcccggagtgctccatttcccagtattcctgggggatatgacatattaatgatatcaaaatattgagtcacttaccaaatgtgacctaaggattctagagtgagaaaatattctaccttgatgtatttggaaataaaccagcatagaagattaagaccttaaattatcatctttaaggaactaaacattaatgtctagttcattgtttcttaattttgtttcacagacccctttgaaaagctattgaaagttatatacgcttaaatactaggtatagagaaatgcatttactcagtgtaacttgcagataattttatagggttcatagaacacattagacaagactaaagacaccagttcaagaccctctgggtctgtatttgtcagttcttttcaaaatctctttcaatgaatatatattttcctcctgattttcagttatttcacagcattcttggtcaaaactttaagggtacttaaaggagacagggagaacattcaaattgggcaatctggggatagttaaataaaagatttatttacaaaggcatgcacaaagtgtagtaaaagcaacaagaaatagttcaagacccaataactggcgaatcattacattaaaaagtgagggggagcggtggttatgggagctcataactactgtcatcttatctctgacaggcacattcattgacatataccaaacagaagccagagtacaagaagcctggttgatgtagttcatagaggtcatcctcccgaagcacagagcagcaaagagaagggtagaggaagtacctagagggacaatgtagaatatctgagaaattagcaaagcaggtttctttacaaaaataatgcaatttctttcaggaaggtcttagaaaatgtctggctctttaatagtatgtatgatgcgcccttattatatagccatctttaaacaataacaatggaaacttctaaatcctgctgaaaaataaaccttatttttccatatgtgtttgcttattcataatctgccgtttttaattaaaaaagcatttaaggttatctacaaaaatgcaaacataaaaaatttagcacactaacataaaatgatgaatggaaaaacacatgtaaaagggaaacaagaatagaaaaataggcagggcacggtggctctcacctgtaatcctagcactttgggaggccaagatgggcagattgcctgagctcaggagtttgagaccagcctgggcaacatggtgaaaccccatctctactaaaatacaaaaattcagccaggcatggtggcgggcgcctgtaatcccagctacttaggtggctgaggcacaagaattgcttgaacccaggaggtggaggttgcagtgagccaagattgtgccactgcatccagcctggaaaacaaagcaacattctgtaaaaaaaaaaaaaaaaaaggaaagaaagaaaagaaaaaaagaaagaatggaaggaaggaagggagggagggaggaagggataagatggggtcaaggataaatctcttattttgaaatccaaaacaagctagagatggggtctatatttaatgttaagtatacttgcagtcaataaaatggtaactaatttgcttacataatttaaaaggtaaattttataattataagaaaaaacatccttactctggaaagtataatttctagaaacagaaaaatgattcttatgtagatactcatagagaaaattctgctacctaatgaatgaacaatatattccacagcatccttaatgcatatgtatgtctacagagaataagatgcatattctgcttgggatataagacatgttcttttattaaagcaaaggagttctgatttactaggagtaagatttcttcaaagttcagtagaagatcaaactacttaacaatcctacgcttcatcttttctctctaaaaaaaatagactcaatatgctaggacaatattagaacttatcatatatagaggttcaaaaaataattaaatgaatgagtgatttttggggattatcagccttctcacttgttctactggatatatccaggtttactgaatcctaggtcaccttacaatgagaatatatctctgttaaagctttttaatgttttcctaagttttttcaacatgtattttatttttaagctaggttaacttatatatctattggtatatacgtttgctctttcttttacttatatttatgtaaatcaaactcagaatgctttataaaagtgttacctacaaatgtatcctcaagctatttaaggtttttagagtttttattgcctcatacactaagaataaaatacatattcttcttaaataataccaattaagcttttctcacaattctcagcctactgcctgtagtagttactttactgatatttgtcttccatttgttaataattcagatcattcaacatgcaattggtatcacagaaacaaagtcttctttcaagtttccattttggtgccattaggtaattttcaggaattattctatgtcacttattactaaacaggtttttgttatagttcatattttttttactgctaccagattttcttatcattaaaatcatatgtctacataaaaaggtaagaagaggtaatcataatgtatttatggattacatagaatagacagatccatatactttacattgatgaatctagttttagaatataaaaatatgctcaccatgattatatagcactttcttatatgttttagtaagataatgaatattttattcctgatagatgtttacttttctcttcttacctttttgatccagacatatgattttgatctagaaatacgatgataaaaataattagacctttagaattcctattcaataggtataataattattgtctgatgcctaagtcttaatgcatgattccaatggcactcaaaagtgaccctttaaaaactataatcttgtgtagtttgaagtcgggtagcatgatgccaaaagagcatggtactggtataaaaacaggcacatagaccaatggaacagaatagagaactcaaaaataaaaccacacatctataatcatctgaccttcgacaaacctgatgaaaacaagcaatggggaaaggattccctgcttaacaaatggtgctgggagaactggttagctatatgcagaaaattgaaactggaatccatttctcaccacttatacaaaaatttactctagatggattaaaggcttaaatgtcaaacccaaaactataaaaaccctagaagaaaatctgggcaataccattcaggacatgggcacaggcaaagattttatcatgaaatcgccaaaagcaattgagacaaaagaaaagattgataaatgggatctaattaaactaaaaagcttctgcaaagcaaaaggaactatcatcagaatgaacagacaacaaaatgggagaaaatttttgcaaaatttcttaaacaaatttacaagaaaaaaaaacattaaaaactgggcaaagtacatgaacagccacttctcaaaagaagacatttatgtggccaagaaacatacgaagaaaagctcaacatcattgattattagagaaatgcaaatcaaaacaacaatgagataccatcttacaccagtcagaattgtgattattaaaaagtcaagaaacaacagatgctggcaaggtttcagagaaataggaatgcttttacaccattgctgcgaatgtaaatttgttcaaccattgtggaagacagtgtggcaattcctcaaatatttagaactggaaataccatttgactcagcatgactcagcaattccattactgggaatatactcaaaggaatataaatcattcgattataaagatacatacacacatatgttcactgcagcactattcacaatagcaaagtaatggaattgtcccaaatgcccatcaatgatagactggatgaagaaaatttggtacatatacaagataaaatactatgcagccataaaaaggaaccagatcgtgtcatttgcagggacgtggatgaagctggaagccattatcctcaccaaattaaagcaggaacagaaaaccaaataccacatgttctcacttacaagtaggagctgaacaatgaaaacacatggacacagggagggaaacaacacacactgggacctgtcaggggagtgtagagtggggagagcatcaggaaaaagagctaatgtatgctgggcttcatacctaggccatggtttgataggtgcagcaaaccaccgtagcacacatttacctatgtaacaaacctgcacatcctgcacgtgtaccccagaacttaaaaaataaaaaacataaaaaactataatctgaaggaaaattaactgggtttgagttttatttgtatttttttgtttcaaagttttattataatgatagaaatggtcacaaatgaaataattcatttcttcaggtaaagagtatcctcttttgaaaggcaaatcttcctgcttctagaggaattcatcttagtgaggatttatgcaattagatgacacttcttcctggtaattactttatgtggaagtaaggagggccatctttatggtggtgggaaagggcaggtacattgcagaggtatagaagtttgaagttcattttttttttattacgtttttattttttcatttgcacataacttattgtttaggaaatttcactagaaagatctctgtcatggaatatctgcctagggagtatagagaaaagtatgagaatcatgggaacactgtttaatctggagatctccagcctggacatgagccattatacaactcaagcttttatgcttatctgatgagttatatttatatctcagcttcacttctaaactttgaaattactttactacataatttttgtagtccattgtagttcattttgaaatttcatccctaatgtcttttccagttctgcaattctgtgatctgtcatcttctgaactgggtattacatgttctctctcacacacacctatgagatgatatttccagatgtttatctcttaagaatgcactagccaacaagctttaaatgatagacagggatggttcaagtacaaaaagcagtttgttaagtattagattaataaaagcgtttatacaagttaattttttaaaaaaaacagatgaataagtcaatcaaaatctcaaaaataatgattgaatcagtgcaacttctctttctcaatttattaatgaaatatatgcagacttcaacatgcatcatgcaaaaatttactgagatggataatacagacatattgaaatggataatatcaatgtaaatttctgctaattcaacttttcttttgaaaaaaaaaagaaaacaattttattgctctgatgagtagattcaattaaatcaaatgtccccatgggtgtctttgaacggtagtgatacctaaactggaaaggaaacgtaccttttgaacaatatccaggaaatgaatatgtgtctgtgatgatttttaggacaaaatagaaaatatacaacaaaaacttacacacaaaatattggctttttttttttaggaaaacaaatcaattataatttctggaaactaatcaaataaaggagctcactccctttagagtataatgagcttcatttgtcttttgtccccaaaattctaattagattgtcttccattttctctcttcccttctctccccttttctctcaggcagacacaatctcgatacccagggtattttaggtgtgagctgacttaaatctttgtatttcaaactgcttaatcaagcataaatggacacagagtgtttcattctcttttaagaatgtattatctcagcccagatgaaatgactggctctttcattctatacctctgtcccccttcttgctctacctaatttccaaaatagattgtggttcttcaaaacaacttgctgcaaagcacataaaaaaaaacaaagagctttgttaatgttatctttatattatcagaagcaataatgtttccattatttatgacataccccaccacacagaaaatcaatgttaataaccaaggaacacaaagaaaatcccttattgcttcgtgttcacacagaagttctaagacagaaacaggctcaagttgttccttagatctccatacttcttagaatcccttgacaacattcttgtaagtcattttgacattcaaaaggagatacatcaaaaaggttctattttcaaaatcattttcctttttcttttactgacagtctaacaacacctatcacttcctacttacctctcactctcttcatgtgttgtcctccaaatctgtggataaatcatgtgacatattcaacgacataaaaaggaaaagagtcaagtattcaaacagaaagggttgactgagcaggtggcctaaaatcaatcctaaaatctacactctagagagtaaaattatattggagtctgatgtgatatgaatatcaaaatgtagtaaccaaggaccttggattcaggacaatttagttcacattccatgctatcctttccttgatgtgtgatattcagcaaattaccaagattccctgagctgtcttctctataaataagggctaccagtacctcctttaaaaagttactgtaaaataaacatgtaccattaatgtaagcatatagtagacacctaataaatggcagcaaatatgattgttagtattaaagttggcagtttagagaaaggagaggtcatatagcttttagacatactggtacacggtaactccttgaagaataaataggatttacagagtagaatgaggagggcatttctatcaattggtgcacttaggaaattctaatcatctatttctaataccatacccattatgagaaggcacttgaaaggtgttatgatagtcaccctatttgcagcccactacctagtatcaccgaaattcattttaaagtattattctttgtttaacagccaagaaatgaaatgggaaaatgatttcaatagttgtactttgtatgtattcatatttatgatggaattacaaagagaagtagaaagtcttgtccaaagagaaatcattttttaaaatgctgatcctcaagaacacttgtgataaaggcagataattttccttgcccattacaccactagaaagtgtgaatagttcatttgagcctgtaagattgcttccttttatccctgacacagtatcattcaattatgttcctaagtctgttgcattaattatatcataagacttaatatattagcttatcaagaacttctcaatttaggtaatgagagcttccctgagaaaaaatactcaaactgaaaactagtaaatctactcatactcctctctcttttctagaaaaggtcatgggtcatcttcagaagagtccctaaaataagtgatgagccaaaattcatataaatttctttcagtcaaaacataattacaccgataatctactgaaaataaagaactttattttctaaaatgtgttatatttgctatatcttatgtgactcagggcaaatctctgaacttctctgaagcttaacctgttctcttgtttgtcagagtgggatgagagtaactgtcctgcttctcccataaagtctcaatgaggacaaaaataaataatagatgcgtaaatgctttgaaactatatatctctatgcagatattattattaaaatcaatattaaatggatacgtaagccaaagcaagcaagattaaatgaggtcacgggaatttttttaaggacaagtaaaaaagagacctttaaaaatagcaacataacatgtattcaataaatatttattgaataaaagaatgaatgaattttagtatataaataaaacatatttgagtaaaaatatcacacatataggtttttcagtcacctataaggttcctaatagtgaagtttaaattgaacattgtcttgataattttatttaaaataataaacagaatattcatcgttgagctcacaatataatattttatactgtagataccagaacctctataactacttgtgaaaagaatactgaataagtgtatgaacaaattcgtcactcaaaacaacttctaatgtaggaaaagaaatttcaaacctatttatttttagcagccacattaatagtgaattattataaacacaccatttaaaatgcatcaaaaactttctagttggtaaatattaaaaatcagtgtacatgatgctaaatggtgggcacaatctttcaaaatggaatatgaatctcctcccagaatattaaaacatgttttttcgatattattgtttgaattatatatttgcattaactcttcctagaagcaatatatgcctatggctgaaattcagttcatttatgcaatctcaggtaatctcctggagaatgacatcaagtataacctctgttttgacacaaataaaaatataaccaagtcttcctagttttttcaagctaatttttccaagagtgtaaagaaagattcattcattaaaataagtagacaaaattgcttttccataaaaataacatactatttaataatgttataatatttagttgatactaacaataattaattaatacaaataataatttgtaatatttgtatttgcaaattgctccatcatacatcaacatctcattcaagtcacatcaaggttatatatgtggtacaggtattatgtccagttactcatccataagtgtgaggtaacatctgtgctatttaatatgctaagcctcagtttattcatgtaaaaaccaagctgaggttaattatgaatagcattggagatagatgtacatgaacacatattttaaacactttcattaaatttaaccatggaaaatataatgttcgtgagaaattatatgtgttaatacaataacagtctgaatatttcctagtgatgggtcacatgatcagaaaatcaaaggtgcataagtcaaattgggtatttatttttttatttcatagaattggagagtttagacccttagcttaattataggttttcactgtatacaaaagtgatccaaaaaccagattaatatgttatttttactacataaacaagagatccaagcacagtgcttatcattgatcaattttgtaaatcaatgagaatgtggatagttaagggtctggagaattgttgagaacaaagagtgagtatgatatctttattcttactccttggcttcactttacacctctgttgatcactgtttccatttaagcagttggcctgaaaacagaacctactttcatggtgacagttacaaactccacagttttactctctggccagagaaatctggatagatcttagatttctataactgacctcaggagtccaagaattctctgtttcttagtcaatatagttcactttgcagcttagtctttatttttttttcaatattttaacaatatatcttgcatctgagtcatgcggattgagcaaaaacttccataactggagcaatccgaatatagtattttgagagcagaaacagagattcaacgtacaactcataatcataaaaatctaggaaagctttgtagttcttcaaaatctgtgactgcatggaacttaggaaagttcagcaacaggaaatgaaggaagttgccagttgttgtccagcaactagcagacaaaactctggaatttgtgaatgccaacacttccttcaataatagcaatgcccctgattttttttcaggcttcaagttgtgtgtgttatgtgatgtcctgtcacatcagtagaaaagtacaatcatgtgacacaccaaaggcctgacaagtttggttcctatgaattcttcaatttccaaaactccttgaactgaggaagtggataagccaaaaccttcaaaaatatgtctacgacctaagcgactcactatattttaaaaaaatcaaactgccataggaggtttcactttcttgtaaatgtccccgcctggcaatggctagtaacacaaagacaatgatgtcttccttctatactttgtgaaaaggtttgacttttaagtttcagaaagacaaattttctcataaatgacgcaatggaaattggattaaaaagctgtctcagttggctttaataaactaccaaagtacttttgtttcgttgttccattctaggcagggaacacagcaggttttaatggtcagctaccactaaaaagctaacagactgcacgcaggcaaaacattaatcaaaactgtgaaatagtttccctttagttccctggatctccccaatttgtgccctttctgcccttttccaccctttaaaagctcaacatacctgagttctctatactttattttcttcttttacagtggtgctcacccttgagagcattcatttttatatggagcctagtagacttaacccaaaggaatttatgtctaaatgtgaatttttattgcaaaaagtaagtgggcaggagagggacattctagagttagtgaagtaggaggcaggatgtaactgcagaggtggggcttagacaccacaccaaattgaggactagctaaaacaggaccggggtggaagcagatttccacaagacatgcccaccagtgcacgatgtaagtttaccattgccatggtaacacccgggcgttgcctcccctttccatggcaatgacctgatgaccccaagttactactccttccttagaaatttctgcataaattgccccttaatctgcatgtaattaaaagtgggtataaatatgacagcaaaactgccctgagctactactccctgcctatagggtagtcctgctctgcagaaggagtcacagagctgtaatactgccagagctgtaacactgcctcttcaataaagctgttttcttctacctccatcttgcccttgaattctttcctgggcaaagccctggaaagaaaattctttcgtgggctaagctccactttggggcttccctgccctgcatcagtaggatcatactagcagccttctacatttcctaagcagaagctttgagtaacacccaaacataactaactcctattgtctagattataaagggcttgatatctgtgtatgtttttataagagtaccatttaaaaaaggatttaagattgtatttagggtttaacttcctaaagcaatcagcatgtacaaaaagataagttctgaatattcatgacatcgtgctttctataatttgcaatatctgagttgtaggttttaaaagacaagaatgcagacttgatttagatgcattcatctcatacagtcttccaaaagattgctttccagctattattttatcagtattcatacttctcaggtttcattaatgtgtctaaacattttgtttaagttcacttatgtatttaatgctcaggataataccgagtgtgtaatctataccacatctgaaatgatgtgacaaaattttcagtcaaattctacaatccccactctaacaagccttctcatttgcctcgtatattccttagcttaatctgtacttttctgccacataaggttttgcaagttttgcactgtactatcaagatgagccattcaggcataccaggctgtgactatttcacataaatagcacttgttgggcttacacaaaggatagcctgcatcctgactacaggtggtatcactgtgtgctatctactgagtttgggaagttcattaatttgatttgctcatcatttcatacaaatgatgaaatgtatgaacgcacttccatcttcaatccccatatccaatcaatcacttaatcctttcagttctacttcaaaaggagcctcatatatctccctttcctatttcactacctttatccaggcttcttctaacagtatcctgcaccagccgtctaactagctggatgccttaccaccactttctcccctatccagtctctccttcccattgctgctacttttcttgctgcaatataaagttcctcactctcttggtttaaatttctttagttgcctactttagtaagcaattagataaaatccaaattattttcctaagagacaatgttgtcttagtttgggttctttcagaagccaagcctgaatcaaagattcaagcacaaatcaaactttggtgagctctttccaagaaacaagggtagggaaatagaaaaatgtaagagagatgagaaagcagtgacaaagagtgtgttatcaatctaattacatttgttgaatcctgctgggaccctggggacctttagagaatatgtacctcaaagttatttagcacaatgggcaagggaactggggtaataatccaccaagttcaataattggttgtggactattctttgaggaatgttaattctccagcatttctggctgccccaattgtaagcagagaaagttccaggaggtaaaaccatcagtcgtgggtagtttgaaattgagccagccgtcatggtattgtaaatacagtactaaaaagacatgggggaggggtgcaaatgagagtatgtatcccaaagtatctgctaatccaccgacatttaacaccaggctaccattccagcctcattacctttcacactcttatccaacatccgtcttctgcctcatgaaactcacttctcttagacatgctagatattttatgattccttgattatacccaagctactccttctggctccattctttgcccagcaaaatctttgattttaaggcccagctaaaatatcatctcttcactaatgactttgttctcaaatttttagttgtttttcaagatcccagattattgaattaaggctgtgacttgcaagattccagaaatcgaggtaaaatgtaaatcttttgaccagtcattcaaatgtttccaagtagccacatttccttctatatttaaattttttatatatcaacctgtcattctatcatagttaaagtgaggctttaaaacataacatatattagaaattagaaaagtgcctggcacatgttaatcattatataatgccagctattgttatttgtttaatacacttaagaagcaactgtaaaagcttttttaaaaatgcagacccccaggccacaaagccagagattctggtttagcagatgggctccaggaatttagatttgtaaacaatcacactacgtgattctcttgcagagcagttgatgatagaatgaccagactttcagatatgatgtggacgatttcattttatacctgtttttatggtttaattatcaatagtgactcctttcactttcaaaagtgtcccagtttgaacaaaaaattaaatggtaactctatggaccacattttgaggttactgttctttagaaaaatgatggctgacgatatgtatcacaaaatttttagagaagtcattttctgacactttatattaaattgtgtgcagaaaagactcaaggaaagacaagtgatggcaaagattattatggcaatttccctagtcactaaactatttcccgctgcacaatccctggtgagtttagagtaggagttaagaaggagcctgcagggaaagcaactttgctgtctcttggtgcctgttttgagtctgagtaagaatgactctgccaagtatattaatattgctaaatattattttagaaaaatatgctgtaaatccagattcagaccattaatgaaagtgtacaattttcaaacatgccatttcatatgcaatgttgatgcaggccttctcagctaaaaccaagatgataatgagtcacggctggcttttcagtgagttacagctatttaaagtaatgtggtaattggaagtgacactgtagatctgtgtgtttattctgggttgccatgttgtggttatagtgcaaaacctagaaatactgaaaaaacatcaaatgtatgtgtcaagttaatttgccactccttttgccttaggctgattagcacaaattaaattggccactaataaactcaagatgttattatagaaagcaatatgaaaatgccacatatgcattctgctgattatttttaaaaagccacaaaaatgcatggcttcatagttttatatttaaacaaatatgaacagatagagactagtttaataccttcaccacttttgataagtacatatttaagcatcagtgcattatcatatcaaatggaatactttatatgtggatataattttaataaaataatctttagagaaaattacatttttctttgttcaaaataaaatatacataggaaataaagtacttgtttagtagcatacaatttggtgggggagggtggtattggcactgaccctatttctacagacttccatatggacatgcttcttgataagtttataggtaaggacatagatgggctagagagtggttcctgaaataagaaattataggaagaaatatttatatggaactgaaaatatcataagagggaaaggaagttcagttattttttctcagagagaaaaggagttttaaaaaagaaaagaaatgaaggaagaaagactggaccaaaaaaacccaaaacaaaataaaacaaacttagcaagatgactaatttcacttctatgtgagagttgataggaaactgggaaaggatattgagtaacattgagtctattcatttggtggccctattaacacagcttaaaactagatacacggcagggagaaatgatacttacaaaattatataaatgtaccattttagtctactcagaaatctataataatgttagagactgatttatattcccaaatctttcacttattctttgtacacttttagataggcaatttggaaaaacaaattagtgatatcaagattacttttctaatgaaggtagtggaggacccttgggatctcaaaagagaagctgggtatgtagctaatcattggtgctattaaaataatattttattaaattttgtaatgcagctcaaggcaaccaaaataatatcatgtcagagtattaaaactgatgataaacaattaagaaccaaattccttatatattttgcaaagagcctaaattttaaaatattaaaagcaaaaaaacttttccaatatttgtatttaaacagaaaagggaattatgtaaccttcataatatggttcttaaaatttataaagtaactgtatttttaaaataaattgagttattttaactttgatccaggaaattgtaaaaattgtacataccaaagggcaacatttacaatataagtattaccagaagtaataacttaaacagtggcatggaagccattttaggtattagttaaaattggaggctctaaggtcatggagaccttagtttaatttaatataatctctgctacttattagctatttgatctttggtaaattatttaacagttctgagtttgagtttactcatgtgtaaaatagagatattaataccaaattacgctgtgaagattctataatgaaatagtataaggaaaatactgaatgccacaaaaattgtagcaggaaatctcaataaatcataatcaaaaatgaatcattatgcttcctcatttaactacagaagaaaacacaaccctttaaacaattgcagatttaatgaagtgtagacccaaagtcttatttcttgtctcttaaaatcagtaggggttatgagcaagtctgaagatagtatacttcccactggttgtatacataataaagataattacccatattaaaaaaaaccctttgtgtcagcttactaatctgtgtttcttcttatttttatatgtcccttcagagagacttctctgcagggaatatcaattatgcattttccctacctttacctacattcactttgtgtgaaagcagacaattagttctacttttgactattaaattactctaatggacaaaatatataaaaaggaaataaatatctaataagtcaatatggctttattagctgacattttgttagttttctctattttcttaccttacaaaggattaaaaaggaatagtggttatgattcccagctaatggacaaagcaaaaactatcctttagacataataattgatgggaaaatgaaatcaaagtgatccgtacaataattttactcattgactacttcagaaagctcctaagtgatcaaaattatagtcatgtatttctttatagaaatagataatgggagtacataaacttaacagttaataacattagttggggtatggaaattaataaaagcttgggggaaacagctttagtttaacaaatgttagtttcttttttatccatatagtcaagattctttagcctttttctcttatatcatagtcacaactgatacatttagaaacgtaaatgacttggaaaagatccactgatttttctctcatttgattataagaaatatatgtgagactggtgcaaaaatgctaagccaatgggatggtttcactggaacaaagtgaatgtccacctttttcaaaattcagtttgtgtggaaatttttaggaaatgactccatgaaaattaggttatgttaattccttgctgattcattatttcccgctgacaagcagtaggaaaatatcttagataataacttagatagaggcaccatatacgatgatgttcattcagaggctaatagtttaataacagagaacataaatcaatgcaattctcctctttgagaaacactattaaaagagtagtctctctaaaattcaagcctgtgttaatcttttgcttaaaattatgaaaggctttccagttcctatagaataaagtccatgctccttagcataatttgattctacttaggtacaggttcttatctcattcctctgtccccactcagctcccagaacttaactgttttatttgggttaatgtcaaatagcttatagatgattgaatacactgtgttgctttagagcgctatgactttgcatctgctagttctctctgaggtgtctcatccctccacccacttctaactagttccatccacatgcaaaatattcatgcttcaaaacccacagctcaggtgtcatcaactcagaaaggcttttctgatgtccctagatgagataaatctttgcgctctcttctgtaataatgttttaacatacatacatttcactcttcacccatgtcacactgtattgtttctatttttacatttgctattgtcttctattagaccataaaatctttgatggcaaggaatgtgtcatgtactttcctcccgcaaatgttagctacttgagggcaaaaatgctgttttgtcttcagaatcttcagaatctaacagtccctggcatgtaatatgcactcagcagatacaataagtattaatatttcaaagaataagtgaatggataggttcatcttgtcctcattcttagcaaagtacctgacccaaacaggcatataataaaaaaattgccaatcacttgaattgattctaaaattaaacttgattactcctatgcttttgatttcctatagaggaaaagaagacagcattttttagtgattgtacatatgaactctacctgggatacatataggtaaacatttataagatatattcttaattcctcctgtattacttaagtaaaattgttatccattatatatcaataattaatatgctaaatcttcatatcagttacaaatcagacaaaactaatataggatgagtcacctttatcaacctcattgctatctacttgaggttcatattgagaagacagttagcctactgatcccaacagttcctttccaaaggcttctcctgaactgtgagaatgtcttcaaacaaaacttgatttaaaaaaaggataaaacagttaaatgctagttcaatttctgacttgttatgggcaacatgaaagctgcaattgtttctgatgagaaagtcaagagtacattttttttttaacccttctttatctagaaagcatgcattggtgacgcttatacatacagcattataccagacgccgtggaactagttcaaatcatggataaatacattcttttttttttttttagatggagccttgctctgtcgcctaggctggagtgcagtggagtgatctgggctcactgcaagctccatctcccgggttcacgttattctcctgcctcagcctcctgagtagctgggactacaggtgcccgccaccacgcccagctaattttttgtatttttagtagagactggttttcaccgtgttagtcaggatgctcttgatctcctgacctcgtgatcctcccgcctcggcctgacaaagtgctgggattacaggcgtgagccaccgcatgcccggccaaatacattttattcttatgagtatattccatgcaagtttagattctattaaaaaaatactaacaactaccctttgattgaagcttatgattttctaaaatctggggacaaaggacagagaaattctcattgtgcgtctaaagttccccgaattgaaaagcaaatcctagagatagcagaaatgcagctagattttatcaacttggtagaacagtttgagggctatttctaggcaaaagaaataggcgctacagtagagaaaattattcagctatcatgttgctcctccttttcattttcactgataatcaatcagcttttaatcagaaacaattttgaagggtttttttgtttgttgttcatttgtttttgttttgtttgtttgttttgtttttttgtttttgggttttgtctgtttagtaaaaggattcatttcactttaggaaaactcagcaaagtgtagaaggggaagttggcacttagcctagaccttttgtgtcttcaagtttccaagttctaagaacagcatggagccctgctatgttagagagggaacacatctgagagatgagaatgagtatatctggaagatcacagatgtaacaggaggcttagcctaaggaaagcaccaactggataatgagagttaccaagaaaaggtaatgacagcatctcaaaaacaacactaaagctattatgttcaataacttgtataaatgctttataagtgtatcccaaagcctacaaacaacatctagctaataacattcaagatttgtacgttccttatgtaagttaaagtggacacattgggtgttccaatgcagaagaatacagagaaatgccacaggctgaatatttgggcaaagactaacattctcttgctgacaaacatgtctttgtattttgacataaacttcttatgtgcagattggttctgtggaaattacaaactttttgaagtcaggggaagggatgaaagtaaaattaaaaattaatcttttctaaggaacgttgtaaatctaatagacattaaataactgcttgaaattctaatcagataaaaacatctagaccaaacaataaagtttagatggacaccggggaatgagagcaaatatttttcaagatacttcttcaaagggcactacaacagagaatgattcttagaatctcagggattttgaaaaaattagccgttgtatttctttgtatttatttcacaaaaagtattgttctttaatcatgtatttatttaaagtagccataacattccatgtatcattttcaaaatggtgatgaaatatattattatgggataaactttcaggtatatagaaatatgtgatgtaacttttgaaaaatgtggagaagctacttcctgcctataggaggtagctttaaaaatgtggagaattcccaaatatttccttttataaatacaatataaaattcattatcctagaatataatctattatatattagtctctttatttatatatatgaagaaaaaatctagataaaaatatcattgaatagttccttcatgattaattggattcagtaagcaaaatctaacaactttataattctagtcaaatatggtccttcctttaggcttctccaaggctttttactacaactaaggtatccagctgcactctacctttactgagtgagtccccatggttaccagcaaagtgtgtgactgaaacaaagaggacggctgttcaaaaatgtatgtctaaaatatctctacctaagacatttttttcttttgtactttgtgtgttctgattctcaaaacaattgagttactcgttgattctttttttctcctccataaggaaaagaaaaatgatttttctgaccactgaattgttaaagcttcttcttctttcaccatatctataaatcatggtgttaaagttacagaggagaaggtcagttttgttgtatatatggataatattgcttagctaagtgctagactaagataataaaataagagcaacagaagaatatgttgtattctcagttatgtaaggaaatgccttttcttaaagctttttcctcatttcatggatatgaacatcttctctagggcatgatcggggaagagaagaaaagtaaagtaaaaataaatgtgtgtttgtgagtgtttattgttagcatttgtgatataggttttgtttagagaaagaaacttaaggcatctggcaaattggtggtttgtgaattgtagtgaatttaaatggtcaatatcattcttaaccttgattctatctcccaatgaaataaaaatttattttctcatttatttagtgaatgtgtattagtactttatattccgggtgctatactagttttggagggcctgaaaatgaaagaagtaatttctgctttcatgatacccagcctagcagaggaaagagaagagaatcactaataaatcccatatacacgttttatatgaactataactatgtttcagaagaataatgattgtatactttctgctcactgcctttgaatcataaaattttctttgaagggttactaatagcactagtttcctttttatatatggttgaactaatctctgacaaccgtaattcttcacctttgtgaaggatcttgaagagaggatactttacatggctacattttgcctctttaatgcttagtacctctttcattatagattgaggacagctataattaatattttaaaagaaagtcacaacataatttcatagatgtattttaaacttttgagaacttcttattaagtagtgctcagcattgttcagtaacttgcttatgctgagtagcaataatcatcgccagctttaactgaacaattatcatgtgccagcttctgtgataaccattttatatgtatttttaattttcaaccactctgcaacacagaaattatgattacctctttcagaatagggaaaataaggttcagagaggttaacagagtcagcacatgggaccattctgactccaaagcctgtgcttcttctcctagagagatgccacacacaaatgcctaccaccacaaaaaaaagaaaagaaaagaaaaggaaagaaaaaaggaggaatccatgtcattccaaccatagtctcttgtttttagctgcatgctaaataacaaaatatatccaaagtcttccacctctaatatatttatgtggaaactacataagtacatattttgccaaatttaagtgaactatgtttttttttttagttcaggtatttttttcttaatttccagaagctaaataaatcataaaatatggaagtagacaccttcaaagggcatgccagttatataaatattttaactgagaattcaatgtttcaatcagtttagtctattttaaagttggaagtacctagattatgagtctttttgctttaattttactttctttaaaaatatatgtactttttaagtagtttatattactgtttaattttttctgatggaaagtaacacacactattatttggtgaatagaaaaattttagtagtttttttttcttctctaatgatttttagaaagaaaacacttatatatttttcctcatttatgtggtttatttcaccttataacacaagctgatatgaacaataagaacagaattgaaaagtgcagttctctaaaaagaacatatgaaggaatattgatggctttgcagcttgctatctcaaactaacaaaatacttcagcacggataagagtctcataaatctagcccttttttgttaatttaaaaacaatttagagtagtagggcatcactatttctaactcgtctctgccagttgccctatattcacctccatacctagcatggtagctccggtaagtgtttatcataagcatttgggatattcatgtacactgagtagtacaacttaatgagcttctctgtgaacttctgattttggccttcaggctgtttgtgacctgctctaagactgtggtcttttctccttgggctctgcttcatgggcttttcactgccgtgagattgatttttaccctttgccttcttcaacttttgcgtatttaattgctttcttctcttctgcctatctagaccctatttacctttcacttatcagttaaatctcttttaactattctgttctaatctgaatacggaaacttttcaggagaggtcttctaacaagctcctaaatctacaaccaggagcagagtctgaagagacttcttggttcaaatcccagttctatcagtgggagttacgtgaacttgaccaagttacttaacctctctgcctcagtacgtacttccatctgtaaaactgatcaataacaaaaaacaaaaaaaacaaagaaagtggaaactgaatgtgttcatgtatgtaaaacatttagaaaagtgtagcgtatgttattttagaaaaacggtaaacgggttacaaaattatagctgcctaccactagctgccaatgtttagttgttgctgttttttttcataatctatccagaggtctttactgtaaacagatatatctaagctaatgagtataaaaaaaattcaggttacccattggtattaaaataaaagggaaagtactaatcctctatcagaaggaactgctcaggtgtgttaaagaataattagcaccatctttagtttccagaattgttcacaaacattatttaattttcagccagcttaattttaaagtttttagctcatttaatgacctgaggaatataaaatgagataaaattgaaaaaagaaatagtagcaatatggatcatattacataaaaaaaaaaaaccagtagcatctcatactcaaattaccgcgttctttcaaagcttacatgactaaaaaatagtaaattatgaaaaagggaagcagaaaaaaacagtatcaatatagaatatcctattctctgcaaaagctcaaagacgtctctggagtgtcaaaggcatgtccttcaatatttaactttttcactctttgttccccatctcaagttgaacaatacgttaattacccgatgaagcattataattactctaacagctccactcttacttataattactgcatcaacactttctttttcatatgcttcaatctatacctattacattgtcatgatgaagacacattaacattataataccgtataattagctgatgagcaattaaattattccactgctcttgttcctctttgccaagaggttgcttccacgctctattatctccttttttccttcggtttgctttagtggttctccccctaccccacccaaaacaaagaagctcataagctgtattcaaagcattttgatttcaaattcagtatgggtaagtgctcaaattggtgatagttgaagaaataaatcggcattataggcaagttttactttattttcattttggttctacaataaagaattgcaaatccatgtaacacaataagaccttgcaggcgctttcctttctacatgctgatcttttttgttttaaagattaaaattttccataatttacagcaaaattgtttagactatattagattctacctgaaatatagccatcatgaattattttacaaatacttcaaattaggttttcacggaagctttgaagttttggaaattgggaacataaaataaaatcatgcacgattgtgtagctaaatatgacagtatactgctcaatgaaagcaaccaggtgctttccgttattattttttctttttgtttttctttatgctacatatcaaaaacctatccttcaatctgacttgtccagttgacatttaatctacataacatttcctttaagtgcctataatctttctttgtggttttagtatgcttttttgaagctccctgtaaggaaactggatctcgctccttggttaaagacttactttagttcaaataaacttcggaactaattggaatacaattttaatgcctccaaaatacttgtcatccacatggtttaccattgtgatcatttgctgcatttatattgcaaactagttcagttgttgtttagtctatattttataagagaactaaatctttcttagataattactttggagaaacattatgagctatggaagaaaagtggaattcattttacaagcaaggcctatgccaataaaatgacttttgttgtctcagcttagtttctttagctgtgcggcaaaggaaaatctattgagtactacagtctcatatgcagaaacttgcttcttcactgagaagagccagatgggccctgccaacatcacaaagccatttaggactgttagtacctttatgctttgaaagcaatgataaacaagttacctttgacacgatatagaaaagcaactaagtctttacttaagtgacaattagttcagctataatcctgtgactttcaaagtccttaactgtgatttgatattttttagttgacaaagactcaactctcatgcttttacataggtacgctgtttattttgcctcaggtcaaaactaatctcccaaattctgataaactttgttagaacctgcatttgtttctaattgtgctagaaaaatgaagtttatctaaccattaataaatgagaatctctctgtagagcaaagaggaggcaatacattatatcagatgtaacttggtctactgacagatattaaagtgcaaaaggtatcaaaatgcaatcaagattaacagggatttcagataaaatgttagctgtaataatgtgacactctcacttcaaattcaaattattaatacattgtaaataaggatcttatattgattttcattatatgcagttaagatgcctactattttcagctctcataaataggtttgctagtatacatgttaaaagccagagaataagtgaataagaattagagagtaagaacctgaccattgaatcaggccctgctccaacacttactacatttgtgaccttgaacaagttatttaatcttcctaagtctatttgcagccataaaattatagcagtacctatcttgtcaggttaccagaaggataaaatgaaaaatttaatgtaaagcacttagcacagtgcctagcataatgtgatcactcaataaatattacatattatcattattccctattattagcttaaaggttatttttctttatgttctttggaaaacacgtcatacaaagttcataatcatcgagtgctatagtttctcataaaatatttgatctggaaaaggtcttaatttttgttgttgttttattctgagtgctttatgtgcattgtctagggtcataaatttaattagtgtccaacttagtactacacggtagtgtctcccaatagtatatttttccatgataccattttacttaggagatctgtgaaatttgctcaattggattatagtcgtttaaaatatagacataaaatttcaagcatatataaaagttacactcgaaaaataaattttaatttcagaatcacctgtagctgatttggactcttgccattattcaagatataagtacaagtttattttattctatataaaaaaaccaaaatcctctttcaatgccgatatttctgccgccttttggttgaagtactgagtttttttctagtctacctaaccctcccccttttgaaacagatttcgtatcagagttactgtatttccttcacaatgaattattataactaatggtttctatttttttctcccacattcaggattactcctcttatattacaataaattttaacatctactagcttttataacactttcttttacattctgaagactgtataaattctcaactcctaatcataaaacttttgatgttagtacaaagcttcaaaaggatgcaatgcttattgttggctaatatgttatctggaggatcttactcccatacctccttaaactgatacccttatagttcagggaatcttttatgtcccaaagtcctaatcatagaaaaaggaaccataaatgaccctgattgaagctgaaaaaatattttctttctttctttttttttctttcttctcagttccaattgttatgtgttgtttttgatgggatagatacgatttcagtatcatcagggtctggcagcaataggctcaaagatctaatgagcctctgacacttcattacccgtcatatattaacagttaacataatagccatcaaaagcttaaaaaagctttattctcacaattgtttattgaccaaaaaataattatgttatatgaatcttgcataaaaatattggtaattgtcttctcaacttgacctttgggacttggattcccttggtatggcaattaaatatactacgtgagaataaaactaggctgggtgcagtggctcatgcttgtaatcccagcgctttgggaggccaaggcaggcagatcacatgaagccaggggtttgagaccagcctggccaacatggcgaaatctgtctctactaaaaatacaaaaattagccagacatgtggtgcacatctgtagtcccagctacctgggaggctgaggcatgagaatcacttgaacctgggagacagaggttgcagtgagccaagattgtgccactgcactccagcctgggcaatagaggagagaggagattctgtctcaacaaattaaagaaaggaaaaagaaaagtaacattttgtttttggtaatatatagtagtataaccctcaattgctttccaaatcccattcccccataaaagcatcgtcagaagatccaagctaccattgaagttttagcctcagggaggactaagtaagagtggatcatacctggaaatgagactgaacagtaccaacatgaaacgtcaataagacttaaggctgatagatgaacctgaaaaggcttctttctcctgtccttacagatgaacaaaccgctactgtgtccaagaatagcttttacaatcaaagtagtctgctgaaataaccaagagtgacaatcagctcttaacttcaaaagggaacttcacatttcccgatgcttcatttacaaatgaccagtaatatatatatccttggcagagatgaacatttgtagctatatctctaagcacaaggacagagatgtcaaaccctcctactttgtatcaccaatatattctatggaataaaccgtcttagactcactggtattcagggattctctcattcaagctatcacaattctcatgatccaccatttgcctctgaagatgacaatttggataaatgagtaaagatgggaaacccaatccatgttaatttttttcagacatgtgaagtggagaagagaacctgaaaataatgctgttgaacagaaatatgcgaaatctaaaaatggagagacctaattttttatgagacataataaaaaagcaaaaggaaatagaatcacagcagtttggtgctacgagacacctaagagaataaactaatcccttcactttacagatgagggacctaggccccagagaggtgaagcccattaaccatgtttgcacatagtaaacagtagcacagctagagaagttcagttttctgaccctacccactatgcaacaataaatctggtaagggagtattttgctgtttataagttaaatgtgtgcagttttgaaaagaacattaaagaaaagtataggatggtctagatctgatatcactcccatatgagtttccatttatatatttactattacttagcagtattgatgtatttatcatttaccttcgtattcatcaattaataggacattctattgtacagaaggatgtctattacagtccagtgattcttatatttttccaccaaattgtctatttgccattgcaatggagtgggaaatcttaaagccaggagatttgggggccgtggcacaaatctatcagatgtaatggaaaaatttcttcacctagtgatatttcatcctaagagtaatgcaacgtttgctgtttgctggttgtcatggtaagctgtttttttctcccaaaagttcaaggtaaattaatggcccaaaagtatacaagatttgctttgcttaaccttgtggaattcctgcatatcttcaagagttcatctaccttggatatactgattatatgccattttcttttcccaatttggaagcttactatagaaaataagcacaaagagctgagtgcaaaaataattcatacaaaggatatatttttgggttctctatttcatgtaatagccattattctcccaaaaagaacataattttaagagaaaagttacactgaattttaactgcatattatatattgttgtcctaaaatgaagtaaaaaaaaacttttaagttttctacctctaacactctttatcctaaacaaaatccacccacactttacaaattatccagcaatgttaactcaaatatacatgaatttgaataatctatgagtatcaactgattaatcaaaacaaaacttctaaattattctctttagtctcaatagcttatctaaatggatgtggacaggatgaaactacaaatatgtttcacgaaaataacactattttgcaagaatgaaaagaatcttaactttcttctaattctccatttgaccattcttgaagattctccttcatattaattttatttatttatttatttatttattttagatggagtcttgttctgtcccccaggctagagagcagtggcttgatcttggctcactgcaacttctgcctcttgggttcaagcaattctcctgtcttagcttcgcaagtagttgggactacaggtacccaccaccacacttggctaatttttttttttttttttgtattttagtagagatggggtttcaccatgttgcccaggctggtctcgaactcctgagctcaagcaatccacccacctcagcctcccaaagtgctaggattagaggcatgagccaccgtgcccagcccttcatattaatttttaaaacaaatatttatagaatgcttgatatttgatgattcttatagacaacactcttgttttcatggagtttagagataataatcagacagtaagcaaacgtaaataaataaaaagcacattgtgataggttctatacaaggaattaaagcaaagtgatataatgagattgatgtgtatggagagggttacattttattgggtgttcatgagagacttcgttggggtatgatatttaagcccagctataagctgacaagaaaaactgcatgtgaagtcagggaagaaaaagttcagaagataaaatagctatgacaaaggcctttgggcagaaatggaaagagtgcctcagctggaacagcatggctaaggaaggtgagatggtgtcagaaagatgggcagaaccaaattctatagaattttgttattttacaaaaaggtatggaatatgacttttactttaagtgcaatgggaatcctggagtatttaagtggtggagtgatgacactgtgtaattggttttcacagtcttaatcatactagcagtagtgtaaagtaagaattgcaggggacacagctggaaatggaggaagctatagcagtgatttagagcagggtgctggtagtagacatggagacaagtaaatatatttgggttatgctttggaaggtaaaaattaataaaatggactgatagtttgtttagcagtggaaaagagaaaaaggaaaatcgaaggtaatccctagatatttggctcaagcaacaactggagtgggcagcagtgccacagtttgaaatggaagagactggggaaaaatgaattggtgctggggaaagaggagttgagaattctgttttgactttgtaaagtttgagatccatattctacatcaaagtgaaggtgtcacgtagttagttgtatatttaaatttggagtttcagggtggtgacagagctccctgagaagtatatttgggaatcatgagcacatacgtagtatttaaaaccctgggactggatgagatcatttaagacaagtgtgtttaaagaaaaaatattccccttaagcattcgaacatggaataaataaggagaggaagtcctacaacctcaaggagttgaattctgtcatcaaccagttgggttggaagagaacccagagctgatacgagagtgcaatctgggcacacaccttgatttcagcctggtaaggctctaagcaaaggacccagctaaagtttatccagactcatgaccaaatgaaaaccttgcagtttaaacagatgcgtgttttacattgctaaggtggtgatttgttatatagcaatagaaaattaatgcatccagtttcaagtttcgtttataaatctttccttgtttacattctttcttaaaggctaacaactgtaattataatatctctgttaaattaaaataatctttgggaacatcaaacatgtaataggtaatatctttaggggtcactgatgtgtgttcaactttccagttgtgctacaataattggacctatatgaaaggacttttcattttttttaaattaattttcatagttttgttttccctattatttattattattgttgctattggtgtgcacgcctgattcttgtagccaattatatatcggtatgctctaatctgttatgagtcgggagactagaggaccaggctttttgtattgggtctacaatgagaatacctaggctataaactacgttatgacagtgtatgatgaaattaagctatcctttttgttttctcagtacttctcagtatttaaagtcatcagaaaaaaatgacatttgtttaaataaaaagacacaattgtaagaataccagttggttgttgatattttaggttatttctttaaaaattatgattgcctgttctctacattaaaagaacattgctgggcagaataactggattcaaggtaatgtctttgtcttcacatagtctttactctcaagtgactccagtgagtcagcaaaacatgtgtgggcttcagaaagaacgattccaccataatttgcaaattagaacagtgggatatgctatgtactactttccaagtctgcacttcacatatcattttaatgacccatcaatagaaaatacgtgtcatgatttatctttccagtcatggcaatttaggtaaaaggttggaaaaatacctatacgaatagtggtattagaaaggaacagggacaaagataagctagggttaccttttgaaaaaaaatggggagaatcttgacaaaagattactgggaagcatcaaatttcaagtatttaaatctttaaaatgcatcctcatagtttcatattgtctttttttttcctttctatgtactctctggaccaaacagggtatgtctgtctgaataactccatgacttactcaggtaatcgtatcagaaaactttctggcaaagtttagatttaggggatctatggagatttctgtatccataaccactttctgcaatgcacacatcttaatgcacatatctaatgcagtcagtcacattatcattttagctttctttgtgaatgagaaaaatttcatttcccctcctgtttgcagatacataaagtgataaatgtgatggaatgctttgttagcaccctgccacatggaatagtcctcctggtttgactctattttctcctcttcctcttatttaaaacttaagtgatcttctttggtatagtactgggtagaatatcaatttaaaaataaaataaatataatattttaaatgacgttaatgctgttctgctgatattacttccaaaataaaaaagtagtcgggactaatcctgccaagtttcactgtaaaattaagtattactgtcttaattatctgtgctagtatggaaaataaatggactgcacacatgattatggtgattaaggatgttgtatcattctcattcacttttagcctatttttttcttttactttttgataactaagaaccgaatacttgtttttttgttgctttaaatctgagattcttaaataatgcaggcaaaaataatcactactaccaataccaatccacctccagaaaatgggtatttctgccgtatgaacaactagagaaggtacacctgcaagcttccatcataaacaaccagggaatgtaaaagagcagcctttttgtagcaaagccatactgtaactgaaatagcaatcgccttccagagaacaaaggcactgccatgaaaagtccaagtatttgctctttggcaacattcccccaattctgcagacatgtttagaaagaatgcctacacctcctattcagaaattaaaaggcagctcttctaagctttgaaaggtaatatttgggttgtatcagagtctggcattttatttctttgttctgcttgggatttcatattgacatacaaatcatttagtttctttaagtattttaaagtaatgtctttaaaatactctttaagtaattcttttaagtgctttaagtattaaatgtataagatagctttagatgtggggattaaaagtgacatgagaggaaattgttatcatttgagaggttttatttaaacatcatgaactcacatagtattcactaagacttttatttttaaggttctcaaacctatgcatttaaagaataatttttagcaattttcataatataataaaaattgatgttatgtttccttacacatgagattacttcttacaggaactcaaacgagaaagcaaatgacaacaaaaatactttctttcagtaatcatggaagcacagggttttggtaagttatcacacataatttaaagaaaatctgagtgcaaaacaaccttattttaaactataatgtggtcactttctcctcagttcttgactatggcttcccccatagattttgattttctttcactcatcatgtcctatttatttgcaaggttaaattttataatagtctaaattttattaacatttaaaaatatgattacctctcaggattatcattattacaatatcattcttaaattacaccacacagattagaaaaagaataatctggcacacagagtcagattgaggttcagattttgaccttaacacttatataatttgtggcctcagtttttgtgatggttaatattgagtgtcaacttgactggattgaaggatgcagaatagtgctcctaggtgtgtctgcaaagatgttgccaaaggagattaacatttgagtcagtggaatgggagaagcagacccacctgcaatctgggtaggcaccatctaatcagctgccaatgcagctagaataaagcaggcagaagaaggtagaaagggcagacttgctgagtcttccagctttcatccttctcccatgctggttgtttcctgccctcaaacatcagactcctagctcttcagcttctggacccttggacatataccagtggtttgccaggggggtcttgggccttcagccacagactgaaagctgcactgttggcttccctacttttgagattttggggctcagactggcttccttgctcctcagcttgcagatagcctattgtgggacttcaccttgtgatcctgtgagtcaatactccttaataaacttcccttcatatacacatctatcctactagttctgtccccctagagaaccatgactaatacagtctgcttatatgtaaaatagaagtaatgactaaccaaattttactgaatgtctaaaagttacttaaaatgtgaaaccagcccagttgtccaatagaaatgatgtttatagattttagaataaacacagaaatggacccttttggtcttgaaactcgaaacttgtatttgtctcatctgacttccttcctcaggaagctgactcacaggcaagggactaaaaccacatccagagagtgagatgtcagactcctcattcattattactactcccgtacccctccctaatttctttcaacactgtagtgacatttcttctcctgctatataaataccccaattttagttgctcagagaggtgaatgtgagattattcttctgttctcccatttgacatcacccgaataaaaaagctttctttcctgacaatacttgttgtctcagtgattggcttcctgtgccagtagcaacgggacctggaccaaatgtggggtttccataacaactatagcttttctccaacagtatacaggccaggtgtggtggctcatgcctaaagcccagcacattgagaggccaaaacaggaggatctcttgagcccaagagttcaaggctgcagtgagccatgattatgtcactgcagtctagcctgggaaagagtgaggccgtgtctcaatcaatcgatcaaaataaaatggtacatatcatttccctcttcaaatctattacttctccaaaatttctcttttagtaaggtacaaaacagtctacatagttttccaaataataaatcagaagtcataattaattcctggaccaaattacccctggactgggccaatctaaacatccagtcacccaggtctgataatgttccacctggacacatcctaaaaatcccctcctcttcccttcctcctctgccacctcatagtatgggccacaactctatttcatgcaaactgctctttaccccctttactgatctggctgcctctagccttgctcctctcatatccattctccactctgctgccatagtaattctaaaaatgcctccatgattgtgtgactttccagtttaacacccttcaaatatttccctttgttcttggaatagaaacagactccttaaagtggttcacagggcagcctatgatctggcccttcctccccttccagcttatgtcttgcattctttgtctctgttagctccgtggactccccaagctatctctccgatctgttcctttacctggaagactctggtatcttctttatctggctaaatcttacgcatattcaggtttctattatcaattcttccacagggtttttatgatgccaacttaggcctacatcaccctgcattctcaagaaacacttattaaattacttgttacttataaaaattacttataaaattgtttattaaaagtcactcttccccattagtatatggggataaatatgatggcagctgagagagaacagaagaggggagaaaatcaggattttgaggccgtggcgtctacagaaaaagctgtgcagtaacctccttcccctcctcctcttgccccacagggaagagtattgcacctgtcctcatctcaaatccagtgagggaggtttccactgtgctatgtggagtatatgtgctatgtagggagtttattatatgacctatgtaataggagagaagtggaaaaatatagcataactcccacctaagaaatttggagagtaagaacaggttaatcatttttgtggtggaaacagcctgccttctctctgtgtctgagtaaagcatgcatgaaggtttttgctggaacagatgtaggccacataggataaaaagaagaggtctgggaccattttaagttctgtttcagaaaacaacctggaaaggagaagaatgcttaagaaccaagattgagtggaaaaagctaccagcaaaaccagggctggaaggactggacaacctggggagtagaaaagagtttctactggaagaaaactagtgatgggaatatttgaaaaactcaggataaaatgtggtttcttctagcaggtcccaggccatcttcaccaaagaaactcttgtgcttccattttctcttcttccctctccagtgccaatcctagagtgccaaaagctataggaagtaagctgcgtggggagagcagaaaagggacaaaagccatcagatgctttttctggaagatgctggctgccaaacagtggcctcaactgtcagagaaggagaggaagtattaccttagaataaggatgaaagtattgattaatattttggagtccaagatggccgaataggaacagcttgagtctacagctcccagcgtgagcaatgcagaagatgggtgatttctgcatttccaaatgaggtatcaggttcatctcactggggcttgtaggacagtgggggcaggacagtgggtgcagcccactgagcgagagccaaagtagggtgaggtatctcctcacccgggaagcataaagggtcagggaattccctttcctagccaagggaagcagtgacggatggcacctggaaaatcgggtcactcccaccctaatactgtgcttttccaatggtcttagcaaatggcacaccaggttatactccgcacctggctcggagggtcccacgcccacagagcctcactcattgctagcacagcagtctgagatcgatctgcaaggcagcagtgagtctggggaaggggtgcccgccattgctgaggcttgagtaggtaaacaaagcggccaggaagctcgaactgggtggagcccatgacagctgaatgaggcctccgtgcttctgtagactccacctctgggggcagggcatagccaaaaggcagacttaaatgtccctgtctgacagctttgaagagagtagtggttctcccaacacagagtctgagatctgagaatggatagacagccccctcaagtgggtacctgacccccgagtagcctaactgggaggcaccctccagtaggggcagactgacacctcacacagccgggtaccccgctgagatgaagcttccaggggaacaatcaggcagcaacgtttgctgttcagcaatatttgctgttctgcagccaccactgctgatacccaggcgaacaggatttggagtggacctccagcaaactccaaaagacctgcagctgagggtcctgactgttagaaggaaaaataacaaacaaaaaggacatccacaccaaaaccccatctgtacatcaccatcatcaaagaacaaaggtagataaaaccacaaagatggggaaaaaacagaggacaaaagccgaaaattctaaaaattagaccacctctccccgtccaaaggagcgcagctcctcaccagcaatggaacaaagctggatggagaatgactttgacaagttgacagaagaaggcttcagaagatcaaacttctctgagctaagggaggaagtctgaacccatcgcaaagaagctaaaaaccttgaaaaaagattagacaaatgggtaactagaataaccaatgtagagaagtccttaaatgacctgatggagctgaaaaacatggcacgagaactacgtgacgaatacacaagcttcagtagccgatttgatcaactggaagaaagggtatcagtgattgaagatcaaattaatgaaatgaagtgagaagagaagtttagagaaaaaagagtaaaaagaaatgaacaaagcctccaagaaatatgggactatgtgaaaacaccaaatctacatctgattggtgtacctgaaagtgacggggagaatggaaccaagttggaaaacactctgcagggtattatccaggagaacttccccaacctagcaaggcaggccaacattcaaattcaggaaatagagagaacaccacaaagagactcctcgagaagagcagctccaagacacataattgtcagattcaccaaagttgaaatgaaggaaaaaatgttaagggcagccagagagaaaggtcgggttacccataaagggaagcccatcagactaacagtggatctcttggcagaaactctacaagacagaagagagtggagaccaatattcaacattcttaaagaaaagaattttcaacccagaatttcatatccagccaaactgagcttcctaagtgaaggagaaataaagacctttatagacaagcaaatgctgagagattttgtcaccactaggcctgccctacaggagctcttgaaggaagcactaaacatggaaaggaacaactggtatcagccactgcaaaaacatgccaaactgtaaagaccataaatgctaggaagaaatggcatcaactaatgagcaaaataaccagccaacatcataatgacaggatcaaattcacacataacaatattaaccttaagtgtaaatgggctaaatgctccaattaaaagacacagactggcaaattggataaagagtcaagactcatcagtgtgctgcattcaggagacccatctcacgtgcagagacacacataggctcaaaataaagggatggaggaagatctaccaagcaaatggaaaacaaaaaaaaggcagcggttgcaatcctagtctctgataaaacagactttaaaccagcaaagatcgaaagagacaaagaagagcattacataatggtaaagggatcaattcaacaagaagagctaactgttctaaatatatatgcacccaatacaggagcacccagattcataaagcaagtccttacagacctagaaacagacttagactcccacacaataataatgggagactttaacaccgcactgtcaacattagacagatcaatgagacagaaagttaacaagggtaaccaggaattgaactcagctctgcaccaagtggacctagtaggcatctacagaactctccaccccaaatcaacagaatatacatacttctcagcaccacatcacactgattccaaaactgaccacatagttggaagtaaagcactcctcagcaaatgtaaaagaacagaaattataacaaactgtctctcagaccacagtgcaatcaaactagaactcaggattaagaaactccctcaaaactgctcaactacatggaaactgaacaacctgctcctgaatgacttctgggtacataatgaaatgaaggcagaaacaaagatgttctttgaaaccagtgagaacaaagacacaacataccagaatctctgggacacattcaaagcagtgtgtagagggaaatttatagcactaaatgcccacaagagaaagcaggaaagatctaaaattgacaccctaacatcacaattaaaagaactggagaagcaagagcaaacacattcaaaagctagcagaaggcaagaaataactaagatcagagcagaactgaaggagatagagacacaaaaaacccttcaaaaaatcaatgaatccaggagctggttgtttttggaaaacatcaacaaaattgatagactactagcaaggctcataaaggagagaagagagaagaatcaaatagacgcagacgcaataaaaaatgataaaggggatatcaccactgatcccacagaaatacaaactaccatcagagaatactataaacaactctacacaaataaactagaaaatctagaagaagtggataaattcctggacacatacaccctcccaagactaaaccaggaagaagttgaatctctgaatagacccataacaggctctgaaattgtggcaacagttaatagcctgccacccaaaaaaagtccaggaccagacagattcacagctgaattctacctgaggtacaaggaggaactcataccattccttataaaactattccaatcaatcgaaaaagagggaatcctccctaactcattttatgaagccagcatcatcctgataccaaagcctgatagagaaacaacaaaaaaagagaattttagaccaatatccctgatgaacatcaatgcaaaaatcctcaataaaatactggcaaactgaatccagcagcacatcaaaaagcttatccaccatgatcaagtgggcttcatccctggaatgcaaggctggttcaacatacgcaaatcaatcaacgtaatacagcatataaaaagaactaaagacaaaaatcgcatgattatctcaatagatgcagaaaaggcctttgacaaaattcaacagcccttcatgctaaaaactctcaataaattaggtattgatgggacgtatctcaaaataataagagctttttatgacaaacccacagccaatatcatactgaatggccaaaaactggaagcattccctttgaaaactggcacaagacagggatgccctctctcatcactcttattcaacgtagtgttggaagttctggccagggcaatcaggaaggagaaagaaataaagggtattcaattaggcatagaggaagtcaaattgtccctgtttgcagatgacatgattgtatatttagaaaaccccattgtctcagcccaaaatctccttaagctgataagcaacttcagcaaagtctcaggatacaaaatcaatgggcaaaaatcacaggcattcctatacaccaataacagacaatcagagagccaaatcatgagtgaactcccattcacaattgcttcaaagagaataaaacacctaggaatccaacttacaagggatgtgaaggacctcttcaaggagaacaacaaaccactgctcaatgaaataaaagaggatacaaacaaatggaagaacattccattctcatggataggaagaatcaatattatgaaaatggccatattgcccaaggtaatttaatagatccaatgccatccccatcaagctaccaatgactttcttcacacaattggaaaaaactgctttaaagttcatatggaaccaaaaaagagcccacattgccaagacaattctaagccaaaagaacaaagctggaggcatcatgctacctgatgtcaaactatactacaaggctatagtaaccaaaacagcatggtactggtaccaaaacagagatatagaccaatggaacagaacagagccctcagaaataataccacacatctacaaccatctgatctttgacaaacctgacaaaaacaagaaatggagaaagattccctatttaataaatggtcctgggaaaactggctagccaagtgtagaaagctgaaactggatccctcccttacaccttatacaaaaattaattcgagatggattaaagacttaaacattagatctaaaaccataaaaaccctagaagaaaacctagacaataccactcaggacacaggcatgggcaagcacttcatgtctaaaacaccaaaagcaatggcaacaaaagccaaaattgacaaatgggatctaattaaactaaagagcttctgcacagcaaaagaaaataccatcagagtgaacaggcaaactacagaatgggagaaaatttttgcaatctactcatctgacaaagggctaatatccagaatctacaaagaacttaaacaaatttacaaattacaattgttgttacaaaaaaacgaacaattccatcaaaaagtgggcaaaggatatgaacagacacttctcaaaataagacatttatgcagccaacagacacatgaaaaaaatgctcatcatgactggccatcagagaaatgcaaatcaaaaccacaatgagataccatctcacaccagttagaatggcgatcattaaaaagtcaagaaacaacaggtgctggagaggatgtggagaaataggaacacttttacactgttggtgggactgtaaactagttcaaccattgtggaagacagtgtggcaattcctcaaggatctagaactagaaataccatttgacccagccatcccattactggttatatacccaaaggattataaatcatgctgctataaagacacatgcacacgtatgtttattgcggcactattcacaatagcaaagacttggaacccaccccaacgtccatcaatgatagactggattaagagtatgtggcacatatacaccatgcaatactatgcagccataaaaaagaatgagttcgtgtcctttgtagggacatggatgaatctggaaaccatcattctcagcaaattatctcaaggataaaaaaccaaacaccacatggtctcactcatagatgggaattgaacaatgagaacatttggacacaggaaggggaacatcacacaccggggcctgtcatggggtggggagatgggggagggataccattaggagatatacctaatgtaaatgaggagttaaagagtgcagcacaccaacatggcgcctgtatacatatgtaacaaacctgtacattgtgcacacgtaccctaaaacttaaagtatgataataaataaataaataaataaataaataaataaaataaaaaagtaaataaaaaatattttggaatagatactcttaattgaggtcacttaaaagtaattgtagaattgcttagtctgtaggagtgaaaagagaagtcacaggtatggtgtcgaagttcccattgaggaccagaagacaataacctctaccaagtaaatattaaagaggatatggaggcccagtgcagtggttcatgcctgtaatgccagcattttgggaggctgaggtgggcggatcacttgaggccaggagtttgagaccttgccaacattgttaagctccatctctactaaaaatacaaaacttagcagggtgtggtggttcgtgactgtaatcccagctactctggagcctgagatgggagaattgcttgaacccaggagggggaggttgcagtgagccgcgatggttccactgcactccagcctgggtgacagagtgagactctgtctccaaaaaaaaaaaaaaaaaaaaaaaaaaaaaagcttccaggagacaacaatttgtgtttccattaagccatattctatagtttctggcattcattacacttcaatacccatttaaatatccatgataacagtcattaaaatttgtcattgtgaaaacaatattgtaaagagtggtgatggatatgggtgggaactgttatgtggattatgtgcacctgcaaaatgggtcccaaacaccacatcagattgcagattgtttctttctttcttttccttttttcttttcttttttttttttttttagacagagtctcactcttgctgctcaggctggagtgtaatggtgtgatctcagctcaccacaaactccacctcctgggttctagcaattctcctgcctcagcctcctgagtagctgggattacaggcatgcaccaccacacatggctaattttgtatttttggtacagacagggtttctccatgttggtcagactggtcttgaactcctgacctcaggtgatccacctgcctcggcctcccaaagtgctgggattacaggcatgagccactgcacctggcctagattgtttcttttatactgttaaaaaaatctatatctgtcaaagttatgaaatagtattatttgtattagatatgctcattgtgagtagccatcagaatctattctgtttttcaatattacaaattttcatcttttctttatgcaaatagcatatgagacataatctgcttttcacaaaagtctacatgtatattaattgaataagatgtagaaatgactgcttttctacagatctccattcacgtgtcaacaaacttgaagtgagactaaatatactaacttaaatggaatcttaactgtgctgactgcagtctcactccagctttcgtcttcctcctactactcttctcacttgtcaattctttttttttttttttttttttttttttttttttttttgagatggagtctcactctgttgccaggctggtgcaatctcggctcactgcaatctccagctccctggtttaagcgattctcctgcttcagcctcccgagtagctgagattaaaggcatgcaccaccatgctcaactaattttgtatttttagtacagagggggtttcaccatgttggccaggatggtatcaatctcctgatctcatgatctgcccgccttggcttcccacaatgttgggattacaggagtgagccaccgctcccagccctcaattctttaaaacagaaaattcagcatctcagatggaatcaattgagctgttagtttaattttgagaatctcagatcaagctgatgaaaaggacataatgaacacattttaagaagacactggctatgaaaccagactggcctgtgtataatgtcatctccaccatttactacatctctgagcaagttaaatatcttaagtgttagtgtccttatgtgttaaaagaaaaaacaaaaaaggattgtagtacctagctcactgagttattgtgaaaattgaataaaataaactatacaaattatttatcatgctgtctaatacaatggaagtgctcacatgcatacacaggagacttatcaaatagtaaaattaaattaataatattctcttggcctgccatttttaaaaaatttagttttgttaactttttgcatccaaaccaggaagttaggtatcaaatctaataatttttaccattttactttacaaagagtaataaaatgatctaacaataatgtgttccaccagaatagaaacagatgatttagaacaagaaaaaaatatttttaagaaatttatattagcataagaataaacaggtccttgaatttcaaaaatgtgtatatcatataaactcacctgtatgatatttaacagattataaatgttatcttaaatagtttgaaggacatacagatatttaataaataatctgatgatgactggctagtcatttaaagaaaagtcatgattcctacttcactaaaggcaaataaatttcagatgttaaaatgtagtgcctaaaaagcaaaaccatttaaatactagaaaaatataaatgtatatttttacagtcctaagattttatcaccactgaaagcatgatagcaaacccagcaaccatagggaaaaaaaatgacagaattgagaacataataatttaaaatttagggatggcaaaaacaaacgtaaaaattaaaacaaaacctaataaaatcaacgaaataaacaaaaagccataaataggttaaatataggaactatcatagcaaaatcgtatgcgtttctctcatacaatcataggggttaaaggatttaattcagagagaggtggtatcagttgtggcttgattactatttgccagatgatcccttgaatggcccttgaatgccctccctcaggagtaggagctattaaagaccactaaagctggaggtgactttaaagatcattctggtcccctctttgcattttacagacatggtaactaagacttgttgaagttaaatcactgtagccataatagagatatgtataagacacaataggagcagaaaaatctttccctgcctggagaacaagaaggtcaaaagaatctttcctgggaaagaagcattgtagctgaatgtagaagtaattccccagaaggaaaggagattccagattagaaagaaaagaaaaataacaaaaaccaaaactattatttacaaaggcctgaagcatacctgagacaggtatgtctagcatattataaatgattaggcataaccagagtttatagggtattagtggtgttacacgaagtttaaaatatgggcagtgtactaaatacatggatgccatgctaaataattttgactctgtcctacagatgatgaggaacctagaaatcttttacaataggcaacacatcaggcttgtgttttagaaaggaactgtggctgcttgaaggatggaaaagagtgaagaatttagagattaaaaacagcccacccctttcaagatcctgctgcaatactccactcggccttctgggttctctcttggcagagtcttccttctctttttcttctttgcacttttggtaggattatattttttcatacattcattatacctacatatatgagtttctaagacaaaaagaggtacagtcaaataaatgggtgggcaagcagtgtttactttcgcaaactagagaacaaaagaacactgtaggtaaactgtcatttgaaataggcattgacacataggaaggatttgagtacaaagcgatttggtagagaaagaaaaaggagaaaggaggatagcataaagaaaggtattgagaccagaacaagtaactataatttcttaatatcaaacatcgtgtcagtattaaaatttctgattttgtaattgttgttaacagtttagagaaacaaacattgtgattgactgaagtttctaattaactcttgtttaaactataggttccaccaccataacaacatctttatggtgtgtgtgtgtgtgtgtgtgtgtgtgtgtgtgtgtgtgttgtgtgtgtgtgtgtgttttctgactttcattgacatgatagaagatagttcactcaatcatctaaatggttttactaatcacccctactagacaaagcacaagaaagtagtttctcaacaggcctttagatacaagcatttatttgttgaatatattcaaagagacgtgtttagacaaccccttcctggaagttagtttgccgctaattactctctagtatgaatagaaaattatgtaaatttggtgaaagaatgttctcctttgtgaaataaagcactttcatttttgtgtataaatctttgaccatattaaggtgaaccatgcaaaattgcctacaaaaagagcaaattcagtggctcaactcaatagaaatgaagatgagtttatttcccggtgatttagtgtaaacaatagtatttataatagctaacatattggatatgacaaatacccatgtattattaatcaaacatatttataaatgtctaagttaatatccagattactttacttttcaaaagcagatcactgtcttagtttgtacataattctcccattcaatttcaaatttgttcttagaaggcaactggaaatatttggcaagatattagaaacggagaggaagtggaaactgtgtgaaaatgtctataatgacttaaacagattacatgtcattaagatccctctgggatatcaaggtcaaagtgagtgaaggtattcactgctcatcagtgaaagtcagggaacggagtacagtcactttctaaacactatttcccaaccccatagagctaggattaatttacagaatttaatgcttagttgaaatagaaatgtgcttgttctcagtgaagcgatggtgaaggtgcctgtaacaattgtagttctgaaccggaattatttaataagtagtctggttgaaagcagttggtctcccaggaatattaggtaattttctctcaatttgagttaaatatcatgccagaaaaagaatcttattgactagtcacaaagtgactgctggacagttttctctctaccttaatgaaagccacagagaaatactagggttgaaagtggccactattactcattcgattaggcctcgaaagactcttactctgggatgtggagcaacaggagtaaatttaaagtcctctggctggctctaacttgtgtcctaaactcctcaaaaataatataaagattaagagggttttcaaaaagtataatgacttgatgactttccatagccacttaacaaaccataacctcaaaagtcttacctaggaaaaaataaaatggttttgttttaatagtctcaaatatcaaaattaagtctttctgacctcagtcaaacttttggacattttgtaaggaccccgggaagtacaaaagagaaatattgggctaattaggcttatccgatatgatgaattctaaaagaaacattgtcaaagtaagaaatgatgtttgaaacttcttggagttatatttatatgaatatgttattaatatgtgtttcagaattatataaagttcctagaaatctgatatgttttagtgtaaatgctatccatcataattgtggttattttaaattgttttatgctacagaaataaccaaatttccttgtcaattgtgtaactctcttatcagatccttagccatggccattggaattcttgatgtccacaggtaattgctttaatctaacgcgtttctaaaagcttcttgccagcaattacaatcctaaagtattatgactttaaggagattcatggaaagcatgaaaagaactctgacaagtacaggtttccaatagctatgagttcattccattggaatgaattttcaaaagtctaataaagaaactgatgggtttgtgaaactgctaaccaatatcaaacaaagcaagaattaattacattagactgaatgaactgataagaaagaattatggtttttataatagcttttatatttgaaacattactggttctttcattgttttgttttgaggtttaaggaaacatttttcattaaagctatctatagtttacagcaatttggtatagcacacctttataaacaaaaatggaaacatttaattttcttctttacctgatcccttcagaaactattcacaaatatttttattttcatgacattatggttatatgcataagttcagtaagaaattttcaacaaagcaaatttaaacagagcctatacgtgtatttgtgctgcacttatgtaaataatcaggcgaactggtcttcccatgattatctttggtagaaatgagagtgatgatagagaaaaaaatatgtttcaaaagaaatctaaagtaaacctgtcattagattgtagacttattcactgtttttgagtttttattatctacctatagattaagttagatcctgaattcttctaattttgtccaatatctggttacaactctataacaaaaacaaaaattactgttcctgaagtcctacaggccaaaactggacagcattatgtaaacttcaaggtacaaatctcatacctgattcattggtcacacagagagtttaccaaaaatgtcagatgtcacaaccagagacgttcaatctacaaatccaggacaagaagttgctgacttcatgctgtggatatcttttctcagcattgtcagaacaagactccctattgtaatgagacatccctcctcttaattttctctttacttatccctacctctttcagttgacagaataacactgtctttaagatttcacaataagtagttcctgcgggtaacttgcaaattgtcatgcccattcctaaaatgctagatgatagaattgctacctactaactgaacagagaggaatctacacaatcaatgacacttgtacaaaaataaatacattgggtactatatagacttagatgcaaaaacgaatgaacagactacttagttaaaatggatagacttcttgcctatctcattttttatttgattttaattggttcagttcatggggagcctggctgaggaataaactccaaactcttagtattattcccatgatagtcacagtagtttctctggtgtgttgtatcctttctaaaagttttcaatgtttgtatgcagccatctgtctaacatcaaatggtctctgtccagccagaaccacaaaaactcaaagacacaggtgataatgagtaggacactgtaacctataaatggcaactgagagtaatactgatgctctaagtgctggtcacaaaaagaagggaattgttaaataaaaatcataggagaccattgttttggactcagtttttgcactagttcccaacacagccgactaaaaacaaatggagtcatccatgctaaagttccaaatccactaaacctaaactaatttgttgtctggccttccaagaaatcaggaaagataacagccaatttcccaaacaggccagtttaaatcttcagttggcataataatgaagtttcctctgcttgaattcttacacaccaaaagctaccctgaagtaacctgatgttaaccaatcaattactttcctatggctctgtctctctgtacctgccttacaagaaaagtagctttaaaagactaatacgctctttgttctttgtctctgctttcttcagaccctctctgtctgcgaagcaaatcatctctgctcattggaatactgattctatttcatggaatgaactgttgtccaattttagaatcacaaataaagccaactgaggtatttaagctaaatttgttgtaattttgtgttttgaccatagggatagcaattggtaaataaggaagggaaagtatctatacactttttatctaagaacgtaaatatgaatgaatgaatttggaactcaggtttgctgatagtctcataaaggggagccccccatacatgctctcttgcctgccaccatgtaagacatcactttgctctttcttcatcttccaccatgattgtgaggcctccccagccaggtgaaactgtgagtccattaactctctttcttttataaattacccagtctgaggtatgtctttattagcagtgtgagaaaaaattaatacacttatgaatacagatgtaaaaattctaacaaaatattagcaagccaaatccaacaatctataaataggatcacacaccatgaccaagtgtgattgatcccaggaacacaaggttggtttaacattcaaaaatcaatgaatgtaattcatcacattaataaaaaatcaatatggtcatctcaattggtacagaaagagcatttaagaaaaatccaacatcattataaaaaaattaaatgaactaggattagagtgaaactaacaacctgaaacggacatctataaaaaacccacagctaacatcatacttaatgatgaaagacttaatgcttccccactcccgatcaggaacaaggcaaatacgtttactccttctgcttctattaaatattgtactggaggttctaattagagccattaagtttatttttaaaaggtgttcggtttaaacattcagattggaatgaagaagaaaagtttctctatctgtagatgaaatgatcttatataaacattttacgaaatacacaaaaaaactattagaattagcacaagttcagcaagattgcagaacataagacaatataacaaataaactgtatttctttatacaagcaatgaaattccaaaaataaaattaagaaaacaattcgatttacactagcatcaaaagaattacttaaggctgggtacggtggctcctgtctattattccagcactttgggaggctgaggtgagaggatcacttgaggctggaaacttgagaccagcctgggcaacatagtaagaaccatgtcttaaaaaaaagaaaaaagaaaaaagccaagcacagtggcatgtgtctgtagtctagctacttgggaagctgaggtgggaggagttgctgagcccatcagttcaaggttgcagtgagctacgactgtaccactgtactctagcctggctgacagagtaagaccttgtctcttaaagaaaaaatgaaaataattttttaaaaagtacaagacttctgcattaaaaacttactatatattattgaaagaaattaaagatctaagtaaatgaaaagatatcttattttcccaaattaaaggcatatgttttttaaagtatcaatacttcttaaattgatctacactctcaatgcaatccttataaaaatctccgatggctttctagcagaaattgacaagctgatgttaaaattcacactgaaattcaagaaatacagaatagtcaaaacagtctttataaagaacaatttggaggattcatactttctggtttcacagcttgtgataattaagacaatgtggtagtgtcataagataatacacatataaatcaattgaatagatttaagagttcaaaaataaacccataattgatatttggtcaattgacttttggccagggaatcaagactgttcaatggagaaaaactagttcttccaacaaatagtatggggataactgtaatgtacacacaaaagaattagtttggatctctgtcttacaccatacacagaaaattaactccaagtggatcaaagacataaatataaaagctcaaactataaaacacagaaaaaaggaaagtagatcttcatgactttgggtgaagctttggtttctttctttaaatacatttagttttaaaattgaatttgaatttcctttttcaaatttaagaatcagattgccatttcacacttctttttttaatgtaagcatatctgaaatgtccccgttttctctaacgggaacacattattttcattcttattatgttttaaaattttgttttcaaaattatatttatttctggctttgattaaatgatagacaaagtaacaacaacaattcagtatcgtaatttgactctggcattaagaaactgcactcttgaacaagtcacttccctcaatgtctctgcactgcattgaagaggggggtgttacaaaataatactcactagatatactttctttgggaatctgtaactttgactatcatgttgaccatctattggcagatataaagcacttgatataaaaatatttttaacaaacatctatctgatctggtccatacctatatttctaagttaaagctgactgttttatgtgcataaacaaattaaagcagacagaagaaatgaaaaaaaaaaaacccactcagaaacacagtttaaatcaatattcattgatttctgggacactatatgcaaagagcaataaacagaggcagattctaaaggaggtggccacagacactaatcaaagacataatacatttacagggtaatgcagcctaaggtttttcaagaatatttgaataatcaggtggtagcaagttcatgaatgtactttttgagtacaaaagacaataatcttctatcaccattgaaatcattaaaagctataaactactgcattaaagcgtgtagttttacataatgttcaatcaaaatatttattcacgagaaagaatactttaacaacagatgtacaaagtatctcatttgtctttttggtttttgtcatgacagcagtttgcagttgttataaagctattacgatgaaacatacaacatttgaagtaattgtctacattggctaaatattctttcccagtaatgtgattcatagctggaaagatacatctacttctctagtctaggcaagtaatttcacttgattggagtctgttaataaagacaatagatgtctactgcagtcttactatgtgccagtcttgacagttgctttttatcaattgttgtgtttaatcctctcaacacatcatgaggtatgtattggtatttgaattgtacagaagaagaaactgaggctcagggaaatgaaatacacttccatagtcgtacaggtagcaaaaagcaaggctatattttaattattcctgctccaaatgttgctttgtccatagtatttttctaggcagtaatttccaaatgtgtgtattcaggtcaagggacagtgaatggttgagtacagaagttacaactctagtctaactctactaaacttgatggataagtcatcctcacctgggattaagaggatggaactatttctagttttataattgattagacaaatcttaggcaaatcttcagctaattcattgaaacagtccaactcatcctactttagatatcatggtagcagggtgagtgacaggtagtagcgtagaatgatgatagttttccgtattcgaatgtctaaattcacaaatccttaaaatttaatctctctgcatccacaacatgatccctctctctgacagctccacctgttacagcataaaatagaactttcaagtataaaaaagacagaggggacagctctgggatgaattccctggagaaagatgtatacttgccaaagcaagaaagagggctgggcagtaagaattcactcacattattagaatattggagaactgttttcgatctactcgtcaaatctcattacaataaactgtagagcttttaatgaactcccactgatactcagttttagtccttattcattcacttagccatttaaatcaatagatatttagtcagtggctactatatgctcagccttggctaggtattggagatacacagatgaggaaaaagtaagcccctgtttcatggagcttgagattattaggagaaatgggatttaatcagataattatgcaaatgagtgagtatctggaagttgagattaatgctaagaaacaaagaaatattgtttcatgaaagcacacatcaaacaacaacaacaacaacaacaactggactgaggcttgagaaaagcttgcttgagaaaacagtgcctgaactgagcttacaattaagtagaaattgattagacaaaagtaggaaaatgggaaattttccaagcaggcagagaaccagtatggaggcctggaggtggaaggaaggaaggaagagagaacactgaaaatgtgggacatcagtattagaaaagctagaaaggaaagctggagccaagctgcagaagaaattgtagatcacgttcaagtctatatgaaagatactcatctttatcttgagaataactggaggtcacttcaggatttaaagatgcatttgtgtcatgggtagaggaggatgataggtttgcatttaaaatttcccaattactatacaaggaagacatagctagaatggaggcagaaagtgaagttatgagactaattaatccattggtgaaagttaattgtatatttaataagggtcttgacagggattctatgaggctgtatatatacaatattcacacaccattgtggccagaacaatatataaaacaaaagcagcccaggtagctagtcaccctgcagggagtgagtcagaggataaacactagttctcattcacctgatagtgtctcccattggctaaatacaactgaaagtcagaaaaccaggagtcttcttgatgcagtgcacacaggaaaatttcttggtgcacagagcagggtgaagaagagtgatgagtggatctgggcgggaggcaggttcagtgagagacaaacaatatatgtaatttatccatcagacttgaacaagtaaatcagaaaagatggaggctatacttacacaatcaaagcatgattatttttttacattcaacaagatttatcaatgtctagaaatatttttaagccagttatgtgaaaatatgtttaacacattactttgacaaggtaagttatagtctagggcagcagaaaaacatgcaactgaaatgatgccctggacactgaaaatgatcgagaaagtattcctcacattctcaacttgtgagcaaaggattacacgcaaatgctgatccagccaagaaagcacacatggacttgtccattggcctatgtacattctactgaaggtgaagcatgagtcaaatagtgtaggcaaaaattctgccaaaacttagcttggctccttggtttgtctattcaagcttttagctgtagccaataagaactctgtaaaaatgcaaaaagatggaagttgcactccctagaaacaataaaaatgatgggtggcaaatgccaattgtatccagacaactaatactataaataatgtgtcaaaataagatgcttaagttattcctttcaggaatcactaaacataaaataaagatgcacgtatgagtaagaactaacttgaggattgcggattataactcatgaaagaataaatcatagcacatcattaagggtaattctcaggttaatcccatatttatttaacgtatttaatagaagatcataatgccccaaaaatcaattgaagaggttttggttattatttaaccaaatactattttaaaaaatataatacttctacaggacattcaacaggttggcaggtattttgatgaatatcatcttagtgaatgttgccagcaacctggggagacaatggttatctccattttataggatgattaatacttacagtatcacagagcattagatttggaagggatatttaaggatccagttggtgctatgattctaaggacatattttcttacaactagacactgaaacagtcgttctgggagggttccaggaatttatattttaaacagctagtaggtcattgtaaaacgctatcaagtttgggaattcttgtcctagcgcaaccatctgcccagtgccttagtctcctttcctctaaccaaacaatattttataccttgtttaaaatttgctggtcgtagaggtcctggcaatttcttgaagcaatccatcacatcttaggacagtattaatttgttcaagttcctagctaaattgtagaactaagaatcaaacccaagtattagtttaaattatagggctcttttcatgataacacatctattctcttctcagccatgatgaaactgagcataaaacaatttaagaaagttttcttaaaattaaagcacttaaaaaatataaaagtgttatactctagaaaattcttccatgggattttttttaaaagaaatactaattaatggctttagttaatccaattctcatacacaagacaagctatatttattgtgtaagaaagttttaattggtataggatattcaggaattttacatgaaataattgtcttgggacattggaatataatatttaatatttaatacatgcaatgtaatggtacaatacagcttggatgaaaaagggaataaaattatacaatcattgaattaattatatgtcaggcattttcattagtcttcagcatttctcggaatggctgggtcacctgaagtaaactgcatattagccttcatctttgtgggtagtatatctcattgtaggtggtttatctcagagccagtgggtcagagaaattatcaaagaaatcttacatagtatgaatttcaaaaagaaaaactttagttctctatttcttaaataattatatggtttataaatttcttgaatgtagagaaacacataacattggttggttttatataatattcatacctgttagctgaattgaagggcagaatagtgatgtggctcccatataacttactaagaaggtattttcaatgtaatctcatttatttttgaattttacagccaacattacatatgaaaagttctcttcacttgaatatgggaagaagcacaaataattctcttatgactagaaactaaagtttccaacattttttatttcttctattgctacatttatgataatacctcatcagcttgaaatccagtagttggaatatgtcttacttttttgtaattttaactagagaattttaattttattctgcctattaagatatttaagtaaaatcagaatttagaatgaataactaaactgctaagaagcagacaccaaaagaatgaaaatattttatagacacctcaattggtttgttatgatgaatctattatgtaatttaatttaaacacttttggagatatttctgagggactgtattaacctaattcaaatcatagttcacatttggaattaacaaaacattattttaaaatattctatatttcggactttaattacttcaactttttagacaatttgttatttatttgacaattatcttccatgtaaagagtaaagtgttagatcatgagagagataaatattgaataagacagatgttttaatctatttgactttaccatatcataaaggatatcaaatcaattcaattcaatccaacagtattcattaagtgcctattttaagcaataactaaacgaggctacacatcagaaaataaataaaataggttttcttcctgacaacttactttgtggtttaatgagagagagagaaaagtaaacaaacaactagaatataatgtggtaagtgatctagttgaaatatataagttttaaaaaggaagtgcaatatagaaagaaaccacattctttgcaagaggtatgctagttcacagttggcagggtaagagaaaggagtgaggtcaagagtcaggctattcttagaaaaagggtcccctatgttaaaaagccaccgacacaaaactgcttgaagaatggcttacgggaaaagagtttgtttataagatataaggttaacaccacattttcaaaatattcgtccatcaaaagacagcttaagagagtaaaaatgcaagccaccgaaagggtacatatatttgtaatttatgtaacctatgaagggctggtagtcaaagtatttacattagttctattgtttaataagggaagaaaagacatccagtagaaaactgtgcaagagatttgaatgaacatgtcaaaaaataggatagctaaacaattattaaatgtataaaaacgtatacaacctaattatacatcagaaaaaagtaaaaccaaaatggaataccacaacacacctactatactatgtaaaactaaaattatatataaaaccaagttagcaaagatatgggacaatgggaagacttgttatggtacatacgtattaataacacaactgtggggggcaaaattatcattatctactaaagtttaacttacgtatattcgatgacccagtgattcagttcatagatacatatcttacaagacttatacaccgtaagatatatacaaaaataattatggcagtgttagtcatgttagacaaaatctgaaaacagttcagatgctcatcaacagtagaaatgataaataaattatgatatatttgtttgtgtttgtgtgtgtgtaatggaatagtataaggaactaaaaatcagtgaacccaggtaacatgaaacaacatgaatgacagtgactaatagttttgagcaaaagaaggaagacacaaaagaatacatattattagatccaatttatatagatgtaaaccacaggtaaagttaaactacagtgttagaaggcagggtagttgtcacctttgggaggaaggaggacagggatgggcaaaggcaagcaggggacttaagagaagctggtgttaaattccttaagttaattatatactttgtgataattgatgaatttaacatttatgcttattgcacatttctgtgtttcttatatttcagttatttttaaaaatgaaaagcaatactttagacctgccttctccatgaaaattctcatctttccacaatttccatacttgtttctgaaaattttaaagtgctgggtatcttttctgtcttagaacaaagcctattattctggtggcattcagcaattaccaaataataaaattatattggcaataattcaatcaccacattcttgactaaggctaatataagaaatgatccatcaagaaggaaagaaagtaattccaaaggaagttagagattctcttggtaattagacaaaatcatattacaggcaaatagtattatcaattatttaatgttacttatttgcaaatttattgcaattatactataattttcatcacagatatagacttaggtcacctcattttgatgaactaaatttaatttttatttgtcccagcaacttcactttaaccttgcttttagttttaatgttttagtttcatttttgtttaagaaactttttttggggtttcacttttagtttcttttagtttcagagactttacgtaaactatacctctagtcccgatcagattttgttgttgtgcactatctttcaaaatacggacagctataaagaagttaaatgaaacagcgtagataatatcctattattgaacaaaaataagcttaaatgcatattttacactagattaattataacagtggtaataaaatataaatgtattgaaataaaaattatctttgcaaggaaggaaggtcagcaagcatgtgaatacacacaaacacatatacatatatgtaattaattttgtggtgttgtatttttctaatatttaaatggtactatgggctcattgtacatatttcaatcaaaatttggaatgtaaagttcactaagatctctatttccaaagacatccaccatttgcagttaagagactattattctaattgtagtttttgtttacaaacacaactattaatattaatataattaaaacaatcactaatatgaaaagtaattaatactattaattactaatagtttataacactaattattactagttaccattttatactgatatttttagtataatattaatgctaatattattagtcttaattttatataaatggagtcataatatacatactttttaataacttattttttcacttaatgtacagttacctatccacgttagtatttatagatttacttcattccttttttctatttcatttttatattatccataaagcataattcacttacctattattgataatccattgtattctcttttttgatgttagatataataataaaataaaaatttttatatatatgtatcagatatacacataattttctggagctggaaatattaggtcaaagaatgtaaagatcccatttttaagagcaattgccaaatttcaccccccaataattatatctattttattccccttatgcttgccagcaataactgttattattttcattcttaatcgctctattttttaaagaaatcctattgcttcattaatacaattagcaaacccaatgaattcacgatagctaaaacaaaagaacaaatatatatcctaccaaaactgttggttgagttcctaagaaagtaactggaggtattcatgctttcaacaattgaggtctgtgttgtatagaatttgctgaatgactaactccttattttatttcttgatataactactcccataaccttttaataaccatttcaataacttaatataagggttattgaaataaccatttcaataacttaatataaggagatcatgaacaaatttagatggtactattaatcacaaaccaaataaatatcatcatagatgcttccagttaggcatagatgcttccttttaccttttgtaaaaaggtgcctgccaagtatctttttaaaaagtatgtaaatgacagcaacaggcatacacacatgaacataacactttgctaccctttcataatggtgttcagatttcctgtttcttctttctttgatagtgcaaaatctattttattcagatagatagatagatataaatggatgaagctaattacaacccaatatatattaatcttaggattatatagtagacttttcattaactgttgttctaaatcttacagatttagaaagctataatcactttctattcagttcattaatcataaaaggaaggagctcctcacataaaaaaaaattaacagaaatcagctgggtgtgatggctcacacctgtaatcccagcactttggtggatcacaaggtcaagagatcgagaccaacctggccaacatggtgaaaccccgtctctactaaaaatacaaaaattagcagggtgtggtggtgcgtgcctgtaatctcagctactcaggaagctgaggcaggaaaatccgtttgaacccgggaagcggaggttgcagtgagccgggattgtgccactgcactccagcctgacaacagagccagactccgtctcaaaaaaaaataagaataaaaataaaaattaaaattaaaattaacccaaatctagtatgtctcaatttaaacagaataggcaagaaaaaatgatacagttgagggggagaattaataaatctttaaggctaaggtatataaccatttttttaaaaaataatggttattcagtctcatgcttaccatccattacgaatgtgtttctagtgaagaccacaatttttatgttgatttacatgttttggtttttaaagaccatagcctcagagttcacccaattggagatatattggcaaccctccatatgtcacaatttagcagatgattttgcgacaaagttttatctcattttatggtataaatagtaaaaaaaaaaaaaaaaaacctctttatattcaaaatttatctggaagattacatttcaagctttttagaaattgctttcaacatttctttttaatttgtgaaactattcatagcctttccactgattccttccccattacatctgaaatgacaaaaaggtgaattgtgccatatggaaaacatctcatccagcatgttttgaagcaacctcataaatcgaatattatttctggatgcttcatgatcatttgataggtcacttaaaggtgttctaaaaatattatttggaacattcttcatagagagcacgctgtcaaccttcagtctaacatgagcgttagacattatatgtctatgctcactttattttttctgtcaatagcacagaagccctcacacaaagttataaaatatttctgacattcatggctcacagatcaggagtttcaaagagctgcagacggttatgttaattaagcaaaggcattttctataaatccattgctgaagcaaataaaaagacgggtggtgagggaggtaggtgtgtggtgtcccagtgatcaaccaaactgcagtcagcatggagattgtaagagatgaaatgaaattaagcatcttgctttgtaatcctcttctagaatgttctagaatcttctgcaatgtttatatgacatacaaaaaggagacagtataaacctgtcaagacattaaaaaacaaacaaggaaacaagtaaaactgaaattgcctttcctggatgacagtgcggtactaatcatgtaatgccatcacactaaatcaagggtaccaatcacaatagatctagcaaaatcacaatgctctttttgccttctgagtggtgctaatgttatatatgtcaatgagagcttttcctgtgcttgagtctaaatacatttactgattaaaaagatgcaagtgcttatgaataggttcttccaaaagccacatttcttaagcttcattctcctgtttctaacacaacaagatgtagtatttagggtaatgcttgtcaaatgggcaccgactgtagctgattccataaacatttgccccctttgtgttcttgaagcagaatacaacattacatttccagggaaagttaagaatatgtaggtacttaaagggctgtcagttctgggttttttatatgtaacattaatttttacaggcagcaaacatcagacaattataaagcacttcacctagcaaacttcagcctttgttagacttacaaagatattttgtcatttgcttatgagacttaactgatagccaagaattggctgtattattgtctagcaaagtttccacggaacaattataatactaaaggatgaatacttagaatataaaaagccaggtgatctttcatatttatgaaataatttttcagttagtgacactcttctgcatgaaccattgtgagtcccactatctcttgaaagagaattttatcatgtaaggagaatatttacatttatgtagaaaaacagtgtttactatgtccagctttagacgtagattacatatatagaaattatttcatttaagtataaattgttaaatatttatatggtcacatatgtataaacacttcctttaaaatatattgtgtttaatttttaagaaacaaggagaaaattcaaggagatttttatttgcttgttaaacatagcaatattgttcaaatgatgttaaaattaaagtaataaatgcagattctgagcaaagaaattgggaaataaagatgactataaaataatgttttataagggcatttgcatactttggcacagtaaaatggcatatgtgggtattagaacagggcttttttaaattaaagactatcattatgaaagaaaatagctacagtttttcaaagcacttctgacttcctataagaatacctattttctacaagtggattcgtatgacactcagtcttaaaaacctgaagggaaaaatatttttgacagagatttttaaagttttatgaacaattttgatgtccctaaagggttaggaaaaagcatgtgaagcagtgtcccaggtaaaagtaataactcagcaaggaaatgaaaatatttaattaaacattacatgcatgcatgcatttataaatgcatattggaattactgtcatatagtaggtaaaacgacaagaacacaaatcagaaatttccttctctggtcctgaccaaccatgtgtcaatcagccttaagtgtatatacttgtcccatgaagatttacattataaatgaatacaataggtgttcagcatctactgatgaacaaatgaaggaagctaactctgctatgattcataagtaacctagtatcatatatgttctcactaatagaagccattaagataaacttaggtacacggagaaaagataagaaaaggcccatgaataataaataagcagtatggatatacggagatcaaattatgtcaaacaaacctgattgctttttttgatagaattacaaaattaatggataaagggatgcagtaaaagtagaatatttggattttcatgaagtatgtaattcagtgtttcataaaatctgtcttacaatattaattcaaattggcttgaagatgattattctcagatggtgggaaaaccatttaaagagctataaacaaggggtaatgataaatggcaacagatagaattggggggaggaatgagctgtcaccaaggttgatttaggtctcgaattttagtatcttcattactaacatgcaaaatggaataaataacatgcaaatgcaattcgaaaatgacactaaattggaaggcaccataaacgcaggacagtaaaatagtcaagagaatgtgggctggaacataaaataagactacacgagagactgcccgcactaaaaggcaagtgtatgttaaaagatagtttggatttattaccacccctcccccccaaaaaaaacaatgccagacaaacctggcaaaataggttgacaacataggattgcacaatcccataagtaaagcattctggaaactgctttaaaatatttatctccagattttaattcatgtctaaatctcagcagatctataaacagaagggagtttagaaatgacagtttaaaccaaattctgattttctgtatggtatcccaaacagaacaacgcatatctttatagagtgactttatacattcaattctctattttctccatatggattgttcacaggaaaaaaaaaaaaaagatccactacaacctgcctattctttgacaatgaacacacttataggtctttccttctctcatgagtgcagttgaagtgtatgtagggaatatcatctacacaaaagataatcatgaaggtaaatcttctgtaaatgacttttggattacccatggcacaatgctccctcttcatccgtgcaaataattgagagtcgattgtacacacatataaggaaagataaataggaagacaaatgacttctatgagaagattattaatttactccactttatcctcttgtatcggacaactcaacaaattagcgggaattcagagcactgaaacaaaaacgataaaggcaataaagttatccacttatgagaatgaattaaatgagctaacccatggagtgcatcagacagccatgagcaagctataacgcgcaacacctagttatacgctgaaaattcacaagaggaaagaaattcttttcatgggataagggcaatttccctcttactcagattctcaaataaagaaaattacaatttagagaaaacactattgcctaaatcattgtgaacaaatttgatttagacttttactgcagaaatatttctgaagtactaaagaaccaactcttgattacccatggggaaagacattaaaagttacaagatattagtgaaaatcacaaggattttgaagtgagatagtcgtaggtttgaatcttggctctgtcacttacacaagacatattggtgtggtcaaacatcttcatctgaaacatagagaaaataaatctaacctagttcacatatgtgttaaaatagaaaagaggaacccacagaatgttaaaataataaaaagttagaaagtcacatttcatttaaaaatatacacaaaaacattatttgtaaactatcatccctagtagggaggaaagatggtagaaagagcatgatattgggatcatgaagtcctaaatttgaacactacttccccattgaccaattacatgacttaagtaatttatttaaaatctaagtgtaatagttctcatttataaaattgctgaagtgctgtgcaggtcagtagattgtaatgcaaataactgacatatagtgaatacaaaataaacatgcattttcctgtcccctcatctttatctttccccacctaaaatagttactttaactgttctttaaaaatgtgcatgccctcttggtgcatatgtagcatcatcaatctcaatattcaaactaaattggggtagaaaacacatactgcctatgttttctcttccacattctagcagtttaaaaaatatcaaataatatatttgaaattatttaaggccagagtgtaacattaatgaaaattttatattatttactcaagtattcctacatgtgtattattttgtttcatgaatcttagagataaaaggctgtatttatatagctcattctgtacagcactgaatacaaatgagtgataaataaaagcttttgataatagatggcaattaggcacatcctcaacctctttctgcttaaccctgatcatttcagcttggtattagtatctggagcctgacacctgactgaagagtggcaaaatagacatttgggcttaggtcatctactttacatatatatttttgacagttgcaggtcatcttcatagcaaaaactataatgtaatatgaatagattaaaaataaaactggaaactttgagagttgagactcttttttaggaaatctgtttcattaatgtcactttaaaactatgttatttgttaatatttatttataaggaaggtaaaaattataccttcctcataaagtggcttcgatatataaagaagcttacacatatagtagttaaaacagtatctaagatattatataatcccccaaaataaagttgttattagccttattgtattgccatcaatatttttatatcaagatcacctagttccaaagataagaagggatataacaccattttttcataagaggatataaaggcattcttgtagacacctattgtgtctaatgagagctatacatctgagaacttccccaatctctcacatcctaatcattgacatggttacggttggaattgctatcaactggcttcagttaactcaaggtgactcaacctccttttctgaaatgaattatggggcagaaactggggggaaaagttagttttactttgggtatcttaactgaaggatataagcataaaagtgattggctgccacgttttctattatgtgggccagaaaagcaaataatgtcagtgtacaagaaagtgaagtccactaatagcaggaaatacgaatgatagatggatacaatattcagatggtctttatatttctgatttaaatttttaaggacctatgcattctccccaccaaaaaaaaaaaaagaaaaaatatctttggattctatggaatatttctgatttaaatcgcactaaggccttatgcattaccgcctctaagaaaaaaagaaaaccaaatcttatctttaaattctatgattttttatatcaatatcatgaattttctttttgccttagcttctttatgtctaactatttaattttatgaatgtggtaatcaaggcccagagtggctacatttttgcccagtatcagacaattttcaagtggctgatatggaaccaaaaataagaataatttgggtatattatcagggtcttaattttataagatttcaaataaaactccacactttgtatcagaccaggtaagagaagagggataaggctaaaaaagttaaagcaacggcttccccttatcttccaaatccagaaactgttaggagaagggagatcatagccagaaccatctaatcagagtctttaaacctgatgcaaagtacatgggtaggagaacaccttttccaaagataaactgaactccaagcaccgaacaaactgttcacattctagatagggttactgggaggcttccaacagtttcgaatagagcctgttagagacattacctcctacccctaacatctgtctcaggctagtcacatccacttatattctccaggaaagatgtatatcttcctgcttcggtgatgcagagaaagggagcttaaaaagatcatctgttgattgttatgattacagtcctctatatggaaaatgtgtctataagcaagatactgacctcttatgacatcaacacacacatacacacacacacacacacacaaatatcttctaaaggccatcaccaaactaaacttcactaaatagtgagtatgcaacatttttcctatgttgcttagagacttaggaacacttccacagaaagcaaataaaactagaaatataaatgatttatactgtgataagtggactatctgtatgtataaattaatgcaaaccaatgaacacaatttatagtaacagtactaacgccaccaatttctaaactacattctatagctatgattctgtcatcagtctttgtttccataccacatcatcatggttcctggcacatagtaagtgcttaacaaatgtttggtgaattaataaaatctattaacaatcctcaccctgctgggtttctctgtgacacttccagccactcagcactctacacagtccaaaccagcttgagaggtgaaaatttgcactctagtggaaagagttctaaacaggaggccgggagacaggttctcagtcttagatccgtctagacatttgcattaacttccctcatctataaaacatgtttgctgcactagatacttctaagagctaaattctaataacattctacatttttaaggacaaagaagatgttatagatacattttaaaagcagaaaagggttagaatcctagctttaccatttacttgtgactttgggcaatttatttaacctctaaactttagttcctttttctgttaaaaaggaataataataacacttacttcatagaactgttgtgagagtcaattgaaataatgcgtgttaagcttcagacacagtgcctggcactaaacactcacaatcattatttgttgctattgttcttactattttttatttgttgtgttgtttttatatatctgctctcttctctgatccaggaacaagtggaaagttcatcatctaattaaaatctgctgggaaaaggctatcaaggagactaaactctgcaggacaaatcaatgtaacaacactatatataaagggcaaatcgagcagtaacatcaaagggttattgaactgtgtagtcttcaaacactttaataaatagaagtttcctattacaggtatcaccttattataatagtaggacatgaaggaaattttaaaccactttagaggagtctgggaattatcatatttatcaaaggaagatgtgggttttaaagattaaacagtgctactggaagaattattgtgaaaaataaaaatggattgtctatcacatgacaggtactaaccataacaagaattctcataaccacacaaaatcactaaatgaagaaagacagagttgaatatgatgcaatcctgcacgtgtcacagaaccagtaaactttagagatgaaattcacaccctggttggtagtccctgggtagcagctaagagtctcaggatatcattacccacttctttgtggttgatacagttctacttcaagaaacaccattgccagtgagaaagctacaaatatggtggttatgaccaggaacttgagaatctaacaagtgaaaagacacataattcatagaaattacttaaatgcctataagaaatagcttttatgtgtctgaattctattttaaattaaaaaattacaaatacaaaaatggtttattcattgattcatacaatggacatgtgttaagcattctcatgtaccaggtacgctattagacactcagtttacagcagtaaccaaaagcaaccagattccctgctcagagaaagctcaaattctaggaaaagatgagggggacctgaaaatacagaaacaaaaacaaacaaatatgtaaagtagaattctgaaataataataacaataataaaactggggtttccatttgctactactgatctgcatgtatattaattttgtcaatagttgacaaaggaaagcaaatagaaaaatacattaaaagctaatataagactatatacaaataccaacctgatttcacattttgtatcaattaaaatagctttattttttaaaattgacttcataatatataagcttaatgaatttgaaatttcaaagtaaaaatatactaataaaatagatgtctgggaattccactttgggaaatacaagttccaatcaacatttaaacaacttttgggatagtggttagtattagtgcttattcttcctggctgaattgcacatttttaagtttgaggaatatcttctgatatgatttggatttgtgtccccactgaaatctcatgtcaaattgtaacccccaatgttggagggggaaccctgtgggaggtaactgggtcatgggggtgaagtcctcatgcatggtttagcaccatctcttcttggtactgaatagtgagtgactgctcatgagatctggttgtttaaaagtatttagcaccttctgtctctctctggaacctgctcctgccatgcagatgtctgttcccactttgacttctgccatgagtaaaagctccctgaggcctcctcagaagcaggcgctggtgacatgcttcctatactgcctgtggaaccatgagccaattaagctcttttctttgtaaatcacccagtctcaggtatttgtttacagcaaagggagatggaaataatacatctttactctttttgtgagtttgtttcatccaagttatataataggtgaatcttatgtagtttgtgcctactgagtattttaattgttctgaaatctctttctttgataagaacaagttgcttagagcaagcagcctagtacaaggtgtgcttataaaatgtctaccaggccttcattattaagggtttgctatctccacaatgaagtatgattactcagcctctgcctttcctggtcagatgtgttagtcctattcacagctgtcagcctatcagaaacctgcatggagataaatgatgccattagaacacatggtctgctcaacagacactcagtctagaagctgtggcactttgatttacttatctgaaaataaactctaccaaatctcctctaaagataattcccgtcaaggaacttaaacaaaaatacaatgcaattgaaaataaatgttaaaattataagcctattatttgtaatcactgctattataacagttattcaatgcccattgtactatatttcttgaaacctctttaacttgtaggagttgtaataattctcccttacacacaggtttgaaactttcatggctctatttctccttagaggaaaaactgtttcagtctttaatatcctctaaagctccctggaggtctagtgattgtcagctcaaactggtctatcctatagaagcatctagtcttggaacttggtccctgtgccttcaactcctgaaaactgagtctctgtccttgaaagattataactgatcactcatttagacatgcttgctccacaattctccatcctagatgcatattataatcatattcagagtttaaaaacaaaacactgatgcacaggccatacttccagattccaatttaattcttccaagtctgtccacttcagatgctatttaaagggccccatgaatgtacaatgccttcatcaacatgtcagctaactgatgattaaaacaaggtttactataaggtaatactaattcttgggtttttgtttctttcctctcttcatgtccactatctttagtgatttgcttcaattgttaaaactgaactaatgtgatgacatgtgcaattcttcttttttctaacaatctccacccttttaaattaattctttatctatcttacgttgtgttggtcacctcacccttttggggtgattattaatttgactttaaaaaccattacatattcccagcaggagttcataactgtttcccaaaactgacaatgacacatacctgactttctgtatacaaaatgtgtaaatgtctatacagaaaacagaatgtgaaaaataatggcattttccttggcgtgacagagagggaagaggaagctgaagagcaggagacaggtaaaaaaaaaaaaaagtacagaaagatatattaaggtcaattgatgtggcagggataaatctttttccaaaattcaagtatagatttatagcttatttattgcaataaacttaaattaccttaatctaagcttaagttcgattttgagctcttattctaccaggcaggtaaactaaaacatcaggtgattgggatatgacttacatccctacttcactgacttttccttaaagatctatccaatttccatgcaactagaaggaattaccaggaattgaggtagggcaaatttacttgcagtattgtaactccctcttaacactgccaatggttgctgtatcattttgcatgacccctgaagggtgagatactgtctcaggttgagaactattagactgatggaaaggaacaaagggcttaaagaaatattggacaaaaaattggctaaagttcccagagtaggatccaatctatttgtatatgtatagtgaaacaaacattgaaaaaaaatcataaaatattaacaatagctagttttagattgggaaattataagtgattttttaaaattattttttgtcttttgtttgcccatatttttgaaataaacttgatttccttcataatatgaaaataattttaaaacatatctttaaagtttataaggcaaagcaaaatttattacttttttttattcagaactccagacagtgttcccactctttatattagtaaatgatcattacgaagcaaatactcatcactctcagtattttctctcttcctaattatatgaagatcccacacgtgatatgtctccagttccacttcatttagggaacctctgtgaccttggaaaaattattataactctaggtcacaggtggagagttattagcaatgtcctatgggaaacaaatgtctttcctaaaactgcctaattatgatcattgtgtgtacataattttcatgtattttgtgaagaacatcttaaatggtttagtttaaatgccattagggaattatacatagttattagaattgtagaacaggatagactattcacataaaatgagtctcatttacacatcagatattacactgacttgttgactgttgctcttgttcagtgctcagaaattattaaagtttgggaacttaaaaaagaaacactttctgctccttggagaatggaattataccagtgtttttatttttagagtgttacaatcaagttcatatcaagaaaaccagataggacaaggagttgaaaagttattccaatttttctgacttttgtacctctttatagatcgaagagtgaagactcatgaggctaaggaaaatgatatcgtttacagaaatagaattttaaaatatattgaatatatacaaatttaactaacaccaatctggtcttcttcctactacattcctgtatagtataattatatttgttgattagatggttgaatacgttgtatatgttgaatgatgctttcttagtggaagtaattttaggatattgtagtacaataaaattaggcaataagttggagttgaacaatgagaacacatggacgcagggaggggaacatcacaaccggggcctgtcagggggctaggggagggatagcattaggagaaatacctaatgcagatgatgagttgatgggtgcagcaaaccaacgtggcacgtgtataccaatgtaacaaacctgcacattctgcacatgtactccagaatttaaagtataataagaaaaaattaggcaatacagaaacacagggaaattattgatacgaattctaggatgttacttcacatgtctgatcacctcagtttgcttaactaccaaatgtggagctagatggcctttttcctctcttttacatggaaaatgcttccatacttttttctattccagaaagcaggaactataacttcagaatagaccctatcagaggatataggcgagcacatcccaatggaaagtatctccagagaatgatttatgtcataacaatttggatttgcttatcaagtacttaaccttgtgctatgtgctttttaatacattaggtcatttaaacttaatgaaagtcctatgaagtggataatattactatcatttctacagattaaaaaattagagaattatttttctccatgcttgtgagaataaacaacaacaacaataacaacaagaaacagaactcagaagatgcaagatgaacctcgaacctaactaaactcttggaacccatctgacatctataactcaatggtgtgagagaagtacaactaaaaaagaattacaatgatgaggaggataacagcaaaaaaaattacaaatgaaaacaatgaagccaactgcctgggtttaaatcttggctctgccattaataaactgtgaactctcagccaatttatccaacattgtcgtatttagggattttcatatttaaaatgggaaaattgatagttctcaccttgtggtgttataataatcctgagttaattgtgacatatactcagcagtcagtaaacacattataaatatataaagacatgctattatcatgccatttgattgcttttatataataaatagctgccattaaggatgattagggaaaacatagatattttaattctctgacacatcagaaaaaaataagtatttccagagaaataaattatgtaagttatcacgctgttactgaatagtaagataacctttccttccagtaagagacaatgaaaataaataaataaataaaagaaatagaaataaaatgaatagtaagataacttggttcaattacaaatcagcagttgaaaaataagactccttagaccataatatggtttggatgttctatcccctccaaatctcatgttgaaatgcagtcccctatgttgaggtggggcctggtgggaggcttttcactgatggggtgaacctctcataaatggcttggtgcccgccctgtggtcatgagttcatgtgagataaggttgtttaaaagaacctggctttaaagtataataataataaaaaataataataataaaataaaataaaattaaattacataaacaaggaaaaacaaaaagaatacaaaggtacaaagctcctttaaatatgaatagttttccagacaaaatctacttaacagtatgaaattaatagctatgttttctcaattcataattactctatttttaggtaaagattgtgtcataataaaatacaggaaacttctcaattcaggattgtacaaagtttagatttcaatcaaacttgttctttaaaactctaaattattgtggcatggctacagttaaataaaatatgaaaataaaaaaataaaaaaaaaaagaacctggcacctccgcctgcctctcttgctcctgctctcaccatgtgattcgcaggctccccggttaccttctgtcatgatcgaaagcttcctgaggcctcatcagaagctaagcaggtgctggtgccatgcttcctgtgcagcctgcagaactgtcagccaattaaacttttttcttgataaattatacagtctcaggtattccttgataaagacacaaaatggactaacatagtccataaataaaattctcgaggttagtgaaattatagacatatatgtcataaagattatttattacatttatatgtttatgaaataaatgtgttatatatggattactttcattaaaggaaattagaaaatagggcagaaagtgatatgaaattcctcagcacaattactaagtttctgatactgtttttttttcttttctacgtaaacatcaaaagtaatattcttggggaagagggactacctttgtcctggagcactcacaatgccttacaccttatgtcatcttgattgctagattgtaagaattagtctgagaaaaaagtcactaggcatttcctgagttctaatttgagatattttttaaggtactgaaaacaattggcatttggctttgtattactcaatgcaccagaggcatgcagttatcaaaacaacttttgtgtgttattcccccacttattaaattgattttattaaacttgttcctggctgatttgctatatgccaagctttctcccgggatccatttctaaggaattcataatagaggtgataacttttgatgggtacatttcagaaagttctacgattctaataaaattcccaaagtttgcataaaaccctagagaaagcatccaagttgtataaatgttttggagttaagtgtgagagtttaaaaaagcaaccgaatattaattgttgtgtgatacaaatcaaagaacagagaaaaaggcttgtgactcgattgctaatgaagtttaattggaatccatgtgagtatcagaatacagagcatttatgacacaatttcttagacagtaaattttggccgggcgcggtggctcacgcctataatcccagcactttgggaggccgaggcgggcggatcacgaggtcaggagatcgagaccatcctggctaacacggtgaaaccccgtctctactaaaaacacagaaaaaaattagccgggcgtggtggtgggcgcctgtagtcccagctactcgggaggctgaggcaggagaatggcgtaaacctgggaggcggagcttgcagtgagccgagatggtgctactgcactccagcctgggcaacagagcgagactctgtctcaaaaaaaaaaagaaaaaaaaaaaaagaaagaaagaaggtaagttttatatataatgggcagaatttcccaacgagaacccagagctattttctatatgttctaatattttgatcaaattgataataagctaagggaaggaaaagagaagactcacactgcaaacaatgtcatagtttgaaaaaacttttaatttataaaaggaaaatgagagttgtgcttcacagagaaaagctcaggtttggacatgaattgaagaaaaagggtttaagaggtcagttacaatggtatagaggaggcaaaatctgagaaataggtgtttattaaatcccagattttagaactttagtagattgataacagcatagcctttgtgcaagtcaaattacaagttaaaagttaattagaaaaaaaatagaaaataaaggagtatgccatcgtaactacaggatatccttagagaacttggtgaaaatgttaaataacatatctcatatgttatatattaggaggcattaagatgagatcagaagttctcatcttagttatgaaaacaaagtttaaaggaccgttttgttcttcaaaataaaataaaagtggtggcttactgagggctcacatttcctcaagtttatttagatgagtaagtcattgaaactcacatagtatacatgtcatgcattatctaaaatatactgactttttcatattaaacattttatttttgctagttgcaggttcatgatttagcattatgcaaaataaatatctagcttaattatctgcttagaccctgggaaactagggtaactaataagccagagcaggataagaaaatgtgggatgaagaagcctaggtaaattgggtgccagacaatgggtatttgtaggattctattcagctggaatcttgagtgctctgctattcaaaagcaatgtacccttttgcctacctctctcctacattgatcctacttccattgctctattattattatgtgcaatatctatttgttcctccttctattaagttaacggctaaggaaaaaacatggaaaacaatatagaacaacttgttaaagttgggcaattgcatttcatttggacaaagcttaatgaagtaatttaacaaatgtttatttagtacatacagataagctacagtactacgcactggcaatattgagatgaaagataaatgttgttcccataagataatcaaagtgtagagactggggttttcatgtagggacaagcaggagagtcaacagtcataatttcatcattgttgtaacaatgtacaggatgctgcagaagggagaggggaaaagtgtgccattacaatttaggaaggcatagtgtacttttatgaggaggtaacatgatactggaaagactactaagactaaaatgaataaagaagagggtaacagatgaaaaccatttcaggtaaaggatacattgtgagcatagggaactgatttgactaagggcctggatccctagctaaatggtggcagatagtttggtgaaagcaggtgactaaccaaatcataaaggttagctaaggcacagatattcagaaataaatgtggatttaagagatagatttgggcagggatgaattatacagaaaggagatgcattgtgataacagaaggcaaagatgaaatataccatactatcaatatttaaatggtgatgcagagaaaggggtagccaatgaaagataataaggaaggatcaggcagatgggacaaaaccaggaaataatagtgttagggaatccaaatgatttcaaagagaagaaatggtcagcaacatcaaatgttgcaaaagataatgactagaagatgtccactgggtttaatacagaatatcattagtaaccttgttaagagccatttcattgagattaaagagtaaaaactgtagtagacaggtgagagttatggagacaaagacaatgcatatagacaacactttctggggtcttgacttcgaacatattagatagaaagtagccaaagatatatatgggtttgaggggaattctctgatttatgtggtagaattgtgagcagaataaaatactatatggaaatagacaatagagaaagagggtatggccaaaattttagaagactcatagacaataaagaaaacaaagtgctgatactgataccatgaggttttcacagaggcagatttatctcggaaccgatgaagcttaatcttcatggctcccttctccaagggcccctttcaaaacaatgtaactaatttacattacatttcttaaagaagaccccctccaaccctcaaagaagaaattgcaagcttctatccttgactttgcatttaaagggagacttttcttccaggctatgagaagaaaggttttagacaaagataatctgtttgaggaaaggcagtgaggccagatttgagaaaaatcctcatggcctctatttcctttaaggagacaccaatgggaaagctgaatgtttgtctttatctaggtcttatcaatgttctggaatacaaatatatagagtttggtctttgatagaactttgatgaaaggaaacccccactttgatgagagtgggttgtttaacaggcaattggaaatggcttgtttgtattaaaagacctgctagtcccttggggcatgctttataaaaagaagtttttattttcttttccaattagaaaattcccagttagggatattatataatattgtattatataataccgttttataatgtgatgtgcaaatgcatttgaaagatgttctaataaaaatatgctgaatattaaagtttgtataagaaaatttagctttgaatttaaataaggcttactcttgtaagattggtatcctataaatagttcaaatgtacaattaatgactcctatatttattcaggaatgatgcagaaataacaggaaaattggagaagaggtgggaaaccgctttctaacacctactgtactacccatggaattgcctgcacaaacttgaaagcactgggctatgcatattaaaaggctactgctggctgggcactgtggctcatgcctgtaataccagcagtttgggaggctaaggtgggaggatcacttgagcccaggagttcaagtccaggattttgaggccaggagttcaagactagcctgagcaacatggacagagcccctctctaaaataaataaataaataaataaataaataaataaataaataataaataataaaaataaatcatgccactgcactgcagcctgggtgaaaaagccagactgtgtctcaaataaatatacaaataaaaggctactgcttcaaaaaattcttattcctgaaacttcttcttgagatatgagataccttattttacttactaaatagtaagtcacatgctatctatctagttataagaaaattataataaaaaagtatctatcaagattttctcttaaatagtaaaataactatcctccatttacaacagctacagtacattgtgataaatgtaccctttgaattaccaacaggtatgtctttccacagttttactttgatggccttaatagcaaggcacaattaatagctatctccaatctgcatgtgatagccatagatatgaaatgatgacttctcccggggcatacaaacatattggtcttgctttcctacaacctctaccttatctgacagtgttagttttggctctagggcaatgccaatttagaattctaccatttcagaagtcagctctatatagctttgttttacagtttttttttttttcttttcaggatgacattatctaattatatttgtaaagttctctctctctccctctctcttttctttttttcctgttatctgtattggggatggtggctagtggggattagaagggctatctacagttagtaagatatctgcagcatactaattccattttaaagataacagtgatcacacagataaccacctctagcaaatctatgcatgcatgcaggtatgaagacaaatgataaattcactatagttttaaaacagccattccattgaaataaaatgattatttgcatattaaagtgaactgcaggcaaaagattgtacatcaatggtcttacagtcattactgaatattaaaacttttttttgttgtttctttgtaactgcaggataaattgacctcctgcaatagatctaactgacagcatggctgttttcagctaatgggttgttatatcaatggaccttatcctggcctcaattatagacatcagcatttactgcaaaagaagcagcatcaaaaagtgtaaggacaaggtgatgaagagaggacaggtgaaacagaagtaagcagatttccatcccaagatctgggcccaagattctgctctaatatttgaagccaaattgttctcccttatcactatacctgatacaagaaataaatagcatttttaattggtcttataagttgataggatggttttgtcttaattctgtcattctcattgatagtttacactcctacagtgtgtctctataagtattcataggcatgttgttttaacagaactacagtaaattggtttcacaaaccacaaatgtccactctgtgccaagaacagtgctaaggtacaggatacaaaaataaataagtcaaagttcataatcctgaacctcaggggaatggccaaataaatttgtgattgcaatatggtatgaggaatgaaataaacgaagtgactactgggagcagtggagaccaaaggaagaagcaattattctgcctgagtaggagcagggaaggttttaaagaaaaggtaagtcttgatcaaatacaaacaattttggcagcatttagataactaggccttgagtcctttagagtcattaaagcagatttctggaaggttactattctcaagagattctggtttttgtttattctgcttattgaaagccacaggtaagtagataaatgtgtattgctaatcatcttatttcaaaatttgctgacattttagtgttgttgagtatgaagtgtctgggatagtcaatttttaatggctttatttatttagatttggttataggcaagggaccagttcttgatagacgagtctatcaggaagtcaatatttttatccacatatgaaacttacacacggttttaagttatgatcttgcattaatgttattaatgagcagaaatgatatgtatataattttgttaaaaaagaaaaagaacattccagtgtgtagcacatggcggataataaaaatatcattattggataagtaaatttatgaataaagttacatgtggctacactgaaatgtgttttgcatttggatcaaaatacaaacacacacacaccctatacatatatatatatatatgtatatgtatttcaaactacttttaacatagaaaagacaaaattttctttaaggcgaagaaagatttttttaagaggtggcaagggtcaaagatttccaagcttcttaaaagataatgtattaggttatatgaaattagtgaggaaacacgcataccacaaaaaataaccaatctatccctagataaataatattctaaagagctcagagcagtaagaattaaaattgaaaaacacaaaaagttgaaaacgctcttatcaccctgaactgaaaataatatataacaagtaaaggtcagttaagtcagaaattccttataaaagcaccctaaacattgttcaaggccaagatttctcacttctttcatttccttaagaaaaaaaaattacttctacatagtctttcaataaatatatttttcaacaataatgaaaaggttataaaaagcttcctctcccgctggaagcttattcagtgaccttacttccctgtctaccgtcaacacagacctccatggtccctgctagtacgttttgcttgggggggtacatttacctcctttcggtcaccaatttgtctgcattctcacagtattagttcctttgtaatgcttccaggttataattcccttctcaagttaattatgtgggtagaactctttcccttgaacttgtccttattttttgccttcttggagaaaatcatatacgttgaaaatttattttatatatatatatatatatatatgtcaggtcagatcaacttgttttaataattctatcttcctttaaaaatgtatcttttttctttaccgctggtcattttcataattttattttctctaactctggtgttcaaagctggtttgccttttaacaactcatttatctattgattttctggtttcatatttctgctgattaaaactctggtcaatttgcttctaaaatcaaattattttatctcaataaacggggaaaacattttattttattcaccctgtttgaccataacgtgttgatatcttgaaaatgcccttggcatttgtttcatttgttgatcattttcatctccaatagagaccaattgtctccagggataattcagtgtattaaaagaaaaaaagtctcttttcaaagggaggattgtttcctcttgtttcttttatgcttatagatattctttctaaaatgtcgtgtgattttttaaacaatagacatggataaccatgtgcaaacagatatactgttagtcatgtatatgaataagagttaaatatcgtaagtaataattctaaaagcctacttgatatatctcactttgaaagttccacaggcatctcaaatataatatttcctaagtggagctatagatctctcccatctattccaactcagtgtcaacagaacctcttccactcaattgatcttccaccatattcttcatccttgacatctacagctatcataaatactattaattctatttccaaaacacatctcacatctgttcaatcctctcaaactgcaataactttcattatccaacacactattctttcttacttagactgctgcaattaactaaccagtatttctacttcaacttctgctcttctccacttctatactccattttccacgcagcaatgttatatctgtctctgtccatctctccatcaatccatctctccatctatttatttcaatgcatgacagatggagcttactggacttctttctcttccagaagcttagccacactgaatactccattcctttaattatttgaaattacctaacttcctcctgccccaaagagttacacattctgctacttttgcttggggcatttgttactttcttcttcatgttcaggtaagctgaaagggaagtcattttgataagtcttccttcactttctaggccagtataatagaatataatgtgagtcaataatgcaagttgcatttataatttaaaattatctagtacctacagttaaacctgtaaaaagaaacaggtaaaattatttcaaataatatatgtgattttaatgcaatataaccaaaatattatttttaaaaatgcaattgatataaaaaagtattaatttgatattttatattcttttctggtactaaatcttccaaatcttgtgcatgttttacaactcctacatatctggattttgaccaacctgtttccctcttctgtgatcaaaagataaacataattctgggaggacatacaccaaattttaaaactacttctcagttgcatagggaatggagggattcattagaaagggaagactgccctttctccgttatgcaatccaatgtctgatttttcattttttttttttacaatgcacctcttctatttactacattaaaatatatttccactttgaaaataataattaaacatgatttaaaagagaaacattctgaatgttaagaactgtgaagtattgtaaattcactgtcattttgtgaataaattttatgttctgaaagagaatagtacttaaaacatgttgctttctctgtacaatgcaaaacagaactggataatttgtttaaaggtaagtcattgttcattttccagcattaaatggtccttaagaattgggaaggaattactcaaccaaaaacagttaaagcattattttctttgtgctagaaatacaacatgaggactataccatctcattattaacctcaaacagatttgtggatttttttagcccagtgtcatgcttctcaggcattttgttcacacttctatatgattaatattgtatcatataataataatttgattgatttcccattgcactgagctcccattgcattgtgagtgcttcacattcaaagaactgtttctattcatcttgggatccctagcaggtaacccaatgcctggtccataacagaatatattgttcaaagttaacctaatttggcatatatgtccttgtggaatttgaaaataagcaatacagtttatctgtattatcccatacatgttcaaataaaaatttaaattaaattagaattacacttcacaattcacctgaaattcaccatatctcttcataacaaaaatataatacatgcacatagaaacatgtctaacgaatgctagtttagaactgtaaatacattgggtcattacaaccaaaaagtaggtaccattaatatactcattttacagtaaagaaactgagccacataggagttaaagactctgcctaagttcattcagctaataagtgaggtctcaaaccatgcttagacactggagcccatgatcctagccacaacactataatgcatttctaaagtctcacaaaaacaacttcacattctttatgatattgcgattgtttaaaagcagaagtcaagtcgatttgcgctttgctagaaatatttttatttcaaaattgaaaaaataagtatacgtttgaatttctattatatgtcaggcattatgatagattctatacgttttaccattgcatttgaccccttgtgggtgttggcattcttatcctaaacaagaaactgagactgcaaaatgttaacgaatttgcccaaggtcaaataagtagaattcatcagacatcaacgtcctttctctttcaaaaagatataatttctcaaaaaaaacctggggactagaatgctccattaggaaattccctaaaaaatcagatgacttctggaaatgccactgttccacaaatacctcattcagtagaattccctaacacctaaacttcatgcagaaaacctaatatgaaaagtccattgagtcaccagctcctagaatatcattataaatttgtcagatcatgaattttaagattatagatcatgtgtgcgttattgcagacgagtgagtccaatgttttccaaagagtggtattcaacattattttagatatgtagaaaatagtttacatagcactgaattgcattgtgtaaaaacttttccttatgattatataagaagaaagtctcagctctgtgtttctatatcttaaactactctctaatttttgtcactcccgttttcaaaggagaaacaaagaattcctaaggctctgagtctttagcaatcacgctttttctttgcattaatattttattatttcttacttatgatggagatactggagtgtcatttttggtagtaatattgaattcaattaaaatgcatttgtgtcgaaaaatgtttcaataaaatttaaaataacatagttgcatgtgaatatgacaattatgaaaacaatctaatatcaactcaagctatacaacactgtcctgacctaattgatatggtttaactgtgtccccatccaaatctcatcttgaatcgtagctctcacaattcccacgtgttgtgggagggacccagttggatgtaatttaaacatggtggagggtctttcctgtgctgttctcgtgataatgaataagtcataggagatctgatagtttttataaaggagagttttcttgcacaagttccattattctctcttgtctgcctctgtgtaagacatgtcttttgctttccaacatgattgtaaagcctccccagccacatggaactgtgagtccattaaacctctttttctttttaaattacacagtctcaggtatatctttatcagtagcatgaaaagcaactaatacagtaaactggtaccagtagagtggggcactgctgaaaagataccttaaaatgtggaagtgactttggaatgggtaacagattggaacagtttggagggctcagacaacagaaaaatgtggcaaagtctggaactccctagagacttgctgaatgggtttgaccaaaatgctgataatgatatggacaatgaaatccaagctgaggtagtctcagatggagatgaagaacttgttgggaagtgaagcaaaggtaactcttgttatgttttaacaaagacactggcagcattttgtccctgccctagagattcgtggaactttgaacttgagagagataatttagggtatctggtggaagaaatttctaagcagcaaagcattcaacaggtgacaggtgctgttaaaagcatttagctttaaaagggaaatagagcataaaagtttggaaaatttgcagcctggcaatgtgatagaaaagaaaatcctatattctgaggagaaatccaagccagctgcaaaaatctgcataagtagctagaagctgaataataatcagcaagacaatggggaaaatgtccccagggcatgtcagagaccttcaaagcagcccctcccatcacaggcctggaggcctaggagggaaaaatggttttatgggcctggcccagggtccctctgctgtgtgcagtctagggacttggtgccctgtgccccaggtgatccagcagtgactaaaaggggccaaggtagagctcaggccatggcttcagagggtgcaagccccaagccttggtagcatccacatggtgttgaccctggtggtgcacagaagtcaagatttgaggtttgggaacctctgcctagatttcagaggacctatggaaatgcctgaatgtccaggcagaagtttgctgcagaggcagggtgctcatgcagaacatctgctagggaagtgctgaagggaaatttggggtgggtgcccccaaacaaagtccccactggggtgctgcctagttatgagaaaagtgtcactgtcctccaggaccctaaataatagatccaccaatgacttgcaccatgcacctggaaaagccacagacactcagtgccagtctgtgaaagcagccaggtgggaggctggaccctgcaaagccacgggggcagagctgcccaagatgatgggagcccacctcttgcatcagcgtgacctggatatgagacatggagtcaaaggagatctttttttttggagctttaagatttggttgccctgctggattttggacttgcatgggggactttagcccttcattccttcattttgggcaatttctcccatttgaaatgggtgtatttatccaatgcctgtatccccattgtatctaggaagtaactaacttgcttttgattttacaggctcataggcagaagggacttgccttgtctcagatgagactttggactgtggacttttgatttgacactgaaatgagataagactttgggagactgttgggaaggcatgattggttttgaaatgtgaggacatgagatttgggaggggccaggggcagaatgatatggtttggctgtgtccccacccaaatctcatcttgaattgtagctccaacaattcctacatgtcatgggagggacctggtgggaggtaattgaatcttgggggcagatctttcctgtgctgttctcgtgatagtgaataagtctcaagagatctgatagttttataaaggggagtttccctgcacaagttctattattctctcatatctgctgccaggtaaaacatgcctttctccttctgccatgattgtgaggcttccccagccacgtggaactgtgaatccattaaaccttttttctttttaaattacacagtctcgggtttgtctttatcagcagtgtgaaaatgaactaatacactaatattttcattttacaaaagaaaacaagaaactcagagagttaaataaatatataccagattatactattaaagagtttaaaacctaggttttctatttttccattaattatttgagataagcactgtggcacagatgagtcatgaatatgcacactttaggcaggaaagaataaagacacagcacgagcaaaaacaataggagatttatatgtagggtacccaaaaagcatctcagagggtagattcaaacacttcccctgttatcatttaaaaagcaaaactattcgtgaagatcagtggaatatcaactaacttccatcaagataaaatctaatagctgagatgctggttaataaagtttaagccccctaagacaaaccaccttagcatcttagcattttaataagagactaataagtgataagcactcaagatcaaaggaatgcagttttaaagaaagaaagataagcagtgtgttcaggggtcatgccagtattttttataccatactttaaaactctccaagtccctgttggatacaacctaaataaggaatgccataaatgaataaacttataaaggaaaatcagagggagttttggggtaaagcagtgattccaggagtacattcaactattcccaatcacttcactaaacctgtcatggaaatgttagaaatgggtctgcttttttttttttttttttttttcagaaccaaagtataattgaatagcacagagcatctgctgaggaagtagcgtcacattttaagaagacagaagagtcacaaagaataaaaagactttaaagttttctaaacaactttctaccaaatgcatgaaatcttgtccctcctttcctgattgctcttggctgagtatctatggtggtaggagagtacaggatagcaggtttctgtgatggagatggcagcgcacagtaggagggatgtgagaattggggacagagagatacacattcaagtcctcacttctccctttttcttgctgccttgtcctactctgcagaatgttggtaataatgacaatgtcatggatcattgtgggaatgtatataagaaacactcagggaggggaagaaaatgaacaaacatctttgggtgcctacaacatgccagcatctttaattttgtcttttatttttgctgctttgtggtgccaatggcccggttcctagaaaatacaaggtgttcagttaagagttccggtccattttcccatctaacaaggcactccattatgttgtaagaatgctctgattgttagcaaaacctttattttaagccaaaatctgcctcctttcagcttctgcctaatgctgccttctggaacaactcaaaactaggccactcccttttctatgagagcccttcaaatatctgaaaacaattactatggttcccttcagtactctcctcaccaaggtcaacacacccacttctttcagctattacttttgagacatggctttctaaaaacatattgtcccaattgcctattatagacacactctagtcagtcaattctatccttacatgcaaggtctttatctgaacatcatagtccaaatgaagtctgagaagagctgttgaatctgtgctgaggagcttactaaccaattgattcttctatccctttagcagcattgaagctaggaggatacatgattgtttcatgtgtatattttagggtaaaagagagcattaagcaagagcgtgatcaaacaattcaatattaataaataataagatatatttctgcttgaaaactcactgcaacaatttgttgtgacgtttccctttctgtaagccatgaggatagcataaattctacaatgaagatgcagagggtatgaattgagcttaattatctttaaagttaaattttgttatgagctctgaagtgagtcacttcagaatttcctgagtttaacttctgccagcttttgatacatgacctcaagcaagtcaggtaacctttctgtgcctcgttgccctcatcagtaagatgaacttgtcccactgcttcacaggggtagtgagaatttctcttaaaaagaccaattgtgcataaatgctaagataactgcagcaaaagttgccttataaatcttgactagaggagtcaaaggtgtataggtgaagctatcccactcaaaggattcgaaaaatctaagctatttggaaaacactgtggagctcatttagcatttgttttcattattagcatattcctgtgcttgtggcttcctctcagcttatccaaatccacccgtccccagtatatttattgcttactcttcttctcttccaagacttgacttctttcctgttaccatattcctctttatttgcaccacatgttagttagcttgtgccctctgcttccttaggaaggatgtcagattgctgaccccatgggctttgacacttttccagcagcctatttcacatggagtaataaagcagtcactgctgctaccgcctcactgaaatagatgagagttgagaacaaaccaccacactaaggcgaagtccactgatatctaagtcctttaactgataataggaaaaattcaaatgggactttgctagagcagagttatctgcaaattttatcaccggactgctttcaaattagctcctgcaataaaaaagctcttcatcttaattctaaatgcattgtaattacaatcagcaaacaaaaggttaagccagcctcttcaggggactacatttcttggaaagacacctagattattgccccaaatggctgaagcacaactagctgtttactgagcttaacttcttgtttgttgaatctgattactgtttgaaataaatgcagtggtcatctagtctttgcaaataaaagtttactgataaatgttttattaacactttcattctctggccacccgcctacctgacacttgaatgagccctaacagtgtaccttaccttacttgggatgcaaagcacatttccaatgaggggctcttcctgaaaaagtaatagaaattcaaggaacctgccatcaggtatctttggcaacaatgctctgtccttcctttgtccctgttactgcctggacgacacatctgccaaatgtcccagactggagatctcaggatctttttatctacttcttcacccacaccctttatatgcagttagttgttaagtctttattaagtctttccttataatgattattgaatacatctctgccttcaactgccactccaaataactgattccaggctctcattaaactaattccttggagtttgaaataacgccatacccatacaagtaaattcctccaaataatactttcttcctgctactggatttgttacagcttattagtaagctgacaagtcttaaaggctccccacaatttggtcttccgttttcagccttatgtcctaacatttcacaattttgttgcatcttatctctttccccctatgctatggtaaatactttctcttttttgctttcctccacatctgtgaatagaatttttaaaaaggagaggatttcccaggtggaaatgcacctagaataccttctcctttttctctattctttttttttttataattaactcacattttgtttcttccatgaatcttcttataactgcccccctgccaaatgcatgctactcaatcatctattaattaactcacaacccttttttaaaaaaataccaggcagggtgctaggtactggggatataaagaaagataagatgtagctcttgttttaaggcgctcttgagttcaatctgggaatgtctgtggcatttaccttttttggcactatacaaccttttttttttgcacttattaatttgggctaggtactgtcaactattacagatagcactgtacttctttacaaaacatagtgccatgaatttcaaagagttggcagtcagtaaacatctgctgaatgtttaattcttttttatttttattttattttagaaacaggatctctaaaaaacttctgtcacccagggtggagtgcagtggtacaatcatagctccttacagcctcaaactcctgggctcaaatgatcctcccatcttagcctccggaataggtaggagcacaggcagatcttttgtagaaacaaggtctcactttgctgcccaggctgatctcaaactcctggcttcaagcaatcatcctccttggtctctgtttaattcttttgactataaaacctgaatagcaaaggaggtgaatttgtctctcaagttctcggtacagttttccttatacccactgtccccagcactgagtaatcttagctctgtctgctcagggtccccaaattttgtggctctactgaggcctacctttttcaatctagttccgaaatttttattttattttttttttaatgaaaacctcccttccttgtactgatttttctaaaatcctggtttctttaagtaacaaatgggtcattggtaaatagtaggcagcagcaagacaaagtccaagtgtgtgaagtttaaagtgaaagaactggtttaaaatgctcactttgcccattagctctgtggtcccgagaaagtcatttaattctctgagcctgtttcatcacttacaaaatgtgaataacaacacttattcatagggttgtaataaggagtgggagatggtgttaggcataaaaccagcacagtgccctgaacctattttaacaaatggtatttccgaggtgttagtccatgccaacatgaaacgtgagtctaaggaagcttataaatactgtttctttttattacaaagattataattccagtataacaaaattcactggaagaaaaccatttaacacagcttattatctgttcaaaaaataaaagttcactgaacatttactctgtacaatcttcataaattgacaaaaatgcacagtatatctcaccacctaacacaggcctaaacaatgtgacatacggtatagtaccagtaggtacttaggactatggagaaacaatggaagacattaattctgcttgtcttgatggtaagggtggggatgaaaatacagatcgaatttgggggagcatgttaaggttaggggaatagagatagcttatatttagaacaagttagtagagactgtatgattttccaaatagagaagggtaaaaagacattccatagaggaagaaaattacatgcaaaaccacagagaccttagtttataaagagtaactgggtatggccgggtgcggtggctcacgcctgtaatcccggcactttgagaggctgaggagggttgatcatgaggtcaggagatcgagaccatcctggctaacacggtgaaacccgtctctactaaaaatacaaaaaattagctgggtgtggtggtggatgcctgcagtcccagctacttgggaggctgaggcaggagaatggtgtgaacccgggaggcggagcttgcagtgagccgagatcatgccaccgcactccagcctcagtgacagagcgagactccatctcaaaaaaaaaaaaaaaaaaaaaaaaaaaaaaggaattggacataagggatttgttactggagggattctcaggtattcgaggcaggtcagagaaggagaaagtgaaagttgtgaaggctacatgactctgctcaagtcatgcaactcagccaataagctgcactacctatatgtctgttaggtttctatgtaagagtgtaaatatataagctaagtatcccatgtttccattatgggtagtatatcatttattattaaccaaatcatttcataggctgtaagatgaaaggtactacagattctgcaagacactataaagaggaacttcagttggaaaagtaagtaatgtaaagtaattcctgtgcatttttttcctgattatgactttttatttaaagtcataaataaaagaattcttatggctataaaatttgcttacttatttatttcacaagtatttgctgagcagccaccccatgatagacactgtgtactatgctagaattctgcagtgaactagacatgggctttgtctggtacttgttatttaggagtgttgacagaatttacaaatacttaaataattgtcatagtagaagtgctacaaagaagcagagggtgctatgaatgtatgtaatgggaggaatttagactaggtagttagtaaaatatctctgaagaaattatttatgatggagacctaaaaaaccagaacagaacttagccagcacatgaataattaggtgtatccatatgttcatgggggagaaaatctgagaacgagagaaaggtcagtagagtcagaaagagctgaataccaaaaggaagttggttataattgaaagatggccagtgagttttcatgtcattagtgacagtgggaagacaaagcttattggtagggaccaaacaattgtaggaatttaataagaattttggactttatcctaagaggatggaaagttttaagaaggaaagtaatacaattcagatatgtaatccatatttgcttgtactttctctgtgtttgtctttcatgaatgcttcccaatgcttcattgatgcctcattgagtttttgatgaatacttctcattgcttctgcgaaatgatgttgaaacaaccctcacaaactatgtagagtctttgtacttcttcagccattgactgcctcttaaaaacaaccaagtgtttgacttgcaattttacctctctgaaaatacaaatcaccaccacccaaaaactgaacctccaaaaaagctttgtaaaaacttactgtcaagtcttcagagcatggctcaataatggtatacagggtatcaaagaagaaaggaagaagcctaatagggttaggtacagccaaccagctcttgttgaggggctacaaggtgctgggcatcatgatagacacttttatttttggaaagagtagcactaaattatttaagaggatttactttaacattcaattacatattcttattttcaggtagaaatttaatgataatgattttgaagaggcctttgtttactaaaataccttaattttaccacattcattataaattttactatattatttttataataaatgagttcaaattagagatcaggagaaataattaccatatttctaaatgtgacagttttcacattttatttttacacttttgatccttaaattatactctatgtgaccaacgagagacctttaaaattgatttggtctcatgcaaaattgttcatcaagtttaaatctgtcttttttttgaaagaaaacaaagtgtttcattttaagagtcagagaaaaataaagctaatgaaaatatatgtagtatattttgaaattttgaagaaaaaaaggtattgattatattccaatgtttggtttttagaattaaaagatagctcattgccaatatacttctttaacaacatcacataaattgtgttctctctctttgaataaaggtccttgctgttcccaaataaaagaagtaaagaaataacttttacatgctcaatttccctgagcaaagtatatcaaagaatcatagagtaaaatggatttgttacttgacttctctagttatttgtttattttgtttcattttttttgtagaaacagggtctcaccatgttcctcgggctagtctcaaactcctgggctcaagcaatcctcccacctaggccttccaaagtgttgtgattgcaggtgtgagccactgtgcctggatgtatttttctcatttaaaattaagacaagcctataaattcattatatgcacattttgaagccaaatttaaataccacaatgcccagaggtataaagaaacactttgcatctgctcaccatcctaataaattaatttttaatttaaatatatttgcaacaaaggtatatttgtggaaactgctttgcaattaggggctaaaaaaactttttgcaaacagttttattgttatttattattattgaaataatagattgttttcattatttagtaggttatacttaactagaaacattatataaggttaatattatatactaatttgattcttgattcctggaaagcggttgctaatttacatttatatatgcatagatataaatggtcactatatttacaatatttgtatatactatacttatatgtatatctttatatatattagattgataaatactagtctatttatattagattgataaatactagtctattttttatttgtatcattccttctaatacttcttcaaatatttactatcagttatacatctttatcatagataccattttatttatagttttttaatatgcttaagatacagaggaaactcatagatgtacatattttgctggtttatttattgttgttttttcttgagacagggttttcctctgtcacacaggtttgagtgtagtggcacaatcatagttctctgcagcctccaactcttggactcacatgatcctcccacctcagcctcctgagtaggtgggattacaggcatgtgccgccacactggttaaattttaaaacatttgtagagacagggtctcactatgttacccaaacttttggtctcaagcaatcctcctacctcagcctcccaaagtgctgggattacaggtgtgagtcacagcatcagcctattgaaaatatttttatttaacatttaattgaaatgattaaaaagaaaatttaaaataaatgtttaaataaatgccaaataaagaatatagaccttttttatcctttgatttatcttgtggaatttctgaaagagcatcagaattttgagtcaatgtatatttttagattaaatggtacttaacctctgagaaaaaaaaatcctaagccaagtgtaaattgcatagctttttcaaatgtaatacaagttccatgattagatttagtacaaaatcaagtttcaatttaaaagccagccgtaaatacacacatacaaaattgcatatgtattatctttaacggccttagaaacagctttcagatactatcaaagctttgaaaattctatttaacccaaaatgtctgctttggcctaaatgacatgttacaatattattctctctgtgtcctttttagcattctttatctcaccctgctaagaggtcatcatgttaatgcagtatctaaatatgtaacattttaccacaaaagcaattttacatgaaattaaaacagaaagaattaaagaaaaagttccatcaccatctcttttttaatgcttgtttacccaaccaatagtttcttgaaggtacagtttccttgaatctaatgatggcgaagtctaggtatttcaatgttgatcttgtaatcctctcttgccacctgtctcaattagtgacatggaagaaaaacatagactactgtgctcaatgaatagatacttacagattacaaatgcttgatacagaattctcatttacttgttcaccttttgagtgacaaatataccacttcattatcttacaaagtttatcaggaatacaaattcaggcttgtatagtaggaactatacagtcagatcaaaatgtgtgcataactgaaatatgcatgctgtatctgaaaatgttgcacttaaatcatcttttttgggaaatatgagattgtaattcatgtggacccactttgttatgtcatagatgtttaatttaaatggtgttttcctctctaatgtttctaaaatatgacaagttttctcatcctgattctctctctccaacataatttctgccacacaagtcattctatctggtatttaataagctaaaaataaatatagatgggtgttggtagctagtatttgaacaaactattcagtaaatcattttctaactcaaaataataagtactgtataaattatctatttattttgaaatatgtactcttcaatgtagggtttttctaaatcatgctatgcagcagacagcttagcccggacacagagttaaaagtacatgaggaagatatggaaaacagacacaaacataaaaaccatcccccacactgttggatttaattctggtcatgtgcttctaattgccagaggacaatgaaaaggaagcactaaagctagaagtaggctaaacgtaaatattttagaatttcatattaactctcaatggttgttcatccttactgaaaacagggaaggaatagatcaagacatggttacttgttgcaacttgaaactcattgtcaaacatcactcctgactttattgtaacaaaactgtgctaatgaagccaaagtctttggctgcagtaagattggcagtgttttgctgtctgagttgcagctttctctgccttcctacaaatgtttgtcattggtcagaagaggaatattcatgagaaagagaatgaaatagtatagatcctttactagcagtggaaaagtaatgcaaattttatgtcttacgaagagtagttgaaaagcaacatcctcagaagaatcccatacatatcctaataaaagaggatgacaattccatagcattataaaatgttaattattaactaaagacaaaggctatatttgaatttaaaaataggacattttctctggtagagaaaaataaactatttgcatgatttctccaaagtttttttaaaaaaaaatagaaatttttagatggcattatttcttgtacattcaaaaacagccatatagctctgccaaatatatataaaagcaaattatgtttttcaaatgtgttaccttttcataataacatgcatttgttattcattatctgagagaagttatcttttttaatctttttgcttcaaaaaactatactttctgactttttcaaagtcattgccttttactatcaataatagagtattaatgttatcttaaaaggcatctttatatattactttatttttattcatttattagaaataaaagacatgtataatgattaaaatttaaggtttctagactacagcataaggagttccaatgaattacgatattgtaactattccacatccatgcatcaactgttaaataaattcatctccttataatcttaatgtatactatttctaaaataatttgcacacaactaaattcaagccacagattaaaaattattacccgttatagcaatgactgaggataggtgttaacactcactatatgatctacatttcatagtatacttctttacacataattgacacattatagttatttgcttaaagttaatatataaaacagaaaataaatttaaaatgtaaaagctggtgggtcaggcacctttttagaagcactgagttattaagtgccagcagtagcaaagaagaccaatggaatgacaaaggagagaaagctcccaagaattctaatgagggtaaaaggtctaatagttcattcccattacttactacattttgccttgttttaaagagttcacaaagtgtaagacaatagcacaaaatctgtgatttttatgcctcgctgctttctattatatgtcttaaccttgtgatggtgataaaatacataataaataagttttagggcctttttctagccagcaatgtggttccttggtagttgaatgttaaacatagtaaactggatttctcttcccaaaaagaaatgcaagaactggaggtcagaagaaagctggcatgaaaggtgtttacagagataagcatcaagattgctgtaataaaagcgtcttgaaaagaatgcatttaaaagcatttcaacaaaatgtatctaacaaagattaaggaaagtatctacaaaacattaaaattatttaaaagtgcatcttcaattcaattgcaaaggctcacttttgctgtgttcttgaaatctcaggagacgtactagacaaggcattttagtgtactaaaaggaaacaatctttttctagtttaaggggaaaagggggaaattactataaagttgcaagagtagaggtggaaatggctggattgcaatcagtcatcagaagtagtgtaggaaacagaaatgaatggttccccaaattactatttggggtaaatattgcttttttctactctgtttctgtttcagtgtgttggctttgttctatctgcgcagctctctatgatattcaaaccacaagacaaaagatggctgtgtggtgatggcatttgagtagtcaagaacctaatagagaaactgaatgctattggtgacaattccaaatcctcatgggaagggattttgattgtcttattcccacatacctggcctgtgtgtgaggtcacactgaaataacatgactcacatgtttatctagacaatagttcatatatgaaattggggtctataatttaagacaaatactaattcatttgtccattcaacaaatatttaatgaatatttactatgtcttatcactgtcttagtcataaatgttgaatatgcagatagtgaataagataaatgaggtatcagggaaaattgtcacaattcatagaaattagagtggtttcatacaaaataaaacaaatgccaaagcaaaacactacgacctcactagctagagatgaaaatacggataaaaatcctttaaaaattaaagtaatttcttaagttcctaaagacagaaatgaatccagaatgaaatttaagatgactattgatcctctaaatacatcatttgggtcactcttagaggaaggaaactgtaaaaccattataagaaatttggtgcataaatgtagatgagaactatgtctataataggtatatacaaatttattatccactcatacaatttgaaacttataggaaataatggtaaaatcactatattttctttacatggactccacttactataatgtgttaatactggacagattacatattttggagagaagctactaagagcacaaataagccataatgtggttttaggaaggaatgaaattttatattaaatggagagctttgtagcatattcaaaggtataatttgaaataatgtatcatccaatacagtagtattatgaagattttggcaaatagtctctgctttcagggcccagtaagaaaagtaactactaatactgagctcaccaaaaaaacagacaatggggcatccagagtattctggttttttgtttgtttgtttgtttgtttttgagacggagtctcgctgtgttgcacaggctggagtgcagtggtgtgatctcagctcactgcagcctccacctcctggattctccttcctcagcctcccaagtacagatgcctgcaaccacacctaattaatttttgtatttttagtcgagacgaggtttcactatgttggccaggctggtctcaaactcctcaagtgatctgcccacctcagcctctcaaattgctgggattacaggcatgagcctccacacctggttaaagagtattctgttcttgaaccactccttgatcttactctttttaatctccattgactaccttatccaattacaaaatgttaacttgtcacttggatgctgatgtctcctaaatatctccaccatcgacgttctctacctctccagtggagtattctatttcacctgaaactttttcttcatcaacactatactatagattccctgggagtaggagtcacatgtgatttatttgcaatgtatattcctagtgtctaaaacagtacacactaagtacacatttattaactctgattcaggggcttccttctaagccttatactactcccattgaaatgcccttctcttacaacccactcacctcttgagtttctgttcattttctcaggatttaattcaagcactcctttgatgaaacttttcctgaatcctttagataacctagcatgcactccacccctaccattaacataggaccacaccttctttctgattctgggttcttatttgtgtcttagtaatgataatattttatatttatatatatatatatgtatataaactcatacatacacacaccccacatacaaacacatatatatcacatataaaacataatttatcatatatgtatatagatacacaaacacatatatgtaatatgcctatatatacacacatatacgtatacagtacttatatattacatatctgtcatcctcaacatgattgttgaagccaaggacaataaatgtcattgtttacttgggattgcagatatgttttctaaggattagaaaggtgtaatacataagtactgcatatgacatgaatgggtacatgtcataatataaatgattttttataaaaaagatatgtggaacaaaaaataagttagaaaacaaaaactaagtgctattagaattatctttaaatacatatattaaaataaagatatgcacatggattagtacaaagtttagatgaacttttagagatgctagttaggaaccaaaatttacttttgtaaaagaaacagcttactttttatccaggcagaaatcttgaccctccttatcttactttttccaaatctgttcattctaataatgtatcttactttttaattcaaaatggttcccaacacagtatagaccatatatcaaaaatatctacatgctactttcatattgctaaaggttaaatatggactaaagtctattttttatcattccatgctgttaccttacaagaccataagaattattataaaatatataaaaagacatttttatatattatttaatataatgactgtcatttacaatagtcacaactatttttgttgtcagtgaaatttagttccacgtacagaaaagtaaagcaaacataagaagaaaaacaaagatctttagattgcattttaaaatttttctattattccaatctaatagactgtttaaattatttcctttccctgcttcagaattcagctttctttgttagtttgtctattctataaagtcattgagtttcttgtcatatgttctaggatagcttgcatgtgctcccttctttgaacaacagctccctcaaaaagtaagttcttttgggccgggcgcggtggctcacgcctgtaatcccagcactttgggaggccgaggagggcggattgcctgagctcaggaggttgagaccatcctggctaacacagtgaaactcctgtctccactaaagcacaaaaaattagccgggcgtggcggcatgcgcctgtaatcccagctacctgggatactgaggcaggagaattgcttgaactcgtgaggcggaggttgcaatgagccgatatcacaccactgcgctccagccagggcgacagagcaagactccatctcacaaaacaaaacaaaacaaaacaaagaaaaaacaaaaaagtaagttcttttaaggccctctaattctatgattcagatatcctttactattttttataaacaaagacatcaaaattaaacatcataattattaaaatcttttgacacataacttacagaaacagagctctatcaatcaagtagagaataaggaaataccttcagttcatttgctttactagtccaactatgagagtcgttttaaaaatggatatcataagccacacagtgttatttatgttttgaggtggttcattttctgaggttgttaccaattttagacatatttagtacattgaaaatatttaaatatcactccttttcacgacttatctaagtatagaattattaacattatcatagatctctaaataatttactatccactaactggcttactatatcagtattcaaaacatttaacctaaatgtatacgaaagtgctcctaagaagtttgtaaaggttactgaaaacaagatcaaatgtattctagggaagctattatttaaaatgtatattagtaattcttatataagcataaattcttaattgtgcaaagaccacatccccatctcactttgtcaaaggccccttcaagttcagattttcccaaacatattccagttaaagcaaaacttaagaaactgtaagcattagcactaacagccagtttaacagagtatagatcaatgaaagcaaaaaataataataataatttccaaaaggactgattgtctgagcaacttcaagtatacatatacacatttgtgttcttgcacgtattgatctatgtaaatacttgtgatttcctatgagtctactttaaataatttgtaggttttcaaaaccagatgcttttctttccttttcttttctttttttttaataacagtgttagtctccttatgtgatataaaataatctaaaagtctgaagtggcagaaaagaggcagaaatggagacgactggctagagttatcaattgttatctgattggtcctctgactctcctagttcacagcttgtcagaaaaagatttgctagatgtcatgtactacatggtgacagaatcttttctcaatcttagggcaacagcaactgctttaaactcaggagcgtcagtcattatggctttgttactcttgttcttttcctgggtgcgtttcgctatctcttatcttttgcctatagtcacagtgcctgccaggcagaagagcaccccttccaggtatcagcacacaggtctgcctgtatgcatcatgacgccactgtccattcacaaagaagagaaagaaagccacagctttacccgcaggaaggagaggtcccggttgtgctcaatgctggttatctccaggttgcccatgacaacctcacagttttcatagtacttgcgcaaggctcggtactgctgttccaggtcagagagagagctcagtttattctccgttcctgcacacactgcaaagacaagaagatacacgtgaaattacataacctttatatgatatgcgcaatgataatatctttctcaaaactctctattccacaagcctatcccagttctctgaatataaatatttcgatcgtcattaagaggcatagacccacgcactgatgaacattttcacttttatattcccaaattacatgtgctaatcacagagagtaggaaggcatagattccacagaaatatatagcaaggagataaacttaatcccatttgttatgaccatataaagcaagtaaatacatttacttttatttaaacatttttttttttaggacatatgatttactctgttttctaattgggtaattctacaaatgtaaataaatcaaaatcaaaagatagtgaaagcaacaattttattttaaaatcatagttattatatcagctgttccagctgagtaaattttttactaaataaactagcacctacaagacctcaaacatgcgtttttatttttattttttaacttttattttaagttcaggggtacatacgcaggcttgtttacataggtaaacctgtggcatgggggttattcatacagattatttcatcacccagctattaagcctagaacccattagttatttttcctgatcctctccctcctcccaacttccattctccaataggccccagggtatgtttttctcctctatgtgtccatgtgttctcatcatttagctcccacttataaataagaactgcagtatttggttttctgttcctgctttagtttgctaaggataatagcttctagctccatccatgtctctccaaaggacatgatttcattcttctttatggctgcatagtattccatggtatatatgtaccagattttctttatccagtctattattgatgggcatttagggtgattccatgtcttttctattgggaatagtgctgcagtgagcataaacgtgcatgtgtcattgtaataaaatgatttatattcctttaggtatatacccagtaatgggattgctaggttgaatggtatttctgtctttaggtctaaactgaaatatttgtaaacatatactacaaaccagatatgtaaaaaatacaacttttattgttatcaactagagtatcactgtatatattcatgagtttctgaggtataatggactgataataaataatctgtctgccaagttctattcctatgtgagcacacaagtttacacaagtttttgttttgttttttaattttgtggctgggcatggtggctcacacctgttatcgcagcactttgggaggccgacgcagttggattacctgaggtcaggagttcccaacctagccaacatggagaaaccctgtctctaccaaaaatacaaaaattagctgggcgtggtagctcatgcctgtaatcccagctactcgggagcctgaggcaggagaataacttgaatctgggaggaggaggttgcagtgagccaagatcatgccactgcactcctagcctgagcaacagagtgagactctgtctcaaaaaaaaaaaaaaaaaaaaaaaaattgtgtgtgacttccagaagccagatttttagatactattcttatggtttatatacctgccagaacacaatcttcaccacttaatgtactgactctaatcctaagtagattaaaaatagatattataaatctattaataatggtatgtaaagaaaatggtttggtaagttacataagatatactgaatttaaggcaagatacaaagtggagactgcaaacatactaggaacacagcttagtaataaggtaatatatacattcatgtcttatatacacagaagtaaaaaagatgctatgatgcctgatgttgttttcaaagggatgagttcctgcagaggaaggaaaacacatctagatgggtatagcctaataattaggaccaccttaaagcctgtttttgcctatgaacacatcgaaaataacaaaaatcttaatccaaaaatcttgaaaaatagtgtatgtttgtaaccatagtggaaattcattataaaaacaaaatccaaacttttaaagtctggatttctaaagttcaccaaaaagtatattttctagaagtactctgttaccagctaaattgtgtgtcctaaaagacaagttgaagtcctaattcccattacttagaatgtgaccttacttggaaatagggtcttcctagatgtaaatcaaattaagatgaggtaggtcatttgggtgttccctaattcaatataatgataataagacaaacttgttcaacctgaagctatcaggccacatgtagcccaggatgacattgaatgtggcccaacacaaattcataaactttcttaaaacattatattttttgctgggtgcagcggctcatgcctgtaatcccagcactttgggaggccaaggtgggcggatcacgaggtcaggagatcgagaccatcctggtcaacacagtgaaaccccgtctcaactaaaaatacaaacaattagccgggcctggtggcgggtgcctgtagtcccagctactcgggaggctgaggcaggagaatggcatgaacccgggaggtggagcttgccgtgagccgagattgcgccactgcactccagcctgggcaacagagcgagactccatctcataaataaataaatatttaaaaaaacacattatgttttttgaatcagctattgttagtgtattttacgtgcaacccaagacaattcttttttcgatgtggaccagggaagccaaagattggacggccctgatataagaagaggaaaataccacgtgcacacaaagacaatcaggaaagaaagccccgtgaccagaaaggcaaagggtagagctatgtacctacaagccaaggaatgccaaagattgatggccaccaccagaagctagagagtggcaaggaagaattctacctggagtttcagagggagaatgagcctgctgtcaccttgattttcaacttctaacctccaggacagtgagagaataaatcgctattgttttaagccacccactctgtggtatgttgttactatttgtctctaaattccgcattaaataaatgttaaaaatcactttctctctctccagggtcctatcagcttataacctccatgctacacttccattgcttcctccaagccctttatacaccatgctggaattcatttattgcctttgagaatgcagattttgtagagtgatacggatggatgctatggtaaatacctctaaaatctttaatatccattttccaattccttcattgtaatagactgcacaatttttagctggacacatggtcacccaaaataaagattatatttctctcctccccttagaggtaagtttggccagtggactaagttctgacatgttgcatgacaccttcccagaacttggtttcaaacacggttgaagcctgactttgcctggtttattcttcataagttcttccagcctgatgccagaaatgcagatgtcatggctaaaatatgagccatcatcttggaccgtaagaatgagtgacacaccttagagatggctgagaactgagctaaaaggaagtaggattttcaagcaatagatattttacattgtcatattatcaataccatcaagataatgatgaatattggccccacctgctaaaatgttacacacagaaaggattaaattctagttgtgttatatgcttttgactttgagtaaatttaactattgtgcttggtttgactgaatttgctaaatatataatgaaattacagtatcattcctaaccataacgacattttattggctctgtggaatgttctcttattattaaaacaaacacccaggaagaaatgatattcaacataaggagaagaagaagaaaaagttgattcatgtgcatattccttataaatcaagatcgaagtccaagatatttttcattatatattaaaggcccttttggaaaaaaccttaatccatgatctttattttattgctcccagtaaatttatataaaatctttataaactaataaaatgactgttgagaaaaggtattattatatgggtttatgaaatatagattttaattatctcaaattccaatgaggatgaacatattttagtacaaccaattatggggataatataagcatccattaataaatttgctgcaccatttctaaagtatatccaataacacattgcaacctatatataatttatgttgtatagtttctctcaattggaaataatactcatactttaatattaatataaaaaatcaataggtaataatctaaatgaaaatgttctcaaaatagttggtgtattctgaccttttatatagaagcttaaacaacctttgagagatgcatctattactgtaactgcaatatctaggtatttttgcataattcccattctacatatataaaaaggtatacaatattatatccaatataatataatattatacaataatattcaaatctggatagttatatattcataagttctcattaatattcatttaaatatttgtatggtataaatacttaggattttgtttaaacttcttataatgaacatatgctaccctacattgcaataattcatttacttgatatcagaacatttataactcgtactcagaaaatggccctcaactaaaaaaaattgctattcctcaataaatgatcaggtaagttttgtatataccttcttaaaatggaaaatttgaataagtatgtttagaaatattttttgacaaaaaaagatcctccaaaaaacaaaattagattaatcacaatactctatttgccaaacattctagtctttgcagttttttttactacatgctgttcaatttagtagatatttttgtctcattgaggctttcatttatgtttgattcaaactatctagaatccacagtatattcatcataaattttatcttgaaagacacacttgatttttgaagaactggtttggataggctcatagaaatcatttgtagttgtttttgtggagcctccactgagtaactcacaactttcatttgtcaattgattttacaatcaagcaatgtatacaagacaacgcttaaaccatcaagtttcattgatttcacaaagctgtttatcaaaacacaattgaaaaattgtcttcagcagccaaaacaagtttaacaaaattcagccacctttgtcaatactattataaagtccttaaactataagcctacaatagttcaagcatcaaaaatccaaaatttacatgtgatccctaaagttttcattccaaatgtaactccaggagtaaagctggatgtgaggtcctaataaaatcctcaattattctatttgtattgattctgttacaaatgtagctatacttccaaacacaggctttttatttttcttaagatttatatccaacagcgtgtgaaccatataatcctcattcagtaaaaaagtaaaaagttggtagcaacataaaaaggttggttaacagtggattaatttgattcatggggaaatatattaaaagtaaaataatgaaaccttaacaatatctatattaaaactaaaaattaattatcgcctccaagcttgttctggctatgaaatcagcactctatttgcttacaaagaaaagatgatgggaattaaaaaaagagaattacctaactctcagatcaaatgcctattgcgagatatcagtttatcaattaagaaatgaataattatttatttggcatctactcgtctccaaatgtcatgaaaaaataattactgagaaaaatttccaagttgtttcataggggcttgtatagttttacaaggcacgtagcaaggaaagcagtgagcagtatatttaagtcatgtatatattgtgtgtgcataattcaaaggctggctacataaaatatggaacttgataaaaaattcttttgctgatttaacaccaataagtactttccttttcagaaatgttaataaatgcaccttggatttatgcatattgttgggcattaaaaaatctagcattgcagtaaacatcaaaatacaaaatattgaagaccacagaagaagcaataactatttccagtgactattaatgaatgctattatagttatgcagagatggcaagttttgttatctctatgttcaaaatacatccccaaatgggtccaaacttgtcacttccactgctatagtcatttaatccaaaacactgctatcccttccctggacttacacagcggcctcctaactaatgtccaggatttcctatttgccccattaattaattcgcaacccagagaacagaataatatttttaaaaatataaatcattcatgtcactaaaaacaccctttggcatctcattaaacttactgcaaaatccaaactctttagcttgtaagaatctgtagtcatcttttctcaaatgtcattctttcagaaaagccttctctgaccaccttatttaaataagtaccgggtttccaaacattgtgctctaccaggagacacaacagttattccattgaattggaagtgactgccgtgcagccactttgggctcctcattcctttgaatcaacaggcaaagaaaggaattgctaagctggctgggataattgatcctgaccactaaggatagtagcagattctatcaatattactactccacaatggaggtaataaggaagagtatgtctctaatacaggacattcctgtgggcgtctcttagtattaccatgcccagtgatgaaattcaatggaaaactacaaccacccaatcaaagcaggactagtacggtccagtgcattttgcaatgaatgtttgtgtcacctcaacaggtaaagaaccataaccaactgaggtgcttgctgaaggcaaagggagtatgaaatgggtagtagagaaaggtagttataaataccagctatgatcatgtgaccattgacagaaatgggtactgtaattgccataagtatttattccttattatgttatgaatacattttgtgtgtgggtgtgtctgtttcttttcctctcttatttccttatcatgaaacataagatgtattactttatgtcataatatttaagtattcttaattttacacaatagtatttaagttataggatatcaaggagaaaagcaaacatcaaaaaagacttcactttttcttctggggacaaagtgcatttttggttataggcataatagttgtaccatgttagatgaaatcatttaccttttattgtctttaattggagattaagtacagattaaggagatgcatatgggtgctatgctgacaagggatgggcctgtgatggttaattttatatgtcacttgattgggccacagcatgcccagaatgctggctaaacattatttctgagtgtatccataagggcgttttcacaaaagactaccattgaattggtatactgagtagagcacatggctctccccagtgtgggtgagtattatccaatctgttgcagtgcaggcacggatagaataaaaaggcagaggaaaatggaattttctctctgcctgactgcttgaactgtgacatagatctccagcccttggcactttaggttcttaagtcttcatatccaaactggaatctataccattgccactctaactctcaggcctttaaactacaccactagcttttttgggtctctagcttgcagatggcagattgtgagacttctcagcctccataattgtgtgagccaagactatatagtacattttaaataaatctctatgtgtgtgtgcgcgctatatatagcatatatgtgtgtgtgtatatatacttgtatatatatgctatctgtgcattccatggcccagacaaattgacatagaaaattaactatcataagcccatcccttgttaacgtggcacacatacacaacttcttaatctgtacttaatctccaaataaagaaaataacaggtcatacttccacctaacatgatacaactattgtatctacaacccaaaatgcactaactccttccttgggagagaaggtaaagtcctttcttcatgtttgctctttttgatatcctgtaacttaaaattttttggttctgtttctctggggaaccctgagaaacacatttatgtttattcattctccacacagaggccagaatgtttttttcaaaaatgtaaattgttcatgtcactcccctactgagaacaacccttggcttctaattgcactgactataaaatccaaagttcttatagcctataagaacttgtatttaagtatttgctcaaatgtcaccttttcaaaacagccttttctgaccaccttatctaaaatagacatcaggttcccatacattgtgttctgctttcttttcattttggtgttttttttttgttttgttttgtttttgtttttttttttgctatgtgaatttacattatacatctgcaagtttacctttttatgatatgtctccacattagaatgcaagcctcataagagaggcctttgctcagcacctcggaaagcaggcatatagcagatgttcagtaaacatcagtaaacaggcatagctgttcagtaaacatttgttaaataaatatatggacttcagagtcactgagaactagaatgaaaaaaaaaaaaggtaaagaatatacataaaggaaggccaggtgtggtggctcacgcctgaaatcccaacatttttggagactgaggccagaggattgcttcaggtcaggataccagcctaggtaacaaagtgggaccctttccctacaaaacctttttaaaaattaagaaaataaaaataaaagagaactagaatggagccagaatcaaacactggttcctccatttttaaaagctgaatgaacttgagcaaatcacttcatcactttgagtcttggtttccctgtctacaaagtaaggttttatgctgagtgttcttcataaatccagcttaactgttatgagcacaacatttctaggataatttttttcaattgatgggtaatagtcattcctatcttttttctaaccctcatggaaatgcttcccttaactcagcatacatttcatcatgttatatattctagaattctactttaaaactagggtttttatttcagacttgaatattgcaatttatcatatgcttttgcagttttgagaagtttttttttaatcttattagggtaaattattgataaattgcaattattaaaccatccttacattcttgaatgaatcatatacaatgatcatacattactctattagtataattctggattttattgctcttattcatttgtactggtatcttttaatataaaaaatttgtatcaatgttttaaaatatctttatcagatgtgattagggccaaaagagtttaaaaattgaaatgaatttatatttcagaaatttcatattctacataattaaatgtattaaagaaaaaactattagcaaaataggaaatgtgtttcataattttcattacataaaactagacataaaatatttttcagtgtaaaaattggtatccttttaaaaaaaatcctattatgtattatctgaatctttatcttctaccactgttttattgattcccaaagtgataaaacgtagactgctgaaattaactaaacactttctttttttttttttttttttttttttgagatggagtctggctctgtcgcccagactggagtgcagaggtgcaatctcggctcactgcaagctctgcctcccgggttcatgccattctcctgcctcagcctccccaggagctgggactacaggcgcccgccaccatgcctggctaattttttttgtatttttagtagggatgggggtttcaccgtgtcagctaggatggtctcgatctcctgacctcgtgatccgcctgcctcggcctcccaaagtgctgggattataggcgtgagccaccgcgcctggcctactaaacactttctaaacaatccttgagcctaatgaaaagaacttttggcattgtagacctttactaatagatttgtacctatggaagacataggtattcaataccacagacagatgaaagataaatcaatatattatatatactcctatctgctgatctatctaaaattgaattgatctgtactttacctcttttgttgattacaatagtctttgagagctctcaaaattcttaagtgcagctactatatagtgtgagggaaaataacctcataactgaaaactaaaaaaactgatgtacctcaaaattatacatgattgtcttctatgagtaatatggtttttgagtagtctaccttgatatagtcttcccaatataaacatttatctttgtaaatttttgtactttgtatttcaaagatgagcttggtaaaattaaaaaattgcaaatgatttttaatgtatcatatcaaataacaactaacttataactgcatatatatatattctgtctttattgtttccctgtcttcaaatattttttcttaatttttatttcataacatttctatgttgaaaataggaaaaacagaaaggctttacagatttagaaattacatttctgtcatctatacatacttggatgaaataataagatcacagaaatacaattgtcagaaatgtaatattccctttaccacattttgtcactattctctgcctgccctctttatccctccctcatacaaagtccttcttatttactttgtagtatttcatttcctgtgaaagtgctaggtccttaactttaatgtaggcactggacttgacaagcaattaaaacaaacaatttccactcatcaaggcttgccaaattagtcatctgccatctgccccatcatctggctctccttgaggtcttgctgtgaatctggatgcactttcacagattaagagggacagtgcaaacctccaagctggtaaaatgccagtgggagctaagtatgtaaacattagcaaacatctttcttctctagattatcatgccttcaaccatcccctcgtgtctaataaaaaccagcctgattgtgatgccttatcactgtgagacctttgccattcactgtaattaaagcggcagtgtgtgggatatttttcctgttaggagaatttacaagaaggaattagactagatgttcctaatatgatactatactcacatatcaaggtggatttcttaagcattgataaagatgtgcacattaagaaatggactatggcctttctcttgcattggtttcagagtgagacttcctttttcattcctttcatcagctaatgtttacttgactaataatatgcaataggcactatctagggtaaatgttcaatcagcttacactagaaacgggaaaaaatgagaaatagcaagagtgaaacattgtactattgtcaccccatgcttgtttataaggtctctcttccttcaaagcattctccaacccagggctactcttgggcaataggtaccttcatgcaaatgcactagggtggcactcttttaagtgaaacaaactccatgaggggcacatgacctggacatcacaatatacactgcattttatccccatctgttccctagtacatgagtatgcttgcagtggtgagcttgcataattgtaaacagaagctctggttcactccactgttccaagttatctgtccaaacttgctcattcagggtaaagttgtgtctaatttaacgacccttttaaaattaaaagaaaagtctgtgaatgttagacttggggtgagaagaaggggtgtggcaaacaacatttttgactgacagtctttactgttatcttcagatgatttacatataaagcctaatccaagatcaccttctaacaagttttcggggatgttttaaaacccaattcatagtcacattattctcttggataaaaaacaaaaagcacccacctgatactaatatagactagattataaaatatattattataatttattttaaattgttttcctgtgcccaaactctattattctagaaactagattctataatctccagtgggttggtctctctaaaacatttagatgagtagtgggttgttatttttacaagataatcatacttacaagtacagtcacaatcaactttcctttttttaacttttattttaagttccagggcacacatgcaggttttttacattggtaaacttgtgtcatgggggtttgttgtacagattatttcatcatccaggtattaagcttagtacacattagttattttttctgatcctctctctcctcccactctcacccaccaataggccccagtgtgtactgttcccctctgtgtgtccatgtgttctcatcattttgctcccacttataagtgagaacatgcagtacttggtttgctgttcctgtgttagtatgctagggataacggtctccagcttcatccatgtctctgccaaggacataatcttgttcttttttgtagctgcatagtattccatggtgtatatgtacattttctttatgcagtctattattaatgggcatttaggttgattccatgtatttgctattgtgaacaatactgcagtgaacatacacgtgcatgtgtctttataacagaatgatttatattcctctgggcatatacccagtaatgcgattgctggattaaatggtatttctgttttaggtctttaaggaatcaacacactgtcttccaaaatggttaaacaaatttatactcccaccaacagtgtataagcactcctcctgctgagcaccaaaagaaactatcaacagagtaaacaacacactttcaagtactaactgtaattgggtgtttgataaggagacagccaccactagagaaatatctgtcattcgtttattcgttctgtcacgtatttattcaataaatggttactggaaaacaatacatggtgctctgggttatctgtaaaaggaataataaatacaatctatgtcacagatttataacattttacattctaagataaatcctctgtagaatttttagaaataataatagtatacaaatttagttaagctgctaataaatatgaataattttatctgactttgattcactgctactgaataagacccacaatcaaagtcaaagttcattttacccacaataacatataaaacagagcccttctcgcctaccacacatacgaaatatacatcgttttgtataaaagttagacatcacttgtgagaagaaatttcctgggcataacagtagtcaatgatgttaccgatctactcagcagcatctacaatggaagaaatatcataccttatgctgtggtgtggatgtttgccccctccaaaacagattgaaacttaatccccaatggagcagtatcaagagtctgttaaaaattcagcctggcattctgtagccttcttgccatgtgataccctctgctgcctcaggacccttcagacagtctctaccaagcagaccctcaccagatgcagctccccattcttgaactttctagcctccagaattataaaaaaacacaattcttttctttataaattacccagtctcaggcattcagttatagcaacagaaaaaggagtaggataccttaacaaatgttttattcagttagccaggttagtgtatatcttttagtatatatttaactaggtcctcattcacttgtctaaaaggataaggaaaaattgctctgacacagaccggatacacacattattgaaaactattccatttcaggctgattttcaattaagtccccattctaaattacttaataacgatatgattgaacatgtcatgggtattgtttttagtcttttttcattttatttaattcagaaatttgatattatagttaatagctaatattactaccaagttccctactcacttcacactcctatgggtaagtaaatgggacttcagagatcacatggatagttacttaatttggagtgttttcccataaagtttcactaatctttggacttaaaaatctgatatcctattcgtgggctttattataatagagtagcatgttataatacaaaatctatgataagatattgaaagtaaaagtccaaccttttaatggaattcacatcattcactatgacacacaaagaagagccaaggtgacatttagcaaattttgtaagtattagagatgaactcagaaatgtcttctacatttaagagcaatatttaaaacaacacacacacacacgcacatgtgcacatacacatacatagggatacaatatttgctagtatacaatatttgcatttttatgctacagtgttaacacaaaaatgcattacaaagttccttaatttattttatcttagacaatttggcaataaaggtatcaaaaatataccactgagtgctaaaaatatctcatatcacactaacaataatagaagttctatagcatcaggttcaattttttaaaaagtagagaataattgatgatttttttccttatataagatatgactagtaacaagaaaaaatttttcaattgtacgttttaaattaatacttgcatagttatttttaaattaatgtgaatttctgagagtctaaattatatattttgtagctgataagcttcatatgtgcaaaacatattttctagcaggtaaatacaatttcaaactaaatcacttactgtttacatagagatacagatggaaaagaaaacacacactaacttctatttttaatcctgccacagcacgaatctgatcaatttttaaaatttgaagcacaccttttccgaacatgactcattttcagttcctgacacaaaaataatatgcactttatgataaattatataaataagtatcttttttattatagaattcaagtttctactgatattatttgccaggataaaatataatcaattagttgttacattctttgtaaatgttcatttcttttcagatgcatttaccacctgattataacttgtaaagaagacttaatgcaagtcaaataatgactatagaatctggttataaaatgtattaactgtttgagaaacaagatccatgcagttgcatcattttttattgttctggtctcaaaaactaaaataaaataaaataataacccttaaaacagtcaattctttgcaaagatactttttaagaatatatgggtttatgtaaatgcatatatacataaaaatattagctgggaagaaaaaacaataatatgttgcaaatggttttctctgatcaatagatttctgggtatgagacatataatatatatagtaatatctatatgtttatgtatctatagtaatatctatatatatttatatatatgttatatatatatacatatcatatatatttgtcctgtcatttctaaatttatactagttttaagtattgtaaatgtaaaaagtatatttcatttttaaaaatgttttttttttaattttaggaaagggtaaacagacaaacattctataatatgccatttctttatagaaatgtgtatgctaaccaaattactatcaatacttttgataattttgtaattttaatagaacattattttagataaaaatgtgaatttatttttgatgtaaacagttaagaaactttattttaaaatatctaaaataaaagtaaaaaagaatatattccttaaaaagttgagtgtaaactgatctactcatctataaagttgctctataaagttcaaaaacaaaccaatttcccacctgaatagactaggaaacatgagtgtgtgtgtgtgtgtgtgtgtgtgtgtgtgtgtgtgtgtgtagaggggagtatttaagttaataccataatttctgtgtatgctctaggttcttttctagttcatgcaatttgatatacaaaattgtataatattgtttctattttactaattatttatctcttctgatctcatattttaaattatattactaatgtctatatataactattatataactaacgtctataactacttgttttgaattatttaggttcaatagtagtatatttccgtcaagtaaaaatgccataaacaagatgaaatacttatatgctgaagacacattaccttttataaatttagaactacagcgttgtactcttaattgttatgcattatattagaagtccatgacagatgctatgggtgatagtcattaggtatttacaacacataaaaagaattttatagtacaatctcaatgagtaccaaccattttattaatgaagaaacttggctccctggttccctccatttgtgacccattcccttctcaatttttattccatactgtgtaaagaaaataggtgcaagtttctaaaaataacacttcttagaaatacaaataggcttcagtcaagtgagtgcatgtagaaagactgctccaacagtactatttttaagatagatttttttcttttttaaaaatagaaaaacatttctaaaagtttatccactccttccctccaatttccttcagcctccaatctcattttaataaatggcacccctttcactaactcaggcaaaaatctagtcagtcaactattctctctttccataacccagttataaaagccacaaaaccatatgcaaatccatcagctctttcttcagaatatctatcagctccaccttgctatctctatttcaagccacgaaagtccctatttgaatattgccatgtctttccatctgatgtccctgcttttcttcttgtcttcctcaagtatattttatatcagatataaaacaattttacatcttttaacctataaatcagatcactaatcttctttgctcaaatatctccaatggtttctcatatcaatcagaataaaattaaaagtccttatctagacctactacaaggcacttagaccatctatctgctacttttctgatatcatctcctaggatgtttcacttactcagatctggccacaggggccaccttacttgtctttgaacactgctataaaagtttcaaaatgctgattatcaatttatggatttatcttgtgtaccagtaacagactagcattgacctgtgtatgacactttgagtagcatcatttcaaaacattatattttttatcacttatcaccagctgccatattatatcttcatttaccatgtaagccctatgagggcaggaactctgttttgttcattactatatttatagcatttggaagtacttgacccatagtaggtactcaataaatatttaatgaatgaatggatggatggatggatggatggacgcataaatgaatgactgttgatattttggaattctggctagaattcctcattcattataacccaaatgttatttctgatgctcagaatgttaggaccagaaagatctttagagatcattaagtccagattatgcatatagatgagaaaacagcattcaagataagttaaagaactcagaaaaggtcaaacagttaaataaaggacacattatatatatatatataatattaaaatatatatataatatatataaatattatcctcaattatatagttatataactctaatatagaaatacagagaacatgaattctcaaacgttagagacagaaatggaatgagactcttcatttaggctatgttcacatggcacagtgcctcatgtgctgctgagagctttcatgaaactgtccacctttatggaaaggactcccaaacaaaatgttacgctgccagaagaaaaactgtattgtaaaacttggcagggtgcttaagaacatttggctaaacagcactagttgcctatgtaattggaaaatagatgtttaggaacatcttttttttttttcaagtcctggctgaagcaagttaaatgtgacttgttaaaaggaaactttttgaagagtcattttaacaaaagcatgtgtcatatgtatacagaagctaaccaatatcacatgataaacataatcctcaaaaattttcaaatcaaattacatatttcaagtcatattttagtgtactattgaaactttaaaaatatctcattgtgattattttgcaaacaatctttttgtaatggaaaaatcacctcataatttaactgttttgtcaattcagatttcaaagatcatgcttgcttaaatatattcacacctggagttgcacctaacaattgtatgccaatttactgtcagtgtattataatattaaattattgttatagctattattatggttaataataaagtgttgaataatttacaaagcagttttttcctgttaacttctttgatcctaaattacctaagagatggttataagagccaaaattattagaataattgccaggaattcaaattttgggtatcctgggaaaaaaaggaacttctgagaaatgttctaaaattcttcatgaattagcaacgaggtgatagaaattcccagaaatactagatagccttaccttggtatggctgtgactcacatagaaggaatactagaaatgggttaaataaaaacagattgattaagtttctatcccacagaaaaagtgggagtgaataatatcttcaatggactctactacaagcctcttccttttcgcactttgttccaatggaagttaattagatcggctggacatggtggctcatgcctgtaatcccagcactttgagaggccgaggcgggcggatcacaaggtcaggagttcgagactagcttggccaatatggtgaaagcccatctctactgaaaaaaatacaaaaattaaccatgtgtggtgacgcatgcctgtagtcccagctgcttgggaggctgaggcaggagaatcgcttgaacccaggtggcagagtttgcagtgagccaagatcacaccactgcattccggcctgggcgacagagtgagacttcatctcaaaaaaaaaaaaagaagaaacttaattagatctatgaaagtaaactagaaatagatcaggaatagaaaatggatttggctaccattgaaactgtggctgatttagtaagattgcacacagaattctgttggatgcatgctaactttttttcagtattgtgattttactttgaacgtgaattctcaaatgatatgtatactcacattaatacacgtatgaccctctttggcaattgtgttaaatattactaattcttcattaaccattgaatgaaattctagtcacctaactggtatttaagattttccataaatttagagatccgctacaatatcccttcacacttgatccaaagttattttttctggaaaatgttttaaaaataatcaaaacatagtttaaatatcatccaccattcaacttacccacaacttttcctatatttttaattcattcctttgaccttaccaagaatactttgaaagtatttgacaaaattaatatccaccattatcctcaactattgcctaaaggatttcattctttcagaaaagttctgaatcagttactcaatttacatttccctaaaatttatatgcaaggatttattatgtttctatttgcaaagttgttttattcttatgttccagtatatggatcttaattctccattagatgataaaccagctcatggagacctcaaattttgtttttatcatttctggctgggcaggccagatgtagttcttctatcgcataaaaagtattacagagatttgtacatgtaagcctagattagcttactgtaacccagctgagtagacagtataataaaattaagaggcaaaatttttaaaagatgttagactgaatatatcttaaaaccagaattttaaaaatataatttctaatcttagtatttgcctctgcgtgtttaacagttgatatctcacattcgtaaaccactttgggggaactaaaaaaagctttatgtgtaattgaatgtttactttgcagccttctacagaattaaggaatctgtgttttataagcttatgtcaaaacatttggagtatttctaactaaaatgtgagtacatacataaatgtttccattgcctttacatattaagtttaaaaattgtagttaaaacaaaaaaaatccatttgaaaatcaaatactagagaaagtttttaaagacagttttcgcaagccacagcactctgactcataaggcttggatagtatttttacttcccagacatagctagactagtggttgcataaatactattcattcacactatcagagcctccttttacctcatgattataccatcatattccccaatgactagtattttggtaccaattgttataaatttcagggttgtctagtataaaattagccctcttccagtatcaaaatatttcacatgccatcttagaataattaacttaccccagaaaagctaaagagaaagggagaaggcagttgttttaaatgaccttaagacttttctacatattgctattcagacttccagtgataaaacaagaaattgctataggcctttagacttaagagtcacccagtccactcactcttcatcttgctaagcaatgcaggtcacacctgagattcaacagctaagtgtacagccttggctgtgcccactcaacacggagtgaagcagccagcatgcagtaaaaaaaaaaaaaaaaaaaaaaaagccactggagttcattctgttgtactttctcatccttatcgtcttatttttttctctttgtcaatctgtttgagaactctttggtgtctattatctctcactttcctacccatccttcaaagcggctccccttctcatcaccactgtggaaaactctttcatttcatcctacccttgctcggacccagtgaacttacacccaatctatacttcctgtccccctaagggcccaaaggggatagtctacttatgcttcctggtgtgtctccactaaagagcctggttactcctccctttctcataaaagaggtctgacaaaagcctgcaatttcatttagttccatattatcctggcatcttgacattattgtttgactttgctgtggccagtatctccagctttcagcccaataatttagctgaggtaatgaattaaatatttagtgtttcagttatatgtttagattgggctcctcaataatgttaatgcccactatttctcttatcctgaatggtgacagactgcaaactgccttgctgggacttctattttctgttttattctgttctctgccttttgccgatgtcaccctgttttcagcctcaacattaaataaatagccaaatacacaagtgccaagaattgttgacaatataactctagaagcatatggtgctaagctagtagaaaaacaattcttagctcagtaagtattcttcatttgaaattgtgcactatttcttctccttctacttgaaaagtcagcaaacttgaggaccaagtgtcgcctggggatctaacttgcataaaacattgtgttggctctgaagcactgagattccatagcaaggccagcaatacataaactcctctggtactcctacattatttatccctgaacagctagggggctttttgcaaagacgtccctaactacggcaagcattcactctatttaatgtttatttaattaacagtgcacaaacaccaattctgtgagtgcagtggagtctgtgcacatctttagatttattttctcaattgatttggaaaggcagtagcagaatggtgccagacatttcttcccacccagttatcccttaacacccaagaatctctctatctaaaaaggcattggttaaaatagggtaaaactgatatggggacaagacagaagaaaggaatatctgggggaaaaagttggcagagagaagctctgttgtcattgttagacttttttttttttttttttttttgagacagggtctcactctgttgcccaggctgtcttgcagtggcaggatcttggttcactgcagcctccatctccggggttcaagtgatcctcccacctcagcctcctgagtagtggggtctacaggggcatgccaccatgcccagctaatttttttttttttttttttttttttttttgtagagatggggttttgccatttttcccaggctggtctcgaactcctgtgctcaagccatccacctgcctagcctccctaagtgtttggactacaggcgtgagtcatggtgccctgtctttacactttcaaaagaagaattacaatattattgtgaaataattgaatttcttcattatataaaatgtgaagatttaatccagcatcatttaagagttagataggatgatctgtaaggtcactgttattctaaaattctatgttcagaattacctagactagattgcctctaagtagcactcagaatgagacatcaactgtggatttttatatcctaaagcacacaggataaaactcagagatataaaatgaagcactcacaaactactatctaccacagtacataactctaaaaatctctgtaaacatatgagaaaggaaagaagcatcttctcagcagaattgaataaattgaggatgtatgtattgaaaatctactttagggtataagacttctcagaaataaaatcaaatccaataaaatcaaattttgttagtttgagaaacattgtaaagttttgttttgctgtcattatctgaagcctaccattaaccctccgtgaagaaactggctttctaaactgaggtaacataaagtttcttcatatttgcaattgtggggagttggaatccttatttttctcaagcctgtggtcccttttctgtgatttatccttctttctccatctttccatttctaagattggcctaataatcactgtaatatcagatgactaagttgtggatgcacactttttattgaattaccttttgtgcagactttgtgttaaattttgcatttattaatgaacaatatgttattagtaaacttatttaaaggttctattttattattccattcatcaccagggggcagcacaattcccaaagagtattttcttttttttttttattcagagtgaaaaagtacaatggcataattggtaccgatttctattgcagctagaggcatacacaggattattctacttttttatgcaatgaatatagactaaaaactagctggattcagaaaattgtatctacaaagaggaatatacttattagcagatacctcgcataattcaaaaaagaaggaaaaagtatcattaagtttgtgtgtttgtgtattatctctgaggtacaagaaaaataaaattattgttttctgaattcctttatggcacagaaaaacatataggatggcattatttccctttactatcttgggaaagaaacataagtaatacaaagccctaggtactttcaaagagctgaggatgaaagagatgggagaaatgtggagagatggagataaagggatatttcaaagatgagaaagacatggttggtttcctgaaagacttaatacatcaaagataccacagtttaagaatagtaaataaacaattatattttattttaaaataaaggactataaatcacgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaacatcacactctggggactgttgtggggtggggggaggggggagggatagcattgggagatatacctaatgctagatgacgagttagtgggtgcagcacaccagcatggcacatgtatacatatgtaactaacctgcacaatgtgcacatgtaccctaaaacttaaaatataataattaaaaaaaaattttaaaaaatttgattttctaaattcacatacatgagatttggaaaagtaatttatgatgaatttatctttcatgacattcctgtttataagcctccaattgctgcctggagtatcacctttaaaagttcacatacagtgacacagaactttcaaactatagtgctcgtcacatgtactcttttttaaaaaatgtgttggtttttatagatccataaaataaaatgggttataaagagttaaaagttgtagtaaattgaacatgaaaataaacaacttatgaaatcggataatatttgaaggcaacaagtctacaatattaccaaataaaaaagtattttgctaacttacaggaaggtagaaatagaaacagcggcacagtagcatatgcagttaaaatgtttcaaatatggtcttatttttaatgtgaaaaatgctcttatttagaaaaataaaacatgtacatatgcatacatacaacccttccattagccctgtttctccattaaataatgtctttcttttttcatcctcaaactgaattcattcattctttctttttcattcactaagcattgctttctgaactgattatgcacctgcccttaagatttctctattttgtggagtagaccgacatggcaacaaatgattctaacaaaattgaaatttgtgttttaagacaatacaaagtgtcatgggaataagaacatgcaagtcatagactataaaccccttgaggacagggaccatgtttatctcatcaggaacacttaactccagtatctaaaggaatcctaggcaagcagcaggcactcaacagatatttgttcatttataaaatacccatttttccagaatcagagtggaagacgaaacttgcaaaaccgggtattcatttcctaaggttattgtaataaagtgccataaactggtggcttagaaaagcagaaatttaccctctcacagttctgggggcaagaaatcctccaaaattaaagtgctggagacaatgctgcctctgaagcctctaagggaggatctttctttgcctctcccagtttctagtagccccaggcattccttggcttttggcaagataactccactttctacctccatctgcacatggtgttctccctgcatctctgtcttcacatgactctcttcctataaggacaccagtcatattggattaggagtttacctacttcagaataatttcattttccctaattacatgtacaacaacttatttccaaataaggtcacaatctacaatactagaggttagaacttcagcatatcttttacaggcacacattcgacctctaacaactaataacatgaatgttttcttctactcttttttccctcgatcctcctttgccttacttccttcccccaagatgagataattttgagaatccaatgggttaagaaacagtgtgctgaggaacacaggctgcagtttagactctcaccttttaagattatccattattttgccagactcattcttcttgtgcttggtttggctgtgcaaaattcctacaaattactctcatttataagaactgcttacattcatgcctaattatcatgcagtagaataacaattatgcatatcattaaattcatgtgagataaccttcaatgtaagtttcatttgattatggcactaaactctgttcatgcatgcttggccttcatagcaggttgctcaagaagaatggttgcctctgccacttaaaacataatgacagtaatactggccataaccctaaccttctccaacagaaatattggttccataactcggtacccaccttgcaaaaggttactgcaatcaagtctatgttaaatacaatcaatatttcatatattaaatatgaatgaaaatggaatattttatttaacataattaagctttctaatttgcttaaataaatgcatctgtctgcatcttttcccctcactaaaaatatacataggttaagagtataaaacatgtgatattattttttaacaaatatgttctaatctctttgttaagcattttagctgtagaattaaatatatatatttaatatatacattataggggtttaatatatatatcataggcatatagcaatatataagtgctttgtgttctgctttcacacatttttggagttacttttattcatttttaaagcatataatgtgacaatattatatcaaaccatcaatgttactgtatttatcatctaataggtacaaaaataccttgtcatgcactccatatatataaaacctcaattaaactcccccaagatttgagtgggaattttaaaattatatctaatttttaattataaaaataataaatatacatttcagaaaattttggaaatacaataaagtaaaaataaaaatggtccatggctgggcatggtggctcgcgcctgtaatcccagcactttgggaggccgaggcaggttgatcacttgaggtcaggagttcgagatcagcctggacaacatggagaaaccctgtctctactaaaaatacaaaaaccagctgggcatggtggcacatgctggtaatcccagctactcaagaggctgaggcacgagaatcgtttgaacctgggagacggaggttgcagtgagctgagattgcaccactgcactccagctaaaaaatatttttttaagatgggccataatcacatccaaaattgccacatttcacatttcataagaatactagtgttactagttttgcaagtcccaagttccactctttattctaggcaatcatgatcagttcattcaattatatctaattgggattctattttacaaaatattttgtagcataagttttacttcatcacattttcttttatagataagcatatttaatagatcataaggctctattgtttttttaaatatttaaatctgtttagaattctcagtttttataaaacatagttaagagttctggctctagaatcagagttcctgtggtcaaatcggtctccatcatctattacttttgtgatcttcggctaattattttactcctatttggtttcctttataaaagggagttattaataatgccttccagaattactgtgataattaaataaaatattctacataaagtagttgggcatatttaatgcctagcacatcccaggactctaatgaatattagctgtcaataatcaggtttgcagaatgtattattttctgctgccctcatttgttgactctcctcatcttcctctttctctttggactttccttctacaattcttctttgcgactctaccatagtcagccatttaaatatttgcttgtagaacttagtcccatttctcttaatctaaattttctccctggacattctcacctactccactgactttcattactttcttcatactgatgatccccatatttctatcttcagcccacatcattctttctgagcttttcacccatacatctaactgcctattgaatatctccactcataagtttaaaggcccttcaagtctaacaggttcaaaattaaagtcatccttttcccagaaggagcttctccacttgtgcttcctcattcagtgaatgaccaccaatagcacttagctactccaggaagaatgctgagttatgacatgatctggtcaacagaatgtacacagaagtaagagtgtgtagttctaagcctaggcattaagaggcatcacatgttccacagtttccacattttactgctgctaatctcacgggaacaggtcccagcaaaggtaagagacacttaaggaaaatgggcaatttgccctgactggagaagccaatctacagacatatgacaaagaataaaatcattgtctgaagttactgaattttgggattgtttgttatgcagcattactgtggataatgttaactgataggggaacctactaaaaatcttaagcttcatcgtcatttgcatcttctctataaatatggcatttcaaaaaataaatcttggcaaaataccaattttttctcatccaggttccctgtactttaaacccatattaactttccatagccaaaagtccttctgcccaaaggtaaaggagttgtttcacaaagtgagtaagaacacaagactgacaataggacaaagttctctactcctgcaagcttgccaaacagaatgcccagaaacatccttcagtggctacttactgactttaaataaactccatattctctgaaacacagaacatacacaatcatatgtaaataattgtgtctaagtaggacacttagacacattctgagacagagtacaataaatctcatggaaaggaaaatacagtgtgttatagccaacaccgcatattgttgttttatttctcttaaattcaaccataggttattacaaaagtaattgcgttttttgtcattgaaagtgatggcaaaaactgcaattacttttgtgctaacctaatattataatttgcacgcatgaatatgctacaaccatgtgacacagagcttttatgccttctaccatatattttgtggcactttctagttccagtgaagtttcattctaacatcatataggaattagaatgtgcgaatgttatatatgaaacctcacagactattctatcccagtaaaaatgctgttctatcccagttttttaaaaaaggcagattatgaaactgtaactattaacctcatagcaagaggttaagtacgtatggaaaatggttcactttaaaacacagtcatttgatatttaagaattatcagtgacctattgcttcaaatatctaacaatacctcgtatatgccccctaccccatacaacagctagaaaggaatctctttatgatattatttctagaacaatgactggcatttattaagcccagaaaaacattgatgggcaaatgaatgaatgaattctttcagcaactgcaattctactaagagttgtctcctctgtctttacaccaagttaaaagggaaataacttgtgtacagagaaggaagaaaatgattcacatggcttaaaggatatacacatattttaagctaaacaacaaactttgaccatgccagccctgccttaatatacaaggaaattattgatttttctataaattaaggaagctggggattttatctacaaatggcacacacacactggggaggtgtcctttggaataaaatttattttgataaaaacatatgtgcatagttttctgtaaatattactcacttgaatctatgtatcacagtatttaatatgctaggagtttaaaaactgacatgttaaaatagcacaaagacatgtctaggctagttactgttgagtggcacttagtgtggatttactcactgcaaaccgtccttgatatgccgcctgtctcttccctgcaagtggcagtgaaggtcagtgaatctaatttgacaataatgagcctgctctgcaatgtgttataatattgtgcctttatttctttttttaaaaggtatcaaccaatcaaaaagcctgttcaatgacatcagggaaaccccaggagagctggggagagttaaaaaacagtactctcttatttttcttttccaataatgaagacagcagaggttatgaacctgttcaatatgcattaaaacaaaacacagcctgataggaatgttttaattaataacaattatcttctgcagaattgtgattcaagccaggtctctgagcatgaaggagaaacttgacactggtgcttctttgtggacagagagattttaagcaaagttaatggaaactcagcggatgaatggtgccgcaattcaaatgtactgtaaaattactgaaatgatttcaatgtcacaggactacactgcattacatttatgattattaccacttgctacgctttagtgatattttgtcaaatgttttatttaaagcttgtcttaagaaaaaagtctgtctttcagagaaaaatgttgatgcgacaaataataactcataattatttacccacacaaaatattctatgcacattttaaatactgtatgtataacatatatttatttaaataataattattataaaaaagttcaaaagttggaatgttgacacaaggataatgatctaatagtcatatcccacaccccaatgtctttgcaaatcttattctatattctaagcttttatttctcaaaagatgattctagaacaagatttatgagaatcacatttcaggtatatgtttaaaatatatattctctggccccgccccagaccttctgagtcagcatcttctgggggtggaggcggcacccataattctgcattttaacaagttctccaaataattatcatgcatactgtaacccaagaagcgagaggttcttaaacggcgaccacagaattcaggggtccgtgagcttgagatgggaaaaaaatacaccttcattttcactgaactctgattgaaatttatcattcccatcagttatgaatgtagctgacaaatcagagtagttttagatatctgtgtgtcatcaataaataatcacagatattttcctatattacagttgaagctattgcaaaatattattgacattgatggctactttgaaattatattagttattaaatttcctgctagagcttttaattaattataaaaagaacacatatattacaatatcagaaaaaaattttaatgatatttcaacaaatgtgtttcaatataactggcttcctttgtaatctcatgcattttatttgatgtatttttaaatatgtttctggatggggcccacaggcttcaccagacaagcataagggtctgtgacacacacaaagtcaagaacccctgtctcagctctcctgggtcttgtactcattcagagggagaaggaaagagtagaaagagctaaatgaaagctgtgtctctgaatcaaataaaccttccctgacatttcctctgaaaggacatatatgtgggagcgtaaagaaaagtggcttataaaattccaatgtgtttaaaagtgggggaaaaaaaggaaaggaaagcaggaacagaaacacctgtcagtcatgaatgacttattgacccagttcatcagcaggggagctgaatttgatcagttctgccatgattagtgtcactacagtcaagtgtaatttctgtataaatagaagtggtggataggaaaataattcggttcatccctccaaattgtatcagtcagcacagacatcaaaaattgtcagcccgaggcggggaagcacgcatacccaaccaagcctataattgtattcagtattcaaatattttaaaccacaatatgatcttcaacataagacaaggaaaaatcactgttgattgtgcatccttctgaactgttgaaacagcatttctgtatttttcattgtcttttttggtaaaagtgagcaaatataagttcttgtatttgtcactttttcagtaacaggatattttcctttcaaacttgcctgtcttctagttccttagcttagtgtatgaacctccatccaatcagttgtccaagacagagacacactggcctcctttctctccttcatcaaatagatcactaagtcctgttgcttctatctccctaatatccgtgaaagtaattcacttcccgtaggcccactgctactaggttagttcagaccatcattattttagctagaattacaggaatggactcctaactggtctcctgtgcttaaaccctgtttgtctccaaacttttctccatatgttcatcaaaataatttattaaatgcatgtcttgatgtcattcccctgcaaaaacatgtctatggaattccacagctcttagactacataccatacttcttaaaatggcatatcagaccttcaggacctggtttacatctctggctttagcactacccctcacactacagacttcacatatactgacgttttccccagcatttctgggccatggcacatgctttccctctgactagaatgatctatttgcatgactaacctcagctgatgtctcttgtgggatgttatccctggcacctctaagtggggtgagatggcctctctgagtgtgggcctagtattcaatacttaccctttttattgtatttattagatcagactgtatttgcatgtttgttgttgaattaattgaattaaccagcaggatttatgtcactacaacatagttattgtacttaatctgagattaaacccaggatagttctttttgaaagcattttatatttacttacagcaaaatcatttttaggtattgtaaacatattactgttcaaaggaaaaaaagactgggtttttttgaaaccagtaagaaaattaattctgtatctgatgtctatctaatatttctcattacaaactaaaactatgctttagtaagttaagaataagaagcttgtttatgaagtttatcaattgataagtcttattcagtagaataaatccacatgtatagaaactttgtttagtgcctggcacaaaatagggctcaggaaatattcgtttaatgaatgaatgaatacatgactatcttctacttaagccagagctcttcctaagtctttggactagtaggcacttagactggaggtaagaagaccagaggggaaagaagcctgctcttaacagtcttgacactgttgtcagtgaaactaaatacacaaatctgattctgtcaccatgttgcctatacaactgagataggctcctctgaactacaggacaaatagtataatccttgggataaattaataatagtgataataaaagtaatatttgccgaacacttactgagtctggtccctgtgctaagtgttttgcatttgtctcactgaatcctttgaacaaattaggaagcaaacaatattatatccattttgcagacaagaaaagcaagattaagcaacttgcccaaagtcacatggatagcaaatgcaaaaatagaagtgaaccacaaatggtcagatgagcacacatgctgaagctttttactatataaatcatgaaacatttagttccaacctatctcactagctaccaacttgtgaaatgcccatctcttgacctcactgtttcctaatccccaaagtcccaccacactatactggaaatacttaaaatgaaccacgttcttataagacctctgtgaagtgcacatattacttcctttaccaaaagttccctaccccttctcatctacccaaaagtccctatctatccatcttttaatttcaatatcttatatctcctactctgaagagatatctctgactcgctcaaaaagataatctttttggacctcattatattttgtaccaaattattaatgactttattaagtaatcatgtctctctgggccactcacatccccaataaataaacagtgtattctctaaggaaagagacaatgtgcaattcacttttgtgtccaccacgagctagcccaagtccacaactcagcagaggctcattaaatatctgtcaatatgagatgaaggatgtgtgttttgagggagggtttgcttaggaatgatgatatgacaagaataagaaatgcctgtcaaaaagctaagaatgtaagagagagcaagatatgcaaagggtagatacaatattatagcatacagagtggaatgagaatattaatgtaggggaaaactagagatcaggactatatcactatttgatcattaaataatattgataatgttcttaataaagagtctacatgatgagtaaatcattgaaatgtggtcgatatgttgtttttgagtaggcaggtaagaagaatgcaccttggaaggtttttcatcttggaaagtttacgaaagagtaaaaatcagtcaataagagaattaagtatttattccacaaacacatggacttagaaacactttgctgagccacttgcagatcctgatcctcagaaactgtgagatcataagtgtttgctgttttaaggtagtaaaccgtggtgtgtgtttttgttttttttttttttttggatagaaacagatagctaatacagaccagaatcatatataattccgtgactttgttatctttcaagtatttccttattattgatgcctacactttctcaatgtctaaaatggacaactaaattgctactgtggatttacttcttaactaaaacagattttacattcgtataatgtagatttacatatgtattacttatacatttaaaataattagaagttcatatattttcaacaaaaaggaactcatctaaatgccagcctgggttgcataatgtggacctcatgctgtgggagttgctgctttcccaagttgggtatgacaggctagttgcaattacataaatgaattgttttctttcatcctcactggtgcattaatgaaagcctgcacaattaaaaaaaagaccacactgcttgaagaaagcaaggcaaccagtttaaattagtagatgaaattaaaatcattttactagtactattttccaatccagcaattgctgacactgttctgaaatgctacgtacatccatattcaaggatcttacatacctagagccaaacttatcattaaaaatgtgataaatggctaatatacttttcttaattactctataaaactgacaaactgaaaatgtacacaatattggaaaaggaaaaacattatttttagggttagtctaagtccaaaaacttaacttggcctcctttctttacaacaggtttctcaagacaaatccatggcaagcccaaatgcgttgtcttcaaactattcagtttctctcctcttgtcattaatcatcctattctccggctaaacccctattcttgattttagcataaccctttcctcagaagggtgaatatttcttatgaactttgggttcaacttacgcaggtaagacaagaaccaattagtgtcacagtaagcataaggaaccctggattggatgcttcaggcttgtccccttgcttgcaggagcctgtatgatagctgtaaactcagaaaggtaaccactaaggaagagagaggtggccagtgcctatttaaaaataaaaagtgaagaaattatttataatcaagtggctcataattgtccctataccacactcacttttattatttcctggtaaagagggtgaactctatccacaagtcctccatagttaaataaaacctttttttaaaatctgtatcacacacacaaaaagtcttataaatgtatatcagtgtgaatgaaaacaatgaaaaataaaatggctgttttctatgtcccattgtctctatgcccacatttttatgacgcagtcatggtgtggttacagtttagtattctatatgttcctcttagaagaagagggatgtgcatccaatgccaaattctactgaaaattcatgtgtctaggtcttagcgcttttctttttttagagaatttaactcttcatgaattctgttaatcaaattacttggctggctatttcctaccaaagcctaaggctccctgacacctgatgatctcttcttaattgatactttcacctttgtgagatatccgcacaaatgtagctctcactgagggtaggttggggaaggggaagcgcttgatctcagaagccattatgactgtgtgtatatttgaaagtacaaactcaaaagacaggtaacaaattgccaaagaagcactgcaaatgataacaaagtagagtgaaataaaattagaaagaaaaatatgcatcactgaaaagtgatatgtttaatatcccataaatattcataaatatgtcatctccacaagcttataatgctagagttttagcattaaaagatggaaggctgcttaaaataggagcacaaataacaataacaactcaaaaagtctttaatcttcatcagccacacaattgagatcagatcaaaatatatctgtacagtctctttcactcatctatcctcatatttaatattcattgagtacaaagaagtttctatgtaatttcctttattaatacttcactatgaagtgtccccatactaacataattaactttactagaaattattaccacacccatctgcctaaattttcaattatctttgcctctagacatgagtagctaccttgtgaaatgatatcaggataattccttcatattcataatgcctccttttctcccataggttgatgcagatataatgattaaaatgaaagagcaggaaaagttttctgctaaactctaaaaccttttgtattaggagtttatgtcttaagcctttctacctcaaaggcttcatattgttaaaaatctacagttcttaaaggatcaacttctactcctttttcatcaactatcttttagataaggaaaagacaacttatatttaaagtaaattttgaatgaaattataaggaaagtgcttattatttaccatctggcagtacactagtcctttgagttatatgaccatatatagtataagaattcaaaatacatgaacaaaaccactactaaatcttaacatttggtaagaagtgtaacgtggtgataaaaatattctcctatgaattgggactaatttttatcataacatatatgatctaaaaattccttattaatctttgcttccatttttcatcagttcataaatgacaataaatagcaagtgatggtgaaaatccagagcaagtagcactgttatatattgtgagaatataaagtgttgcaattactttgggaaataatagtctactaatttcacataaacccaaatactacatctcttctataacccagcaattctacttcttggtatttactcaagaaagtgaaacctatgtacacaaaagacatatgcaacaatattcatagcacattataaataacagcctaggtataaatcaaagggaaaattaacaaataaattataatatattcatgcaatgcaatactacttaggaatgaaaaggagcaaattactcatacatgcaccaacatagataaaccttaaaaacattatctttgaaaaagtcttatatacaagtatatagtgtatgatttgaattcaaataaaattctagaacaggcaaaattaatcttggtccaaaaaattaaaatagtgtttatcttgagaagtgagggagacacactggtgagggacatgagggaactttgtaggtgacatgatgtctatatcttgataagtatttgcactacacaattgcatgtatttgataaaacatagtgaatatgcacttaagatttgtacaataaattgtatataaattttacgtcaaaagaaaatgctgtaatcagatactgaactttatttagtagtatgcaagctaatgtatttctacatttctgatttctgcaattcatgttttaatgtacaaaaaatgaaacaggataatggttagagggcaataatgaggagaaatgtgatagcacaagtacaataaaatgtaatggttaaagctaaatgatggatatattgtttcaagtttgctctgtttagtaagtttcacaataaaatgctggggtaaattgcaatctgatttaccttctaatcttatgaattaaggaattaatacttttgaaattcaggtaaacaattttatagtaacagcaaagcagctcttaagtagttctcttggtcttctcaaaagatttctttttgtgtcttttgggtagcatttgagaacaggaatgccaaacttttttactcacatcagcattcttcttcaatttcaaactaggtaataattcagtttctctccttctgttggactctcagaataagagaatctcttatctatgagaaaaaaatcctaaccaattttatggcatgttttttgctttgtaccttcctgtccatcaaatttaatatcaatatgctaagaaacaaatgagccctaaatgctacctatctgtgtgtgtatgtatatatactttctaatctttcatgttatttccttcttaggtttcccatcacccaaaactgtgtttttccaaggttttcttttcacaggatatgacaattgaaaaaacataaatgatataaaggcactattcattaataagggtgaaggaactaaacaaaacattgttttccattaatttaacccagtcagtgctgcaaagcctagagccatttgctggtgttctaaaggagtctgcaactaaactcttgatctaacacataaagaattgacgtttacttttaaaaatcttagaacaggtaatgagaattctattgattagtctgtaataaactgataatggctcttagaataatgaataatttttactgagtcatgtcagctaatataatttcaggtggcacatgaaaaaattgaagcaattcagcattgtgcctttcctgtcactggagttctaccattaaaagccagttatacaaataagattatggtgcttttatatagcttgtgcctttccagatcagtattaatgccatatttttagaaaagaccttttgtgcatgacatactgatcaattttttgtttttgtttgagggagggtctcactgtgtctcccaggctggagtgtagtgatgcaatcacagctcactgcagcctcaacctcctgggttcaagcaattctcctgtcttggccttccaagtagctgagactacaggtatataccaccatgctagctattttttaaattatttttattttttgtaaagatggggtcaccctatgttgcccaggctgggtttcaagctcctgggctcaagtgatcttcctgtatcagactcccaaagtgctgggatgataggtgtgagccatcttgcctggcctgaacaatttttgatatcaaataggctgatgttagacatataacaaaggttaaagttagacacatatagcgctgcactgtccaatacagtagccactagccacatgtgaatttgacatatggctagtctgaattgatatgtgctattaagtataagatatacatatatcagatttcaaagacgtatgatatttttaaaaaaacaacaaaatataaagtatcgaaaacaacattttaatattttagacatatttaatccaagtatattactaaactaattttatctgctcattatttttaatgtggctagtaaaaaacttaaaattagatttgtggccttcatatttctaatgaaagtgctaatgtagaggtttctcacctggcaaaaataattttatatttaaatacaatgtatccttaactttgaaatactgtacaaacaaaaaaggggggaaggaaaaaagatgtgactaaatatgactccattttgggaaaataaataaataaatattatttcttcctgctgttaagcgtctatctatccatcagataggtctgatgcaattcctcattttgatttttaggtaaataatcccttttttctttcatctcagacaatttgaaaaatattgaaaaatggttttctgcctattttcaacctcttgtcatttctttaaagaagaattaaacttgatgaagttctaatttttgataaaatttaattttgccttgatcattttgaataaagaacctgcatccattttgcttgtgcttgagtgtgtatactattatttaagtgatgtaatctactattaagaactacttgcccttatggacaaacttgactttgaagaaatttttctttttcgcatttttaattgtcaagtaacttcaaagaaaacatgaagaaaataaaagaccatttttttaattaactgtggttagtcaaacatgctgcggtcgactttgtccatcccctcactaacatccgtccctcctgtcttgttccttcatcacccacctgaattttcctatttcattcctaataaaagaacctttatttggtcaggtaatcagctaggattaagatgaaactggttcaatgagtcatgcaagttgcgagtgggattctttctttacttagagtttttggtatcttattcatcatgaattttttaatatcaatgtcattttttaaattttttgcattaatatatatatatatttactgagatttttggcacccccgtaaattctacatcagaggcaaatgtctcactcacttcaccataatcccagccctgagggtaatgaaaaaatctctgatttgcagagagggtaaatcctttcatataccccaaaggataaatagtgactgatctcaacaaatcagggagatgtcattcctctggccagtgagatagaagaagtgggctgttcataatagcttctaagaaagcttttttcttttcttttcctttttcctgataaaataccacagaattggctgacacatccttaaaatttatttcatccttcccgcatctttataccatcaatgtggacatcacattgaatgtgcagcaaccatagaaatattaaaaggaaattttctaaagtcatccatgagcaactgcaccagccctggactgcacaccttttaactgcttgttagtggaaaacataaacaatttttgggttaaacttctgtagttggattctctgttacataaaacagaacacaatgccaactgtcacatatgaacaaactaaattcttctattattttaaactaattttttttcataacactttaatttttgctttaatcaaaaactgtatttgcaaaatagtaactatgttacaacaatatgtactgataacatagatctattgttttggtgacataattcttatttacattttagaaagttgtgctctgataacatcacaatcatttttttttcaaattctatttagtcctgccccaaatttagtttggttcaacaaatattggctaagcagctactctcctttagacactaaataaactattttaaagaaaatagacacagtccctgacctttggcatcttacagatcagttctgatccatctttgatattacactcagctttattattagggatcttattttaccagtctggaaatcactgaggatatgcttcttctcactacagatttagatgagaatatttcaaactaatatggttggaaattcatttggttgactgtgctgctgaaatgaatacaataacctatttgtttagtattttacattaacaaaacacttctacaaaattgtctcattttgcaggacacaaacaaatggaaaaacattctatcctcatggataggaagaatcggtctcatgaaaatggttatactgcccaaagtaatttttagattcattgacattcccatcaaactaccattgacattcttcacagaattagaaaaaaaaaaaactattttaaatttcatatggaatcaaagaagaccccgtacagccaagacaaccctaagcaaaaagaacaaaacgggaggcatcacgctacctgacttcaaactatgctacaaggctacagtaaccaaaatgcatgatactggtaccaaaacagacatatagaccaatggagcagaacagaggcctcagaaataacaccacacatctacaaccatctgatcttcgacaaatctcacaaaaacaagaaatggggagatgatctcctattccataaatggtgctgggaaaactggctagccatctgcagaaaactgaaaccggacctcttccttacaccttatacaaaaattaactcaagatggattgaagacttaaatgtaaaaccccaaaccataaaaaccctagaagaaaaccttggcaataccattcaggacataggtatgggcaaagacttaatgacaaaaacaccaaaagcaattgaaacagaagccaaaattgacaaatgggatctaattaaactcaagagtttccgcacagcaaaagaaactatcatcagagtgaacaggcaacctacagaatgagagaaaatttgtaccatctacccatctgacaaaggtctaatatccagaatttacaaggaacttaaacaaatttacaagaaaaaaacaaccccatcaaaaagtgggcaaaggatatgaacagacacttctcaaaagaagatatttacgtggccaacaaacatatgaaaaaaagctcaacatcactgatcattagagaaatgcaaatcaaaaccacaatgagataatatcccatgccactcagaatgccaattattaaaaagtccagaaacaatacatgatggtgaggttgtggggaaataggaacacttttacactgttgatgggaatataaattaattctaactattatggaagacagtatggctattcctcaaggatttagaaccagaaataccatttgacccagcaatcccattactgagtatatacccaaaggattataaatcattctactgtaaagatgcatgcatgcgtatgtttactgcagcattatttacaataacaaagtcatggaaccaacacaaatgcccatcaatgatagactggataaagaaaatgtggtacatatacaccatggaatactatgcagccataaaaaagatgagataatgtcctttgcagggacatgaatgaagctggaagtcatcatcctcagcaaactaatacaggaacagaaaaccaaacaccacatgttctcactcataagtgggagttgcaaaatgaaaacacacggacacaggaagggaaacaacacacaccagggcctgttggggtgtggggaatgaggggagggaacttagaggatgggtcaataggtgcagcaaaccaccatggcacacgtatacctatgtaacaaacttgcacgttctgcatatgtatccaggaactgaaattaaaattaaaaaaaaaaaaaaacttgtctcatttcccttttaaatctctattgttggaaaaactggtgaaaatcaagtctttaaaattacttctacttaagcagcagccacttaaactgttttcttttttataaatgaaatctttcctttttgcattcctaaattcctgggggaatacactggagtaattttaggcttgattttttcaagagtaaaggaaaagaaatatttcctctttgcagatttaaatgagtttcgtatacagtgtgttctatgaaatgaatgccaatttgttttcattagaattattcttcttgcatgacatctcttttcttcaatgatgcttatttatgtactgggcagtgttagacatgcatgcatgcactctttcttcaagagacagtttctaatggagggcaccatgctaagagctgtgggagagaaagacatacatttcataattccagattcttaaggaccttaaaatccagtaggtaaaattagatatatcagcaaattaggatacgagtaccctgtggagggaaaattaacgcaatagatgaagaaaaacaaaaactagcttcaacagggcttatcccagaaggcttcatgtagcacatgacatttgaaccaggtttgacaaatggctaggatttcaggaaaaatagtgaaaaataaaggacattcaggtaagagaaaactgcaaagcacagaaatgatcaagtggacttgtgctgctaatgaggcccatgcctgaagcacagaatctttgtaaagaatgatagagttgaggttggaattacagtaatgtaacctaaatgtcagactaaaggttttgtattttcatcaaatagaagtacctaaagattttagacctcaactaccatcatatgtgacaaaataaaatgagataaacaattttacctataaatagataaagtatttaaattctgatgctattcagtgatggtaaagacgtgaggaataaggtatagtcatttatacttggagaatatgcaaatcattgctttcattttgaaatgaaatttattatctaaaagactttaagttcacatactgtttgacctaggacttccaatttttgaaatttattctatagaaatgttggtatgagtacgtaaagaaatatgtacaaaaatatttattttaataaagatacattcctcacaaagaagaaaaatcttgcctacttatcaacagaaaattgaattagtaaagtataggaaatccatatagtataataatattcagatttaaaaaaataagtttatacatacacttacaaccatttgattttggacaaacctgacaaaaacaagcaatgggggaaggattctctatttaatgaatgatgctgggagaactagctagccatatgcagaaaatcgaaactggatttcttcctaacaccatatacaaaaatcaactcaagacagattaaagacttaaatgtaaaatctaaaactataaaaattctagaaggaaacttaggcaataccattcaggacatagatgcaggcaaagatttcatgactgaaatggtttggctctgtgttaccatcaaaatctcatctcaaattgtaatctccataattcccgacatctcaagggaaggaccaggtgggaggtgattggatcatggcggtgattttccccatgctgttcttgtcatagtaagtgacttctcatgagatctgatgatttatcaagagtttgatggtttctccttcacacagctctctctcacctgctgccatgtaagacttgcctcttctccttcctccatgattgtaggtttcctgaggcctcatcggccatgtggagctgtgagtcaattaaacctcttttctttataaattacccagtctcaggtatgtctttatagcagtgtgaaatggactaaaacagtaaattggtactaggagagaggtactgctataaagataccaaaaaatgtggaagtgactttggaactgggtaatgggcagaggttggaacaatttggagggcccaaaagaatacaggaaactatggaaaagtttggaacttcatagagacttgttgaatggtttttggccaaaatgctgacaatgatatgaacaatgaagtccaggctgaggtggtctcagatggagatgaggaatttattgggaacaagagcaaatatcactcttgatatgctttagcaaagagactggtggcattttgcccctgccctagagatgtggaaaactttgaacttgagagatttgatctgaaattggaacttatgtttaaaaaggaagcagagtataaaagtttggaaaatttgcagcctgatgatgcaatagaaaagagaaacccattttctggggagaaagtcaatccagctgcagaaatttgcttaaataacaaggagccaaatgtcaatggccaagacaatggggaaaatgtctccagggcatttcagagatgttggtggcagcccctcccatcacaggcacgtaggccaaggaggaaaaaatggtttagcaggctgggccccaggccttgcagttttgggacttgggtgcctgtcttgggacttggtgccctgtgtcccagctatggttaaaaggtgccaatatactcaggccattgcttggtcattgcccgagccttggtgacttcacatggtgttgggtctgcaggcacatggaagtcaagaattgaggtttgggaacctctgcctcgatttcagaggatgtatggaaacacctggatgtccaggcagaagtttgcttcacaggtagagacctcatggagaacctctgctagggcagtgtgaaagggaaatgtgaaattggaccccctcacagattccccaccagggcactgcctagtggagctgtaagaagagggccaccatcctccaggcccaagaatgatagatccaccaacagcttgcactgtgcacctggaaaagctgcacactcaacaccagactgtgaaagcagccaggagggggaatatgacctgcaaagccacaggagaggagctgcccaatttcatggaagcccacttcttacctcagcatgacgtggatgtgagacatggggtcaaaggagattatttaggagctttaaaatttaatgactgccctgctggatttcagacttgcatggggcctgtatcccctatgttttggccaatttctcccatttggaatgggaacacttatccaatgcccatacccccattgtatcttggaagtaactaacttgttttttttttaattattttacaggcttataggcagagtacttgccttgtctcagatgaaactttggacttggacttttgtattaatgctggaatgaattaagactccaggggactctttggaaggcatgattggttctgaaatgtaaaacggatgtgaaatatttggaaggggcaaggggcagaatgatatggtttggctctgggccccaacaagtctcatctcaaattgtaatccccataatccccacatattgaaggagggaccaggttgaaggtgattggatcatgtaggtgtcttcccccatgctgttcttataatagtgagctagttctcatgagatatgatggttttataagggtttgatggttactcctttacatagttctcttgcctgctgccacgtaagacacgcctcttcgccttccaccatgattgtaagtttcctgaggcctacccagtcatgaggaactgtgggtcaattaaacctcttttattacccagtctcagatatgtctttatagcactgtgaaaacagaccaatacaatgattaagtcaccaaaagcaattgcaacaaaagcaaaaagtgacaaacagaatctaattaaactaaagagcttctgcacagccaaagaaactatcaacagattaaacagccaacctacagaatgggagaaaatttttgcaatctgtccatctgacaaaggtgtgatacctagcatctctaaggaatttaaacaaattacaagaaaaacacaaccccccaaaaaagtgagcaaaggacatgaacaaatacttctcaaaaaagatatacatgcagccaacaaacatgaaaaaaagctcaatatcactgatcattagagaaatgcaagtcaaaactgtaatgagatacgatctcataccagtcagaatggccattactaaaaagtcaaaaaacaacagatgctgccaaggttgtggagaaaaaggaatgttttttttactgttggtagaagtgtaaattagttctaccattgtggaaaacactgtggtgattcctcaaagacctagaggcagaaataccgtttgactcaccaatcccattactgggaatatacccaaaggactataaattgttctattatgaagacacatgcatgcgtatgttcattgcagcactgttcacaatagcaaagacatggaatcaacccacatttccatcaattgcagattagataaagaaaatgtacatatacatttgtatatgtgtatatacaccatggaatactatgcagccataaaaaggaaggagaccatattttttccaggaatatggatggagctggaggccatgttccttagcaaattaatacaggaactgaaaacaaaatatcacgtgttctcacttataagtgggagctaaatgatgagaacacatggacaaatgggggtggaaaaactcacactggggcttgtgggagggttttggtgggaaaagggagggggtcaggaagaatagctaatggaagctgggcttaatacctgggtgatgcgatgatttgtgcagtaaaccattatggcacacgtttacccatgtaacaaacttctatatcctgcacatgtatccctgaacttagttggaaattttaaaaacaatggaaatgtaaaaaataggtctatagttactaatgcacaatgaaagtcaatgtatattattatgtgggaaatatccagttgcagaatcatatgtagaatatgggttcattttgaaaagttaaaaaacaaaggtctttatctacattaatttcttaaaaaacttaattgatctcttattataccagacatggttctgtatgccagtgaaaccacagagaacaaaacacaaatccctatgtttgtggattttgtattcaagaaagaaaataaaataattacaaattaggattaatcaccaggacacaaaaagaataggatagggacatactatgttagataaggtatacaggtgactactctgaaaaggcaacatacaacagaaacagaaagaagtaagccctgcagctagggaagagtaccccaggctgagggagtagcaaaggcaaaggccttgaagcattatccaggaacaaagagaaggtcagcctgaagggcccagtgaaccagtggaaaggtggtgggaaattgaggtctgttattacccaggaaaatttactgactgtggctagagctccctaaaacaataggaaatacctggtatataacgatatctactgtgtaccaggagatttcactgaatgcatgcacaacaccccttccccaacagaagcaattttgctttattgtcaggaaatgaatccttaaaccacttgacttctagcagagtgttgatcttattgtgactgacatataggcaaatcctcagaagagaatcagaatttccctgagctggatgaaaggaggtcagagggagcagatagagagaacaatgtcgtttgcacatggacaagtctgtttgaaatctcttgcatacagccaaagagataaaagaaaaggactacaaagtattgagccagtacagtgaaggttaaatatgagctcctactgctatgatttatccactgaaacagctgggaaacttccgaagtagttcatatatcacagaagtagaggaagtgagtctgactgtataaacacacctcagggctgctactgttcccattaactgtctgtctcagtaaaggtctgccattagacagattcctgctgcagctgaactgatagaaaactgcaggtacatataaaaattagagggagacgtatgtcaagaacagtcatgaaaaatttttcaggggaaaggagaaaaaggagttctatgatgtgactgttttaaaatctgacatttttggattttcatactctctacatttatgatttttcagcttaatgctatattcatggtttcagttaattatggcagatgtttattaaatatgtgcagtcatcaatttctatagcctatctgatgactgttttgagaactttctctaaattcctcttacaatcaacagggaaaaggactgaggctacaagttaagatacatacattaaatgctatttcagaatagcatcaaacttctaaggaccaatttatatgaaatgtgacaaattacccaatatggacttgcacttcctttcagttgagaaaacaaaagcatgatgtgttcaaatgtgttattccttctaggatgattcctctttgaagatccatgctactcattctacttgattaaaacagaaccaaagaccacatttgtggacatatttctgcttgaagcagttcatctttacacagggacttattgtttggtgaaatatgaggaagctagtttgttcatacatttaatctagtaataattttgatgtctatcatgagtacaactttcagttttttcttatcttggatgggaaaaaggagtattataaacaggacctcaattcccaacaccgctctcttaaagaatttaaattgctgctgttgactaaggataaattaaaaaatcatggcattgcatacacaattttataattcgatctaagtctactatttacaggttcatctcttgccattctacctaattcatcccaaactacagttatatcaaactggtctggtctaacatttcccaaggcaaactcctggtttttgcctatatggcttttcctctgccgtttctttcaagaatgcctattttctttgtctgaacgtttcttattctttcatcaagatctggtgtaaaagtcaccatatcatctctaaaactttcttctaatttcagagacagaattactattttcttactttcaactccagaaacaaggtcctttcacgtttatgttaacatatcaccagcagtcaggatagtatctagcagataaaaagcaggcaataaatgttgaatgaatgaagctcacttcttttaattcagacaataggcacatagtctagaactatacaataccaaaggcttattgagacagctaaatcctctttcctctttatgtcactgtttctctctgctttcctttctccctccttctgtgtgtgtttttgtgtgatgtgagggtagtcatggttagaaaacaatctgacttatcattaccatgtactagattttctatcattaagaaggcaagaacagagaatttaaataactttcaaaatatttgggtcccaaaacagataattttcgcgctatgtctaatactacctcaactacctggaacaaagctaagcagaatatgtatttttttttttttttctggtaggatggagtaagtaaagagagaatgacatcatggatttacttttattaagcttccaagatttattcttagtttggaggatctgaaattaaatattttacctctccaagtacatcatagaataaaattgaggctcataataaacattctcaccatatttcattgttaaagcctttctggcagttccagggtacttagagatcatctataagtaaatcccttcttcttctttcttgtcacaatgctgaaccccagagaagtaaagtgaatggtttgaggtcacccagcagctaagaccaattgcaagtcaaaacacaaagtttcctcatcaccagttcttatcattttataaagttgcctctatcaacaaattgctaacaaattgcttttgttcttaacagaacacttcatttccctacttaaaatcatgcaatagtttccagttttactaagtttagagtacaaactcctcagtagaatttcagggcatgttcatgatctagtctttgattatagctctaacctcaggctaacccttgctgtgcttgcattctatgctttggtttctatcttaaacctctgtcctctaaagatagaagctgttataaccaaatgtttatgtcctccccaccccaattcagatgttgaagccctaatccccaaagtgatggtatttcagggtggagtctttgggaagtaaataggtttagatgaggtaatgagggtgaggctctcaagataggattaatgtccttacaggagaaaaagaccagagcttactcactctccaccctgtagacacgcagcaagaagctagctatctgcaagccagggagagggacttcattaagaacctgaccatgttagcaccctgctctttgacttcttggcctcaagaactttaggaaataaatgtatgttgtttaagccacccagtatatgttattttattatagcagcctgagcagattaagaagcaaaatattatgtctccctttttcacctacctaatgctgattcatccttctgtttttaccttatttacacttattctaggaaatcttccgtaaagctccaagtctggaatcaatgactttattaggtgtccctataatattgaacatctccttttataatgtgtatgtcagtgtattatgttgatccatctacgtgtatgtatacttcgaccaaactacaggctccatggaagtaagaactccatctgctttgctcagcattatattctgagcattatcatagaggctagcatatggcaggtactcatgaagttatgaagatctttgagataagcatattcttaaactaaaataattcttttttctttatatacaaatgaaattaaagtagagaaagagagaggaatttcagtattactttatgaagcaacatcttcaaaaaaaattaaatgaaaatacccataagtattgtgattaatatgattatttcatttgtaatcatcatattaagtgctcaagttttcagatttgtattgtcagtctatttacaactaccacttaagaattatagaatttttttgtaaggtaaaaaaatgtaaataaggatcatctaatggattgttaattatactatatatatataaaatccctatggtgttctcattttttaaaatttgcaatatttttttccaacaatttcttagcggttgtgcctattacactgtaaacccactaagaactatgcatcaaatcaaataattaaattgaaatttatactttttaatatttcagctgaatttagatctgcctagcaaatttagtacaacaataataattctgaaataatctgaactttcaaagtatatagcagctttctagctttctttttatattcaatgctatttgagtgccaacttagggtaatgcaggagatataaaccatcccctactctctactcctttttcccttaatacaagctcatgctgaaggttcactttttaaaaacatttttcaagaagcttatcaattatatagacttcacaatacaccagctgttcattcattctttcattcacaaatgtgccggcactatgctggatgtgagggagacagttgtgagcaaatcatatcatatgttcttagacatactctggaaagacggatccatattagttacactaatgaagtttaattgccacttgagataagtagtctatgagaatgtttaacaaggaaagctttgctcaattaggccagaagagggggtcatggaggataaagcacttaagctaagttctgaatgatgaaatcaagttaaaaaggcaaagagtgtttgtgagtgtttgtgagtgtgagtgtgtgtgtgtgtgtgtgtgttgggaagagggttgttcatggaggaatgtttcaaacagtgtaaaacagtatgtgcaaatggtctgtggctaaagagggaatggaacagtccagagaagggtaaaaagtggtgatagataaggccgaaatataagaggatgcttaagaaatatcaagggtcttattgtctatgttaaagattcagccttaccttaaaaacaatgataagtcactgaaggctgttaagtaggggtgtggaaggtgatataatcatatatcaatttgtcaatagtaaaaagattgctgtaacccatattggaggatgtttaaggttttattttggaaaagcaattaagaggacactaaaggatttcagacaagagatgatgttagggcaagatgatgatgccctaaaaatgagagttatgtaaagaaggaggaaagtggagagatttacaagatactgaaaatgtaaaatggacaagacttgatgatgaatcaaatatatctgggggcattagagtgagaggtgtcaatcataaccactaggtttcagtaacttttataatttatttcatcctcttaaatacatatgtattagaggtagtactgaaaaccctaaactcaaatatccctaagcttcatgggtaaaaatatatatcatgaaattcattttaaagataaagtaagactttaacatcctagtatggcggaatgaccactaaactttaaactttcattctggtcaccatttacatatcaagattgatagtcagagatttgaagataagagcaggtaatttatatttgtttgttcgctttatgatggaagactctcctccatcgccaaaacattacaataatttaaaaatacataaaaaatcctcttgcttagaaaaaaaattatagtctagataaaggtattgcaaactgaatattggcttttccatagaaaacttactgtaagagttaaatatctgaatcaagatttaattctaatctttttatagaaatggctagaaataccacaatcaaatatacaattaatatataaaagtaatactatatctttttagcagtgtctcttaaattacattgaaatgaatgaaacttttactaaacatcatatttgatttggtaagacatagaatcattatactggagtatgtaaagctcctatgtcttttgaaagaaataaatctaaagacaaaatatcagggttgtgaaatcaaaaagcctgttttgacattgttgagtaaagttcaggggagatagagagctacctgatgactcttcgaggaggacattacttttgttattttcattttctcatttagaaattcctcctgcatacacagtccaatccagaaaacattgagagcttttttttttttgtatgactatactaagcactgagagtactccaaacaaatagtaaagaataggctatagttcttaggtttaagaatggtatattctaaaactagtaagagaaaaaacagggacatactgaaagaacagggtagataaattctaggagagaggaataacaaagagctatattaacacggagtagaaaagattaccatgggttgttgggtgtgagaattagagatcatgttgctcaccctttagctgcatttgtgcccagattaacttcctcaaaagtgaatgatgatttattttaatttgtaaactgctgtttacaagtgctaatatgaatgtaactgtggatcattttaagccaagttgctataaatcatagatgatagatatttgagctagaaagctcctctccaaggaaaatgtaccaattataaacacactttatgatgaaatatttcattaagttgatcctattgaattactgggaatggtctcccaaatcttcatacatttctcacattatttatttttcatgatattgagaaaagcctttacaaagtgaagctaatggcacatgtgtgaggagaatgtgaataatagatgataaaaaataaatctctggcatctagaaaactggcctattggggtacaattatttgatgcatattatcataaaaattttatgtctaaaaaatggtaatataaagccatgcagatccttttgaaagagaattgtgataattgccgttgcatgccaaaataattggttttgctgatcaaaaacttttccattaggtaccaaaatgtaacatctgccagtgatataatggaccaataattgaagcacatagtatatcctcataggggctacactgctgttttatttattcttgcccaactgtgaagataaacttcactaaatacatgtgatatcctgtcaattcgggataagcatatttttttcttggacagatagctggtaagtgaaacacctggatcaccccagagctgcaaaattacaatcatagcggatatatgatgtcagaaacaagtccacttagacagactaaaaacattcaaatatgcagaggcaataactcctctccctttccagtttagctgtaagctaacattgtttcatttgcctttaagatcactctattccaacatgacaggtttatatttataggtcaccccattacagatttcttattctgtctgaaactttattaatcagaaacaaagcattatgctgaatcgggtatttgcaatggaagattcaacttaaaatacggaatttctatcctctaggacattttctctaatgtcaccaatttctcaactcagtattcaaacagtgcagatttattatttcctaacaacacacttttcatttagaaacgtatatttctaattatatcatctgcctcatttgcaaattcaactgtatgtttcctaagattctttgattacactcttggggacatttagtgaatgtttactgacaagtagttatggccagttaaataatcatgccctctatagttgcacttctgtacagtaattccattatactaattactagtacttaactcctagtagtgcttttattttatgatctagagtctgttctaggtatctcccatgtaataagccatttaatgctaacaactgttgatgatatcagaattgtttttatttcaattctatagataactgagaccccagatggttaaacaacttgcttaaggtcatgtagtcactaagtgtagacccataaccagagcctagggagtctttctccagatcacctgcctttgaccactcttcatcactgttttcctataacttgatgtgatttatgataaactttaaaccttggttttatattaatcttttctatttttcagatgtttagctttatacacatcaaatagccatcacagagattttttgttgttgttgggctgccaatattgaatatgtggtatataagatacataatacatatttatgtgtgaatatgtacgtacatatttctgattggttgccacaccacagaattaaataacatacagtattatgtaaaatgcagatctttatcacttactcttgaaaacctataaataatttcaatatgaaaattttattgactctgaattacaacacatattactaataatcatatacatatgtttatcacacagattttcagcttatattacagtcctgcactcattcagcagaaatcttctgcttttactgcaatgcgtagcagttatgcttcatgactgacaattatgtcatataaaaaataagtcacaattaataaaaatcaaaactaatatgtgctacaattatttaatgatttaataaactaggagagggttttatgaaaagacttatacaaacaagagacccaatttccaattagaatcaacacttaaaattcttcaagttcctaagagtgaggcaacacctaatcagtttgttcttcacatatccctctacccacaaaggggcagttactttcaaagaaaaacacggttaaaatatctgttccctccacatgggttagaaatacttttgtgagataactgatacactacaaaaaatgctgcaagtgtaagatcagaaattatttgtgtggtaaccttaccacatttggatatcaggactataattatagattcacaaggaaaaataaattaacttaataactaaaatagcccttaaatgaatagatgtatcataataatagttaacattccccaagatttcactacatgccaggaatgttctaaattcctaacatctatgagttcatttaatccaaatactaacactatgaagttaatactattattatttccattttaatgatgatgaaataagtacaaagaagctaaataacttgtcccaggtcatttgcaaatcactggggatggtattgaacccaactggtatcccacaagaacctgcactcttaatcacaattcttgacagtttttttgatccatcttatttataaacaattagcttatttcaaattttgcactatttcaaataatgttataataagcatgccagtacccacacctttttgagcttgtcctagtatttttagagtaaacttcctagggatgtaaatgctgaatcaaaggacatgaacattcatcactgtcaggtttgtaggtgaaaaatgatgctctgaactgttgtttttatttgcattttttattagtgagcatattttatttcagtggtgtcttagaaccagctcatgcaggttttgattatttcttcccacccgactccaccttcaataaaatgaagttggtagcttgaaattaaacataggtgggagttttcacagctttgaaatcagcacagtataaaaattagacttgctttgtttgttttgttttgttttgctttggagagttgcttaaatgttcaccttcacaggccattatgtttctgctatgaatagactactcatcttctttgctcaggtaaaagttgggttgaggtttttttttattgatttttaagatgaatattttaacctaataaattataaacaagaggaaaaattttgttattaattctagtaatcatgattttggtcacacaacttagccatttgttcaaaaataatatagataaaacccaaagtgaaaaaggttatgagtttcaatttagaatctgctataaaatttaaataattattaggtctccttaagttaaaacgatgttttaagtttgacttaccttattttaaaataaatgtatgtatataatctatgccttttagaaatgctataagatagaggttggtgaatacaccctaaagctctgaagtaccatagacacttgaggttgtagtaataaaaaataaaaaagaaaacacttgagattgcaattttactatcataaaactttaaacttctatggattttatatgctaatgccaatgttgaagcattagaaacagagggctgaaccatgggtagtctagacaatttgctatataaatttaactagcaggtaacttcatagttactgattttcaaacaatagcaatgttcctggaactgcatataactagtaaaaactgtttcagttaaaaatcaatgatgagatatcactaaattagtggacataaaagaaatagggtttaaactgtattcttcaaacaacatttatcttgaattttgaaaggaatgtaattgttatcattttcatataccttttaactttctattcaaatacactgaaatactgcactatggagaagtttttttgctacactttcagttaatttataaaagtagactatacaagatgtatagtccattgtactaacatgaaagaacatttttcaggacaaagaaattaaaattgtttcaacaggaaaatctgccaaaccaagtgaccatgaaattcatttacacataattttactattgctggtcaagaacaatcagaaaataagctattcttcatctatttttccaaagatatttttacagattaactacaagagaaaggtctattctttttcattttgaatttgtgatttaagaacctgacacttttgaaaaatgccttattactgctttaagcatgctctgttcccattctgttttcaaaatcattaaatcatatttatgaagtgaccatacacatcactagcaattttgataactgcttttctcctgccttaggtcattagttggactgaatgttttaaagtgaaataaaacattttatgcgtcacagagtaagaaatggactgaatcaaggggctgtggttcttggtgttctctgctgtagcctggggctaattcccattttcaaaactttgcttaaatctcgatccttccctgaaatgacctggacctcttttccccaccaaatcttaacctaatcatgttctaagaccctgccgaaaaccctgtgttcttgaatatttcaactgttattaatcacccccttctcaccttgactccaagtactcaaaggtatacgacaccctttaatacttatatatataaggctctgaattggttgattttgttttagggtcatttaattaacaaatgatcaattctattaatagtaggcagggattatgcttatatatctttctaatagtcctaatcacctacctggcaccttcaagtacagtcaaacacttacatctggccctagcacattttggagcatctagtaaatactcactaagagctcaatagattgaataaaagtaaacaaaatgtctttgtgttcgtttgtttttgtttattttacctactatgcaatttcattgcagttacaaaaatattacaattttaggtagatttggaaataataataaaaatgtagcatagagtaaaaattgatattcaaaatccaaaacatttttatgaatgcctccaagaatcagttcatttggctttcttaaatagaggtcaggttaatttcacaagaaaataagtattttttttcttagattctagtctcctggcttctttgcaagctgacaaaatattaggattaacaaggaccaatctagtgcaccttcacccacggtcctctgttcataacacatatacacaccacgcatatgaacatccatgtccattagatatcacagttacttttttttcttttttttttttcttttgagacagagtctcactctgttgcccaggctggaatgtagtggcacaatcttggctcactgcaacctacgcttccctggttaaagtggttctgatgcctgtgcctcccgagtatctgggattacaggtgcacaccaccacattcagctaagtttttgtatttttagtacagacaaggttttgccatgttgaccaggctggtctcaaactcctggcctcaattgatctgctggaattggcctcccaaaatgctgggattagaggtgtgaaccaccacacccagccaacacagttatttgttcttggggtatgtgcttggtagacctcagaaaaagaaaaaaaaaaggctcatctgcttggaatcacttgaagattacagttttaactatgggtttcaattattttgatattcagaaatcacgtgcaattaaaatataaataaccctcaaagagattatttttaaaaatctgttaacacgtaagtacttcagatctttcctagagtgtcagtaagctcagaataacttgtagtggtcatggtcactgcggtgggatgcttagggagaagagatcttaagtagggtccacattataaattcctgggaatataggaccattctagggagattggtttctcagactttagaggaataataagtaatgatggaatttgggagaagtctggcccaaagaggacataatagaatctaaaagtaaaatgtctcagttgtagtgtaggtatgggggacagggaggggaagaaagtttaatttacaaattacaagcatactttggaaaagtttcatttctcttcatgcacataaagtacatatttcaatattatagaattttttccattgttctaaaaatgcaaatacataaaaatttcttaggcagttgtctaatgaatgtttaaacagtaaagttaattatcctacaacttaaagtaatttgtatttgatcaaaacagctacgttagcattgaattcaaacgtttgcttacaagaaatacattgtttttaattgtctgtcacctaacaaaacccaaggcattttgaagtaaaataaatttgtatctcccatatagatttttttaattacgtttcgactaaatgagaaagacaggattggaaagtgcctccagaggtcatttagtccatttccacttctggcaaacttcgcctaaatcatttcaaacatatggctaactaccttgtgccatctttgttaagcaatctccgttcttggctgcccacattaatgatgtgtgtgcctacaaactggtttaagtgttctgtgtgatttagctagtcaagagtgtctgataatctgtctagtcagcaagatatctctcagttaaatcagtctaactgaaaatgtgttcattaaacttggctaattttttatttacttcactggtaaatacaattaaaacactcaatcaagtgtagatgtcagagacaaccagtaaatcaggatcttccttaatctaactaaattgttcccgacctgattttaaccaaattttactcaacctacccaccctggagcaaaagactgtcaaactatgttcctgttcctaaacgtcttcaataagtcttcttttctctgccacttttgcaggcaaataaactaaagagtcaaagaatgaaacagggatcagaatgagccaaccaaatttataaggaaacccaaagagaggtttgttttattttttttaaatgaacatactcaacaatattcaaaagactaatactgaaagatagaagtatgcagcgataaaatacgtcaacatgtttgctattttctctatattatagcagttatttctaaaaataagaatttcagactatctccaccattattttcttttcatattcctctgaaggtaatgaactaagttttaaatttgcctactttttgaagtagaacacttctcccttaaaatcaaatttaaatatataatactaagacttacatttttcctctgccttagactaagatcagattttacatattgctcagaggccgaaccctaaggtcaaatacagttggagtttacttgactctactgttaaaagggaaaacagaggcatatagactcagatgacagtcaaagatgatctagacaaaaaatgcagaatcacaatactatactataatacataaaacatttgagtactattattaacattgagactgtcatttaagatattgtgtcacaattaccagcatgtgagatgattcttcggtttaagatttcaaccagaaaatatacctaatgctagaggatgagttagtgggtgcagcacaccagcatggcacacgtatgtatgtaactaacctgcacaatgtgcacatgtaccctaaaacttaaagtataataataaataaataaataaataaataaataaagatgttaatcttccattataattatacaaattatattgacatgtattgacaatacatgttaataaatactccaaactatggaattgctgaagtagcttacattagaaaatacaaaagtaaatttgaaaacaagaatatcagtcttaaatatcaattttttaagagccagcatttaaaaatattcaatactgaatttgttactaatttgtagaattaatggcatgcaactccaaaggaaaagagacatttaagtgactcagatttgggataatatcataaattcctttcagtggctgtagctagtgttttagagggtaggaaataatgatgcaaaatcagatacaaattatttcagagacatgagtgatcttcaaagtgaaatattagaagtgatgttatgaaatacaagaaatgtgactgagagctcctaatctgatatatggcaatatgttaccactcattaaagcccaattttaatgcgttgacagctaacctcgagaaacaagacatctaacttcaatcctataatattatttggtgatatatcctcacaatatcgtacaggcaaataaaacgttcaaatttgaatttagcacttcttctcctgacagctctagaattccttaacttagtgaatatagccacaatcaatccagttgctcaagtcagagatcaggtagccatccatgtcaaatcccaaatcctgtcagatctcccttataataccttcaggtctctctctctctctctctctctctctctctctctctctctctctctctccccccccctctcaccccctccctccctccctcttctctccctccctcttctctccctccctcttctctccctccctctctatcccgctacccactacaactctaggataaactcttatcatctcttgcctgtattataacatcctcttaaatggtcagggtacacctccctctcccacccgacctcctagacacctcacccctaggtttctcgctttctaccattctgttctctccactgtaaccagaatgctttttaaaaacagaaaagctaatgatggcagtctcctacataaaagtattcaaaggcttcccgtggttttagtaaacttggcctttaatgcaaagacaattttgtctctgcatatctcttttgcttcatctagtgccacctttttctttgttcaatagatttgaattggatttcatctagctgtgtcttttacctggaacaagctttctccctcttcctactagatccttcagaactcagtttaaatactatttattattttaggtcatcttccttcaagattcctcagactaggtgaatattgtctgacatagtcttccatagactcaacatacttataatgtattcattataagctacatgagaacatgagaatagagactcaaagcctgtcactattcctgacgaatatgttcttattaaatgcatgctgaacattcattaagagctaaaaatatataaacaggttatttttctatacatgtagtcaaattagtgctcagtggctgttctgattattttatcattacaggttgagtatctcttatccaaaatgcttgggactggaagtatttcagatttctaactttttttttgggggggggggtgatttttgaatatttgcataataccagtttagcatcctaatctgaaaatccaaaatgtaaaatgttccaatgagcacttcctttgagcatcaagttggcattcaaaaagttttgaattttgcagcatttcagattctgcattttcagattggggatactcaaactttatttgaaattattagtgacttattcactgttccttaaatcagttgagtgaatgagggttctctttcctctacaatattcagatatctactgttgtcatttcttctgcttatcctctccatcactaattattcctggtgtcattttatttcaagacttctgtcagcctcttttcttcattattagaaataaaactgtgaagtcctccaaaaactctgatccaccttcaaatgatcctctttttcattccatcacattcaatttttcaaattctttcaaggctctttcttgagagcgacatatcaaagagctagtaataagaatcttcaacaccccaaattataaacaagtttcatgccaataagggcctagtgcactgcactaaatgtgtaacaggcatatatactacaaaaacattaaataaaatattgccaatttgaataaaatggtttattctcttattacaggtctttaacctcacatatctgagtaccatccataagattcatatcgctttgtttataatcagtgattagatagatggaatttctaacctccatattttacatgctaagattttaaattctgacttcaaggagttaaaaaaattatgctcacaaggaccaaaatatgtaaaccaattataagatcatctttactgttagtcaaaccattttatgtataatattattcaccatattggaatatgtctttgtaaggttaatgaaaacacacctttttataataaagcctactttaccagacataatgaaataaaatttccataggcatagctaccttctaagtgaaagttctatgttactttttagtcattgatagttattacattctaaaaagttttacttactgaactagaaaaattttcaaatttcaaattagattatctttgttatactgagtcagcattatcactagagagttctttagatggtgcaatcaacttagataatttctatcttttaagaaatgggggcagctgggcgcggtagctcaagcctgtaatcccagcactttgggaggccaaggcgggcggatcacgaggtcaggagatccagaccatcctggctaacagggtgaaaccccgtctctactgaaaatacaaaaaaattagccgggcgtggtggcaggtgcctgtagtcccagctactcgggaggctgaggcaggagaatggcgtgaacccgggaggtggggcttgcagtgagcggagatcgtgccattgcactccagcctgggcaacagagcgagactccgtctcaaaaaaaaaaaaaaaagaagaagaagaagaactgggcgcctttgatacataagtgtattcattaggtcttgaaaattattcacaccaccatcggttcctttgcagtgaatgttgcagcccttagggtcagtgtcaaccaattaaaattcaaacacatagacctgagagaagaaaccctgttaatctatttcacatcctaatgatgaaaacctttaccttaaatgaatgtattttggataaagtaggccatatttttataaaatatgatatgcctatttcagatccgagtattattttaggaattaataaactaaatctagttcccattcattctgaaactattttcagaattgtattttgaaaacacacatacgctcacaaacacatataatatcctaatgcatctcaattagactcagttggctaataccaagtttccctaaagttcactacccctccttgaggatcagaatactgatcaacacagccctaagggcatttttttttttttagataaagataaaccactgtataactaccaagtttaatagcaagtataaaatttcactagtaaatgtagtttcataaaacaagggtttaagaaagtgattctcaaattttacactatataagaatcatggacaagacttactacaatacatattgcatgtcatatcccctttttctgattctgtgggtctgctcaagaatttgcatttctaaccattccccagatgatgctgatgctattggcctggggactacactttgagaaccaccgatttaacgaatcatccattttttttaatgttactgcaaatgagttttaatgttacttttaaaaaaatgtaatgtgtattaggaaacagaaaattttacaacctagttgtaggtatatacacatgttatacatgttatacctgttatatataacacatgtgttatacatgttatacctgttatatataacacgtgttatacatgttatacctgttatatataacacatgtgttatgcctgttatatataacacatgtgttatgcctgttatatataacacatgtgttatgcctgttatatataacacatgtgttatgcatgctatatataacacatgcgttatacatgtcatatatcgcgtgtgttatacatgttacatataacacgtgttatacatgttacatataacacgtgttatacatgttacatataacacgtgttatacatgttatatataacacgtgtgttatatgttctatatgttatatataatacatgttatatatgttctatgttatatataatacatgttatatatgttctatatattatatataatacatatgttacatgttatatattatatatgatacatatgttatatatgttatatattatatatgatgcatatgttatatatgttatatatgttatatgttatatatgttatatgttatatatgttatatataatatatgttatatgttatatatgttatatgttatatatatgttatatgttatatatgttatatgttatatatattatatatattatataagttatatattatatattatatatattatgtgttatgttatctatatgttatatatattatattatatgtgttatatattatatatataatattagatatatatattcttttttatttccttctttggcataattctaatttctaaatgctaatttcccctatactctgtctgcaaactcaagacagactagttatgtgaggtactattcaaaattgaaatagaactttttaaattcttcatattgattcgggcattggaaacagcaattcctcagttttcatagttatttatctcagttgtctttctcctgagtattataatcataccatcagcccatgtatattgagatcatatttcagtctatatttatgttatgtggttttccatgtacattttgttcatttagtcattatcttttctcagaattagctgaaaaaggctattgggcaaatggtgagaaatgaaggaaaaaaggacaaatagaaaaatagaacaataatgcctttggtcttaagcctttccttatctttcatggtcttatcatggacaaaggccacatcttttaaaggattcatactgagatactcaggaggtctcacaggagtcatatactatactcagtagagtggctttatttttattcccagctagtccacctgatatctgaaaagtttgcccagttacactgaggaccgatcaatagtgtgatatctgaaaagtttgcccagttacactgaggaccgatcaatagtgtgatttgctatccatagggaggaggggaacaccctctgatatttcctgtttttaaacaactaaagttgttttgtattccctaaaccgtattgatccaagaagctaatgatagtttttacgaaagctcccttttgtaaactctgtcacagaggaaaccttggaaaattacaattaacggcaggaaaaatgttggaaatctattttaccatgtaactttcctgccagctcctgctatgtacaaaataaagcaagacccacatgtttttacctcctgggtttggatatagctggactgatgcaatggcaatgaagatggcttatatttataactccagggtgcttttactcctcccaactaatttgccatcttgtccattatgtgaataagctgtaacggctgaattggcattgcccccacttttccatttcagcagaaattttaaaaggaggttgtcactctgtaggctcaagtgatgccatctgcttttccatttggggaaatgcacataaaaatggtgggggagatgttaagtatttaattaaaggtagactatctgtttccccaattttctctagtttaatacctgctgggtcacatatagaatacaaataagaagatagaaaacagttcatgagatcttgtgggagaaatactaaaattaggttgcccattaaacataacaaatgcacattttactagtacattaaaccaaacagaaaggtttttttttaatgtgaaatacatgagaactcttagaacactataattgcagttctaaagaaagtaatcatattactcatatatgaatcttgatttctagacaaatatatttctgaaactgtatgatgaaattcatatttaaaatggaatttaataattgtcatcaataatggatatcttactttaatctatcaataaaatcacctacctagggatgtatgtagatgagtaattcttcaattagaatactaaaaaatatgtcattacaattacagcttcaaggggccagtaatgtttgtggtagactttcaagactgttgagtgtgtagtttatctaaatactaaggttattttttccttgtaattctagagccacaccattgttttgactatggcacaaatgtaatgcacatttcaataaaacagtacagctgggaattaacaggctaataaaaaggactttaaaggtgcattaaattaggatttaagatgtctcttgcatttgcagcataaatgctaataaaaatataaatctgttattaactttttatagtcatgcaaagcaataaaagctgaaaatattgaagatttatcagcacatatctgcaagacggacagaatagaacaaaggtagagaaagagagatgttaggaaaagggagagaaatttttagagtagaaatgaggagaaataatttatatatagtttaaatagtttatacacacacacacacacacacacacacactttgtttcctttctaacataatcatttttattttgatcctcaagaaagtttgggaatgttgtttcatgaaagtaaaaaccaagaaaatattttctatcatttaaatgactagagcattaagctaggagattctgctccaagggcaatactatgttacctgttactatttcccttagctaacaatataccacttgtgtcaaatgtgtgctgacaatacaggcttgttcattagaatcatacaaacagctagctagcagtttgcttaataatgcactaacctattcagaatgcttattgcttgagtcataattgcacagatctaattgttaaatgtggctgggaaattaaaatggtagtccttagagacagctctgtttcaaaattaatataatcattaaagaaaaataaaaacatatatttttgctggcatatctgaaggtttttaagaatttcttatgcaaaatgtaaaagagaagtcatggttctcgaaaacaatattaaaatgatatacttccatctattaagccacatggaagataaaagttttggggttgtagcctcagaaaggctctaaattcttaatgttgataaacaataaacaacaatcatttgttttccacattggttatgattaattggtatatactgaagtttttaaaaatgcattaaaaatataatataggcagtccatggattgccctcatgctactttgagaagctgaaaaaccacaacacattaaattgcagtaaaattcaaataaagttttataatttgtatatagtgcataaaaatgtttatataaattcgccattaactatataaagtattatttcattgtagatagtaacaggatcctcatttgtcagaacaaattataaatttggtgttattactcttttctctctcctttaaaatatcaatttgccagtattttaaaaaattctgaatagcaacagttgttagctacaatttgcattagacagctgacaattactcaaggtgttactttctaagaaaatcaaacaaataaatatgctcagattttaaaaaaagacttgcaaaatacttaatctgctacttatagtgtatcacataacaagttagacagtcacagtattatttttaaaactatttttaattaggctatttttaaatttaaattaattaaataaaatatgcacaccttttaaaggcataattgttgttcttataatatatgtaaatcaatttaggcttcctaatttattaaaaatagaggtggttagagtacgtaagaaaattctctggaacataatttttaatatggcacaagcataactcataagttcaatattgtcttcaagcacattaactttatataataaaaataaacaacaaaaacatggcttaccatatccctatacttaatctgtataaataatattaaaagcatatttcaaagaactcatttcagaaatgtttatgttgtgagttaccaaggaaacattaaacagaccagaaccaagggaatacatgattgaatagtcctggtttcctttcgttatagagttctttcctttatgtcataattgaggaataggagtagtttaggaaaatggaaaattttctttttaatttaagatagtccatcatgcattcctggaaattttcatccaaaaataaaattatgtagacacatgtcaacatctggttagactaacaaaagcaattttaatgtgcagttgaccctagaacaatgcagaggttaaggatgccaaacctatccccaccaccggagtcaaaaatctatgggtaactttcgattcccctaaaacttaattactaatactctactgctggctggaagctttaccaataacaattgattaaaaaacgattttgtatgttatatgtattatatactttattcttataattaagacagccagagaaaagaaaatgttattaagaaaatgataaggaagataaaatatatttactatattcattaagtggaagcagatcattataacggtcttcattctcatctttataatgagtatgctaaggaggaggagcaacaggaagcattggtcttgccctcttagggatggcagaggcagaagaaggggaggaggtgaaaggggaggcaggagaggcaggtatactaggtgtaattttatagaaaaaaattcatgtctaagtgggtccatgtagttcaaatctgtgttgttcaaaggtcagctgtaatttataatagtaaagtaatttagactgaaaattctaaatgatgcaatataattatatattgtacaggaggtaaggaaagaagcagaaatctcataaaagtactaaacctgatggaatagtactgtttactgatctgacataatttccatcaatttaagcgattcctttgactataccttaaatgaaatagtatggtttcatcctaaattcaaactctcataactgcccaaattaataattatggtagctaaactaaatgttgaataagtatgaagtattttgttatttttgatatacaggaaattcttggattgacatacgtgtataaatccagaactttcagattttggataaggaaatcagagcatataccatatgtcacgcctcacccgtgctgggtagcaacccacatttgaaaccagcctaattctcccatagaactgatgtctacgggttgtttttttctttcgttttaaataaacatagaaattgaccagttgctgcctgctgaccaactcctttatacacccctaattttagtcagctgggggaagagacaaatttgagaatggcctgtagtgtcccagctgacatcctccaaattaaagcttttcttccctggcaatactcattgtcatgactagacctaagccaaactgctggtatttagaaacatattcaattgccttaattattatacaataaaacttatgaagattcgcaataagtgggaacaataaagacacaaattattcttaagtcagcttaggtcaggatttttcactaaataaattttggagccaatttagaagaaaactgttagcttttagaactttgtggattttagaattgtgggtaaatgattatgggcccagttttctcatttaaccctaaccacacacttatgcaaaaggtaattttattatcattttatatatgaggaaactgaggcttaactctcataaatatcttgctcaaaattatttggctcgtaccataaatacagaactatgttattaatcaagaagtctgtctctgaatcccacaataatttggagaactgcccataataggtttgatagtgtcacaaatgccactgtgtttataactccagattttgtattgccttttgtgtttaaagccatttcctgttttagaagggtgagctggaaatttatgtttgctgaaagccctgtaactatatagctaagtagcatttttgaagggtctatgaaaaagtgaattagggagcatactctgaaattcctatttattcctctaaattctaacttgcaattgttgattaaacttactgttataactagagcattttcagtcaagtggagaaaatctgacagagaaataagcattttaatttttaatttcatgtagttaagacagatcccctcaagaaccaaactatgaggctgctaaatggagaacacacttcatatggggattcttttgagagctgagcaaataaactcaagtgatacataatatgccgtaatgtatagaaaagaatgctcatatgagaatgtttaattgatagaaacaatattcactatcataagggaataatgatctttatactactgagattgtctgaaagttaacttttgaaaaatgtttgattttagcaattgggttttttaaattgtgatatataaacatatttaccattttatccatttttagatgtacaattcaatggcattaagtacattcaagttattgcacaatgataaccacctttcatttccagatattttttatcttcccaaactgaaactgtctgcctattacaaaataacttcccattctcattccccacagcccctgacaaccactattctattatgtctttatgaatgtgactagactattccaggtaacctcatacaagtgaaatcatataataatatttctcattttatgactggcttatgtcttaaatggtcaatcgtattgtagtatgtgttagaattcaatccttcttagggctgaataatattatactgtatctgccatatatatagtttttagctggagtcttgctctgttgcccaggctggaatgcagtggtgggatctcagtttactgcaacctctgcctcccgggttcaagcgattctcctggctcagccccagtagctagggattacaggtgtgtatcaccacgcccttttttttttttttttttttttggatttttagtagagatggggtttcaccatgttggccaggctggtctcaaactcctgacctcacgtgatccacccacctcggcctcccaaaggctgggattacagacatgaaccaccacacctagcctataacacattttttatcccttcatctgttgatgtttattgggattgtttccagcttttgactattatgaacaatgctgctatgaacattaattcacaaatatctgttcgagtctccactttcaatgctcttgaaatagaagtggaattacggtaattttatgtgtttaatttgtttttggggaatcaccatactgttttccacagtggttgtgtcattttaaatccccactcacaatgcacaagggcttcaatttttccacattctcatcaatacttgttagaaaatatttttataattttacattgtacagggaccccaaactatttacaaccattaactcactactgatcacagatacgtactttgacttctgtttactttctttcatattgttctatttatctatttcacttccagtgtattgtacagtacccattacattaaggtaatagtagcagcttcttataatttgaatgaatgagtgagtgagtgaacctcattagtgactttaaatattttaaaaataatctacctggatccccagaacataactattacatcataaattatatcacaatttgtagtagatacagaacaaactttgaagtctccacaacttacggctgcagaggaaggagactctaaaccaaattactcaggctagaggtctttcttaagctaattgtcagtatatcatgaatgaatattcttaaggttataatgcattatagagagcctggtttatcttgagaccagctttatctgagtaagcagctatacttcagaattctacgtttcctcagtacttaaatctgctcatgaaaatattcaccagaatcattaaatttttaatttattagagatgagcaattcacaatatccagctcatatttaaaaaaaaaataaaaacgattctcttgtctgaaggactccagagacagccaatgaaccaatcagaattcattgactgccagtctgacctatgtccctagcatggagtcaggccagtgaagtatgaaaagatattagtggacaacaagcacatagctaaatagtaattcatgaagttaaactgtatgcagacatgttacagtactaggtaactagaactgaagaatttttaataaaacaaaagtttactgaaaatcctcagctatctagattctccttgtttaaaattctgttaaaggtcatggcagctggtaattataggacattaatttcatctcacaaatcagtaatggtctccatttaactaagaaccccttcttccagacaacataaaataggaaggatctatttaatatcattctactttgaggaatgaccctacctatataatattcagaggcaaaatatcatataaaggaatataagggaaaaggaatatgaaaagaaataggaaaagttacatatgtaaacttacaatctcaataataaagactgtataatagtttttcctaacagttataattacatctttagacaaaatatttatcttgtaaagtttttcagaaattaaaaatggaaaactatccagatgactattggttatttttatttcagtataaataagcttcagtactacttaacaggaaagctgtattaattaaagttaagcactcatagtatttacatcatagatttattataaggattaaaccaggtaataattgtaaaaagcttggaacactgtatggctgaaatgtgtttcaccacgtaaatataaaagtagtgctacagtaggccaactggatagcaactttgcaatacttgttagtcaaaaagtgtaagagagtttgctggcatgagaagcaaacagaattcaaaaatgattattatttattgatattcctttcctaatagagaatatcacatttcctccataggaaaatccaaaaggaaatattttcacttaagacaattggggaaggtgctagctaattagtatcacacaaccaattaattagcattccacatacctataattagaaagtgttaaatatggtctacatcagagtgaatttataaaccttgcctgaggaatcagttagtcagtagggtagtgcttgtttctgagtttgaaagtagcacttgtgaaaaacatttccaggaagaatttccacgaatgtctactcctttaaatccaagttgaaagaaaacccaacaaaaattcagatgaatacatattacatttctatttttttagaattagtcaattagatattaagaaagtacatttaaaatttaattatgcaagttttccttcttttataacttggcctgatgcttaattaccctatatttgttgattattttccatccttcttatgaatatattagcatgcaaccataactatgttaaattacctttaaaaacacataaaaactagtggagcatggtgttttcctcttcatagtacatgaaatccactctaaataaattaggatattttaacagagtttgggaatgtttattttagcattgattccaaacagctctcccgtggattcacctgatagtggatcctgtcattctcaggatggtattctggactgttataaggtggatcctgggtggattttatttttttcacgcttgctttaatcgataaatattttcagaaatgatgagaaaaatgtaagactctaattattttctctaatgttctttaaataatattgattcattcagaatatagctatgtcaaaatatttccttcatttaaaaggtacattggaattactgaagcatgtcctatattttaaaattcatctaaaggaaattattttttgatccattcttcattctgtcctctctggatactatggtagacaaacttacatctcttaactggtccttcctctctacagttatgacttgctgtctagaaagcagtggcttattaagtagactatcaattctttgagtgttgtctctcttgtggaactgccatgactaccataagcttagtcatatagccctactattattccttttgttttgttggcacttatatgaattattttatttacatatatgtattggtatgtttgtgtatgagaaagaaaaattgtgagtttgaagggaaaaagatcacagtgagaaggactttgccttattcattctgtatactgaacaataatagcaacattcatgaaatgtttgctaaatgaataccaattcggttacaaagctaggtttgtagtatggattgcatttaaaatgtgataaatccatttaagcaaatacatcattctccctcccttcatttaaatggatatttaattttatttaaaatggtggtgcgaaattttataagtgatagtaactttctttggttttatcaatagtgcatattcatcatttctatgttcatttattcactaagtatttattgaggacctactatgtatcaggcatacataggcactgaggatatgttttgacatgaaatattaattttttatttttatttttttgagatagggtctcactgtctcccaggctggaatgaagtggtacgatcatggatccatgcatccgtgacctcctgggctcaagtgatcctcctgtctcagcctcccaagtagctgggactacaggcatgagccaccatgtctgggtattttttgtagagacaggggtctcgccatgttgcccaagctggtcttgaatccctaggttcaaggagtcctcccacctaagcctcccaaattgctggaattacaggcatgagccaccacacatagcccaaaatatttaaatatatgtattaagtttatcttcatgatacaatacagattaatctaatgtggcagtattaaaaagtctcacttcactaattaatccaaagaaataaaacttcaatccaggaaagactgatcactgtcagaaatctgattctgaaacatggagcaaccatatgttttttaaccaaaataaatgactattgagaagaaaatcaataaaaactattagttttatgtatattagtttctggtaaaaagtttttacacatcggctaattatattaatagtattacattaataacaaaaccataataatactatacatttatgtaatatatgttatataacttattttatttacatatatgtatatattaattgaacatctacaaggtgctaggcacagaagatacaaaagtgaacgagtcagaaatctgtcctctttgagagcttacatttaggggaatcaactagaaataaaaattaacacggacattgtacatatatgttacagtaatatataataaggagaacaaatgggagaagagatacaagagttgaaattctagataagatagcacatggtaggctctcctggaaagtggcttttgagtaaaaacctaaaaccagggaagaaattagctatacaggtgtaagaggaaagcacaatgcaagcagagagaagagcaaaagaagttcctaaggcagaaacatgcctgccctgataaagagacatgaagaagctgatgtagctgaagttgagtgaaggagaaggcagagtaataggagatgagctcaagacacaatgaaggcccaggtcacgtagaaactttcaggccattatccagattttggcttttacagtgtgaaagatgggaaggcactgggaaagttttgaaaataagaataacatgatctgaacaactttttaatgaatcattctatactttggaaaataagatgtgtgtacatattttggcatcacagaccaccacatcaatactcatgaaaaggacaaactagtaattaaaatccttgctaaaatcttcaagcctaaacatatattttaatccaatctctgtccacttcctatctttttggaagaaggcaataagtcactaatcaaccacttagctgtttcccaactttacctgtcattcaggtggcacaaagataacaccattgctttcatcttccatcctccctgacactaggaataaaaaaaatgaagatactctttttaactttgtttctagataaatgaccactgacagtcacatactaagtcacttgactgaaaagttatttgctgtagtattcatcccttcttatttttacacattatttgatttgtcaaaagttagtcaaacatgcatgaatgttctaaaattataaagattatcaacttaaaacattaaatcactttaatttaaatattgaatatggtaagctgttggaaaaattactcagatctattttttctctacttgtaaaataagtcactgatttgattttttaacaatctgattcttggagcattttgccctctacttactaatgattctattatcgctagagtaaattatttctcacattgctaattggagattggcctttcaatgaggcaaaagactctgtttatttttccatttcctttaaaaaactttacaaaatattattttgttttaaacttaatgtgtcttttttgctttcattctgtttgcacatggataaagaactgtgaacttctgacttcttaaaatatcagtatttgtgggccaggcgcggtggctcacatttgtaatcccagcacttcaggaggccaagacaggctgatcatttgaggccaggagttcgaaacaagcctgggcaacatggtggaaccccatctctactaaaaacacaaaaattagccggcttcatggtacatgcctttagtccccgctacttgagatggggaggtacaagaattgcgtgaaccttggaggcagaggttgcagtgagttgagattgtgccattgcactccagcctgagtgacagagtgagactctgtcccccacaaaaaaaacaaaaaaaaaaacagtatttatgattgtcttccagaaataagattaacatcaagttggaacacagttctaaatctttgtctcccaaaagatattatttatatgaaaactttttttttttttttttttgagacagagttttactcttgttgcccaggctgaagtgcaatggcatgatctcggctcaccacaacctctgcctcccgggttcaaacgattctcctgcctcagcctcccgagtagctgggattacaggtatgcaccaccacgcccggctagttttgtatttttaggagagactgggtttctccatattggccaggctagtctcaaactctggacctcaggtgatcaacccgcctcggcctcccaaagtgctagaattacaggcatgagccaccgtgcctggccaacttccagacagagacagacagacagacagacagacagatagacagattttgtttgttttgagacagagtcctgctttgccactcaggctggagtgcagtggcacgatctctgctcactgaagtctctgcctcctgggttcaagtgagcctcccacctcagcctcccaagtagctaggattgcaggtgcgtgccaccacgccagccaatttttgcatttttagtagagacggggtttcaccatgttggccccaccaagtctccatagttttatttctacttttgtttctagacaaagcagaaaaaagtaaaagcactaggtattataaatttctacactttcctccataaaaaacaaacggtcattttatgatattatagaaaccattttaaagaaaattatactttaaaaaataatttttactccattagtgaaaatcatggcatttactttctgaattccaaaaaatcctcaaatattaaaattaaaattgatgcctacaaactgactccattcaattattaaagaccttatctttatttgtcataagcattgttacatatcaacaataacaaatacaccatcttttacatgtaggagggtcttatagaaataagtagtcagatacttaggtaaatcatagagagaaaatttgaatttttaaaatttactcactgggcataaagaatcatgttttaaaagcaaaatatgtggttagaagtttctgaaaaccgagttgataaagtaccatttcaatctgatgtcagatgtctttgttaaagagctttctgagtagtaatcttaacatccaaaaagtaaagctattttggtttcttcaagtatcctaacacaggggagagaatttcctcttgtgagtccttataatacctatgataattttatttatatctttataattagtggttctgatttctcataatttgtgttggtattagcagggaaccaataaagatttgcaagttcacccagtttttatatggccctggttctactgacctgtttcatggttacagaccctcacgcatagccatgaacagttatctcacagctatcctgtataccactgtaacctcagcccctagcacaggatctgacacaagctggggagggtgctacttagaggcagtcaaatcatgtttgaaaaagtgatatcactagaatcaggttatctgggttcaaatcctaggattgcccttctagctctctgaccttaagcaaattatgtagttacatttgtaaaatgttttagtgttggttacaatcgcatgggattggttactattgcatgggattaaatgatgtaatgcatgtatttcacggtgagccttttatttaaaatctcattattattataaattgaattttttaaagataaaaaactagggatagcttaggtctaatgacatttttggttcacaagcactatgaactgtctccgtctgttctgttcttttttttttttttttgagacggagtctcgctcttttgcccaggccaactgcagtggtgctatctcggctcactgcaagctccgcctcccgggttcacgccattctcctgcctcagcctcccgagtagctgggactacaggggcccgccactgcgcccagctaattttttttgtatttttagtagagacggggtttcaccgtgttagccaggatggtctccatctcctgacctcgtgatccgcccacctcggcctcccaaagtgctgggattacaggcatgagccaccgcgcccggcctagtctgttctattcttaaatgtttcttttactcataattttaaggaaccataagtagcatgatcaattttatggactgcaattaaccatgttggtttctgagaagtttcaaaaaaaaaaaaaaacttttgatgagttttttgtaagcacaattaagtagactgacatttataaatgcttatagtatgtgaattcataaactgaaattgtgtataaacatattccagaaaagccatctcctcaaattctttcattttgtttttgttcaaagtaatcataaatgatcagtgatggtataaagaaaactttttattaaggataaaagagcttcattaaaaaaatcctgtggtaacaggtagaataagaaatctagccagttcagtcacattaaagagataagaaagtggagtcaatataagcaatgatagttgatcacaatttatatgaaaaaggcttttcaaataatggaattatctgtttgttttccagtaaataatcttatgcatttgcaagcaatagcatctgtttctatatgataatatatgacagaaggagaattaatttgtctgtcgccatgtgctacacaacatattaagagtgaactcaaagaacagtgaagctttatttcaactgcagtggaatctgatctaagttaatgttattcaatcttacactaaatataatatatcaagaacaagtataagcagtgaaaatttgttagggtttttttggaatagcattgcttatgtataatgtcataaacaaattacataattatgaactgtgtaatctgtataatacgacagtgttaggcttacaatatattacttttctaattctgggcaagacacttgaactctctacatctaatgtcctcctcttaaaaaggatagaattttacctgctttatagtaggtcatttacttaaagagtttatagactaggacctaattttttattatataattaagtatgagttcctttctttcatactgccattcttttctaaaaagtatatgatcttctgcaattttttaatttgtattaaattcaataattagaaaaaaagtaaaataaactgtgctaattaaagccatatactttttaaaatctgactctcagaagttaatgtgtgttattgtaatacataaaaaacagctactgaacaaagactttaaatatctgcttttgtatttctatattatctatttacctttggagttatatcactttatttaaggaatatctataaagcttgaaagagaaaaatgaactaattgaggattagtcgcttgtttgtgccaggagtatttctgccttagggtcctgtttgccctggactgtgcttccctcttacgcctgcaaggttaatgccttttattgctttaggtttttactaacaagtcactttcccaatgaagctttccacatgcccataaaatttcaacccatatccttcttttctcattatttgttcttcttagtatataatactataccatattatataatatacttatctatcttgaagaaagattcaatgaaaggaaagagtccttgataaaagagagacaaagcttgaaagatataaacagggctaaggcaagagattatattggaataggacacaactgagaatttagagccagaggaaaatagttatgatgatagggaagaaacttcactagtcttgaaatgcaacataataatgatggatttaaagtgaagatcttgaggatgttaataggtggttagaggcagtgggaattcaaaacattaagaagacaagctttagtgcttgctgaatttgtcaggcaaggagaaactgccaaaggatgccaataacaattatgtcaatttaaacaatcctgtaacacttccagccttaaatagacaccagatcatccaaggcaaagaacgtatctaaccccttattccatactttcaactaaatgaaaaataactctgtataaggaattaaatatacagcttaaggacctttattcttttttattcttttatactttaaggaaactattcagagtttcaaaaaatcttttaaactgagaaaaatgctctcccgatttatctcctatgtattttattggataaaacttaaatcagcttgtatctcagaacatacaagaaaagatgtagaccctcctttccattttctcaactttgatagcatctgtgctatattagagactttctgacctcataatttcttcacatgcagactcataatcctttctatggaaataaaattaatgtcagacacttgaaatgtccaacttagatgaactctccataactgaatttgctgcatatgaaacattctccttacttaatagcaatatagaactgaatggtaagacattaatcacagccattttaaaatgcatattacttttttcatctcagtgtatatatgctcttttttgataggcaaagaaattaagttacaaggttattatcaaaatggctaatctaaaaacatattcccctcaattttaacattacttttgtttgttctactactgcagtgaaaatcctgatcttatgatatactcctgacattccacagtgggtacattttgctcgtctactctcagtgatgcaccagagactagaggttgagagagtatctactagtaatgtgactacttgggctaaaattctgagcttcttgcttattagcagtgttatgaactgaatagtgttcccccaaaattcatatgctgaagcccaaacccttagagtgactacatttggagacagggtccataaggagggaattaagattaaatgaggccatgagggtgaggcactaatccaataggctggttttcaatatatatgatttttaagaataataataaagtttgccctactaattgcacagtgttctcttttagagaaactaaaatatggcaaaagagtttcattgggcaatatgtatgttgtttcccatccaatagtccagagtagagaaaagacaccctttcctcattcaaaccagtcagcctatttccttgtcacttgcttgactgacctgcattgtttttcagctgaatcagattgtggatatggagatagaataggtagaaaagtcagcatggaaaagataacttgctcagaaaggtcatttagcctctggctaaaaggacatactggacactcttgggagcttgaggcctaatctcatcaaataacctatcataacatcatgttgtgcatagatatgcataaagtgatgagagataaaagaaatgaaagtaggaagttaagaaccaagaaaagagaaagagcagcaatgctagtgcaaaaaaaaaaaaaaaaaagaatttagaatttaccttgtaagtacaatgaacaatttcccatatgatctgatattatgttaatttagaaataataaaggagctcttccaaaaatacatttaaaagtaatgaaactaaaacagtaaataaaagaaaaaaatgatggtaactaaagagtctcacttgtcagaggctttgcctatgactcttgaaatttcctaatatcacatttactggcttcaagaaatcctctgtctcctataagattttcagtttcattttgtagccacttaatattttatttataatatctagtttatgatatccatcaatcagagaaatagatgatccaaaagtggattgaatggatagggacagacagcaggtgggatttgaaagcagaattattaattattactgattagtgaaattttggtgtcattttgatgcctgctttttcatgaaacaagagaatcgagagtcagataatggatattttgattaaaagttttcccttcaccacctactcctcaatttctgctctaagttttctcttctgtttattctggaaatactctctgagggatgtcatggtttcatttatttttaatgtattgaaggctcttggttctatatctccaacctagacaatattgctgaattcacaatttatatttcccagtctgtagaacattctcacttggcatctctctctctctcatgctcaaaccaaagtccattatatctcctctgcctttgcatttgtgtttgtttttccttatgcactccttgtatacataactggcatctctatccattctgttttccaacccagtaagctgatggtcatccttggtttttctcttagtccccacattaattactcactagtgctataaactctacatagtaaacatctctgcatccactcacttacttattccactgtgtcactcaaggctaccatcatctaatgcttgcactactgtagcttccatgagtgtctctgcttctcagtctttacctgacttccactcatccctccagtttccatttaaacacatctactgaaaacactttctggagagaacacacacatatgcgtgaagacacatcgcacacatacatactcaggcttctgataacatcctacatagcacctgtgctgcaaaagactcagctttcaaggttgcaattaatatcagccttctctgaaaggctataagactatttttctgatttctgtgtccttagtgcttagctctgagttagacatgtagtctacactttctaataaaatagttacaattcacttagtgaatgaagtaacaaaacctacttgtgagagagatccaaagtctaaacagcagaagtttccatttctttcttttttaaaaaatttatctaaaaaaaaaaaatggatacatgtatagaatgtgcaggtttgttacataggtatatgtgtgccatggtggtttgctgcacctattgacccatcctctaagttccctcccctccccactcataccccaacagggcctggtgtgtattgttccccctctctgtgtctgtgtgttctcacttatgagtgagaacatgcagtgtttgggtttctgttcctgtgttagtttgctgatgatggcttatagcttcatacatgtcctcgcaaaggacatgatctcatttctttttatggcaacatagtattccatgttgtatatgtaccacattttctttacccagtctatcagtgatgggcatttgggttggttccatatctttactactgtaaatagtgctgcaataaacatacatgtgcatgtgtctttacctttgaatgatttgtattcctttgggtatatacccagtaatgggattgctggatcaaatggtatttctggttctagaaccttgaggaatcaccatactgtcttcctcaatggttgaactagtttacattcccaccaacagtgtaaaagtattcctatttccccacagcctcaccagcatctattgttttctgactttttaataatcattattctaactggcatgagatagacaagcaaagagtcaaatcatgaatgaactcccatttacaattgctacaaagagaataaaacacctaggaatacagctaacagggcatgtgaaggacctcttcaaggagaactacaaaccactgctcaaagaaataagaaaggacgcagacaaatggaaaaacattccatcctcatagacaggaagaatcaaaatcatgaaaatggccatactgtccgaagtaatttatagattccatgctattttcataaaactatcattgacattcttcacagaattaaaaaaaaaaaaggactttaaatttcatatggaatcaaagaaagacccctatagccaagacaatcctatgcaaaaagaacaaagctggaggcgtcaggctacctgacttcaaactatactacaaggctacagtaaccaaaacagaatggtactagtaacaaaacagacatgtagaccaatggagcagaacagagacctcagacataacaccacacatctacaaccatctgatcttcaacaaacctgacaaaaacaagcaatggaaaaagcatctcctatttaataaatggtgctgggaaaactggctagccatttacagaaaaccgaaactggaccccttccttatgccttatacaaaaattaactcaagatggtttaaatacttaaatgtaaaagccaaaatctataaaaatcctagaaaaaacctaggcaataccattcaggacataggcatgggcaaagacttcatgacaaaaatgccaaaagcaattgcaacgaaagccaaaattgacaaatgggatctaattaaactaaagagcttctgcacagaaaagaaactatcactcaagtgaacaggcaacctacgaataggagaaaatttttgcaatctacccatttgacaaaggtgtaatatccagaatttacaaggaacttaaacaaatttacaagaaaaaaacaaccccatcagaaagtgggaaagggatatgaacagacacttcaaaaaagaagacatttacacagccaacaaacgtatgaaagaaagctcaacatcactgatcatcagagaaatgaaaaatcaaaatcacaatgagaagtttcagtttctatatatgagggtttagtggtaaactattgtcttagaaatgagtagaagtttaacaggaagttgtcttaattttatgcttgtaatgaaagcacagtttttaatgtagatcttatgcatttatgggggcagctaaaagatattggaaggaatggctaagccctctcacatcatcccaaagtgctgacataggatctacatgttagaaaatatttacgtttccctatgtgattgatattagtacaatgctaaagtaattttctgaaaaaatacaaatataaatgcactcattcaatttcttaagtcaaaataattttgctgatctaatggcaaaggctcttcaaaagcagggtgaagggcataatcaccaggccccaacttgcctgatatagtaactccataaccactcttaccaaggtctataggctatttaattgctttctattttaggttgtagctgtattctttagaatttcaaataaggttttcaggccaaaaggcaatgggagtggcttatcaaaattcagagaattcagatttctttggtgtttgcaggttaatccctttgttatacaaagttgattgacacggaggattttccttaaatcaccaagccgtgcaaggacagtgctaggactacagttgaggtattcagaatccaagaacacctcatgctgacctttaattcctgatccttacaattggttgcatgctgcattttatctagtttcaaaagataataaggcaataaaattaaatattcaaattaacacagaatttttacacatatgggaataattttttaaagctacttaatagaatgattcaatacatcttcctgtgataatggagatgttctttatctgcactgcccaatagagtgaccaacaggcacctgtggctctcgcatgcttgagatatatctagtgcaattgagaaactgaatttttacttttaattaatttaaaatgaattaaatttaaagaaccacatataactaatggctactgtattggatagcacagttttagaatatattttgggacatacactacattatcttgaatagtttttatacttcatggacatcattaggagattgcaaatttatatttccaaggtccataattacataaagagtgctatatttcattaataattaggaaaatacatttacaaatatatttaaaaccacaataagataccatcacacacctggtaaaatcaagtattggccagaacatagagcaagaactggaatttccatacattgctgatggaagtgtaaatttgtacaatctttttggaaaaccctttggcaatatgaactaaagctgatcatatgtaaaacttatgacttaataattccactcctatatataatccccaacagaaatattctatatgtgggcgccaaaatacacgtacacaatgttcattgctctactgtttgtaatagcccctaaatagacacaactctatgtttattaatggcagaagtgtaaatagattacagtatattcatacaaatgatacgacacatcaaggaaaatgattaaaatactggtacttaatctcatgaacataaatttaattacatgaagccagaaacaaaaaaatgcatactttatgaatccctgtatataaagtccaaaacaggcaaagttaacctataatgttaaggaatcaggttgtgataactttgaggggaagaggagcaagcaagagagactttacaggtgcttgtatatcctgtcacctgatttgggaggtgattactgtgtatacagtgcctcctttgtgaaaattcacagcattttatgcttaggatttgaacaatcttctgtccatatgtagtagttgaaataaatggtcaaatttttcatagaaattctattaaatcacatatatttgtcacagcttaaatattcatggaaaacagtcactatataattatgtacattgaaaaatttagagaaaagtgacaaaagctgaaaagtctaagagaatcattttttctaaggctcaaattgccatttttcatcataaaaattcttgctgtgtgtattgtgcaaattttagagaatgcattgtataaaatgagttatgatttcttaatatttcaacataagtctggtatattttatatagcatgaaatagaaataataacatgaagaataataatttcagaaattcaattcacaaaacttagtttttgtgtttttatagtaattttccatcttgaaggttaaaaaggaaaacaagctttagaaatattacttattatcaagctgtgaagtcactaacaaggacaatactttgctaaaaaaaaatcttgtgaaggaaatccctattagcaatttgatgcaagtatagcttgcatatattataattatctaacatttaaaatctctatactgaatttttgcttttcctttggctatgcgcctacttttcttaaattgatttattaatgtccaaggttgctttgcagttttatccttttagcaataatagatgcaatagatcacaaaaacaaatttttaagagaacatcattagagtgatgtagcactggtaataaaccccttcacacttggatgaacttaaatcagtttctctttattgatttttggtcataacataattttaaagttcaactcagttaataaaaaaagatttgcgccggtgttatgggcaaaatacttgcgttgtaagtttccacatcatttgtggaagaatgttatagttgtatcatatatggatcttcgatagatatagcaatgagcatattattttatgataatccttatgtttaatatctttccctctccttttattgatgtgaatctttcaacatccttatcataagatccaatgacaccattagtattcacttcctatttatgcatacgaatgtgtgtgaaagatgtaaaaaatgcaatatgtatcaaatatacacacagtaaatctatttaaaatatttatcttatgcatatcatggcaacattttaactatttttactaataatgtgataattttctttagaatgattttacatctttatgcaggattgtcactcccatgtagagagtgggttgattttttatcttgtagttcattcaaaaagtgtcaaaaatcaattaatgtaacctgtttttaacatgatgaattacagacttatgaagggtctatgccatcaggagaattaatatcttcatccagaattaagtaattgaatatacacaaaaaaagaaaaaaataggttaatatgaactcaaatatgagtgtcaaacttctattgattgctattcttcctgtgaagctgttatctactataattgttctcactttctcctcactacaacatagcagattatatacataacatgttgcccggggctcactcagatatggcccacagcatttataaaattctcagctctcaaccgtaattcctggccttcagtttttcacacaaggaaacctatcagaatgcaagagagcaagagtacactctaatataatcttatatccattctatagtttaaaaaataaattatgcacaaatttccccacttcatttttaaacattccttgcaatatccttcacatgtatgtgttaagattgcagatcaaggcatctggtctgtaatgccttgagcacacaataaagagaaaggtagcatcagacaattagcaaccaatggcttgaggagaattaaaagataattttattattagcttggatgctagaatataattttcattgactgttgttttgacagtgaaaaaggcaatggatacttgctctattttgcagcagcctaaaatgtacaagccctatatcacaatttatctagcaataaaagggtcttctgtggaactgatcagagccaaaaccaaaatttgtctccaatatctttgtgtcatcacccaccaaagcttcttaacatctttgcaagttcaaatgttatttaacccttaaaactgaggttaaatgtgttcattcattcaacaaatattaattgagcaaggcattttatattagagacttagaagaaaaaaaaagacatgaaactttcttccaaaacaaaagggcagacaatttaatttgaaggagacatggagagaatttgttagtataagaagctatgtctctagagggtagccagggtaaggctaggcagacaacatatgtttgagtaccagtttccaaaggaaaaagaaggaaacggttcgatttctcaccgtgacaatctattgtcatcagaacacatcaagtacattcagaggtaatttaaacagacccattaaaacataagctccagaatcataaagaactagtttcaaattcaagtttaaaatactggtcattttgttgagtcttgatagtttttataatttaattaagcttccgtatattaatttataaaatgagattacaaggatttttgtgatgaccgaacaagataatatatgtaaagcccttaggtcttagaacataataaatgcccaataaagtatatatttcttctggtgcacttaaatcttaagacagaatgttgaatcagcacatatcatgacaacccaaagatcaataactatttgtaaattagatgagaaaaaagtatatttattgaatacctaatactgtctgcttgcttctgtgacatcatgtgacatgattattatgaaaagtaacataataagaataaagtagttctttactatagcctcaaagtctccattgctaacgagagctgctttagaaatattggcataaaaccttttttataagttgcacataattacaggatcagctttgggtttcaattggtaagaatttcagttctgtgcggccttaatgaataatatctgaagtacaaattaaattttttctatcaggaggcttattcagaaaattataggccatttattccttccataatatatgagaaagataaatttttccctaactctattcttcaaagagtaaaacatcctggctacagcattcatccctttgttttgtctgtctgtttgtttgtgtgtttgtttgtttgcatccttgcttactattaaggaagcctagatggtaagacaataagaaaatagagggcaaagccaggccatgttctcataagatttaagcctgtgagagaacatccagaattaataatgtgtgaacctggagctagtcaaccagctaattgccttcaacactgttcatcattaatccagagattgccattccattttagttaaataaggaatttcacattggcaaaagtgagtctatagtattcatatctcactctaggttgactgcacaacctcacaggatgccaatggctcatgctggcacatatcaatatcatgggatttatcctggtaacctaggtttgtgtgcatcagaaagatgagtttcatgtatgtttcttaatttacacataatatatagaatggggatattcagatttcccaaagatagccatgtttactgtttttaaagtctcaaaagatgttttaaaagttcaccatatgtactagaacttttatccttgaatgtatatgccattttttttttaccactcaaacgtaaatctacagggaccacacaatgattcgtgtagattccattcctttttatgatgccaaaaatgttttaaaatagtattttctcccccgatttaaagaaaggaaagaatagagattttgtagaatcataaaatcatgaagtgtcagagtttacagattacaatctaactacttaatgttaaaaatgaaaagaatgagacccaaagaagttatgattttaaaaaattggtaaatggtagaactaaaaccatttcttattttgtcctctaaacattattgcatttctgaaaagtatacacatatgaattataaatggtagggtgaagtttgtataatgtctttttatagcaatcaataaataggtgactatgtcacatttatactgtaattctgatgcacacataatactttaaaaactgctaaacaagcatgtcagaaagacctaaattataacatttttctatattatttaataaaaaataataagatttttaaagcaattccctccacttgtgattgacaagatatactatgattccaaacagtccaatttttggtcaccttctcccacttgtgttagttaaatccagaatggggggaaaaataaaaaatctaattatattattcatgctagccttgtatgcagcattcctctgccccttactgagcctccctagaagctagaaagagccaatggacaactacatcacacacacaccccatatcctgatcattcatccctgaaattatgtattctttactcctataccttataaacagtagtgtaaattgtgtgcatggccaaattcataacacaaaacactcttaggagcaaaatagaaacctgcacaaaccctctggttttgtcaatgaaaacaaccttttattataaagtgacagttttataacttcaaaaataggctttaatttttatagaacatttaattcaggaatgaaaaatgtatttttatcaacccgcaaaaaaaaaaaaaagtgggatttttcatcagtgttgccagaggtgaaggaaatttacatggtgaatgaagtaaaaagcctatttcaactatcacagtaccttaaggatgaagaaaatagttttaattttggataataaatcacttttgtagcatttcaaagatcaagaaacttgcttatcaaaacagaatgtagtcatcataatgcaaagtcctcaggcaatgagaattgcagtaaaatctttttctccttttataactggatcaatatttttgagtatataagaatatgtactcattaaatcactttcacctactatatttcatatttgctacaaattacttaatgtcacaggagactggaagatctattttaaatctaaacacataagtacactatcaagtggacacaaataagcatacacaaagaaaaagctttttattcgccatcccaaatgcccagcattgctttgacctagttataaaaaccagagatttggttttatttcccagcctaagagttaattctgatgattttagcagaagggaatgaataggaatatagcattctcctaagacctcttgttcctgggataatatatagcaggtgctgacttcttgtgtgtatccctagttcccatcttgtttgagatggcaacagatgatatgttaacaatgaccaaccatttgccaaaatgtctttgcacatatttttctctggctggaaggtccttccctccctgctatattcaattaaggctttcttatccctcagtgttcagtcaaataataatgctggggtaaaattttctgaccaagctatatctcccaatgatatactttcattgttccatgtacctctgtacttatcctgttgttaatgtgtgattgatgaattaatatcttacttctccattatgatctccatcagcacaatgatcatatttatttttgctacttttgaggtctctggcttctataaaaggatgtgaaaacctagcaggtgttccatatatttatttgaaaaatattaaacatccaattcctgacattttgtccaacccagtatgtaggtgacttccacacaacctccctacttagagacttctgaaagagcaattgtatctcatactctgaaccatggatcatgaaacagggggtggtttttgagtggcagtctccagttgcaaatatataaatctaagcattacaatgaaagtgcttggagtttatagtgttaggggccacagatctgtaatgcaatttagatgtcagctgctagaatcaatatgaatgatcatatgctcaagagactcatgtaattactaagcattaaatgaatatgtaactttcatcaatatacattgtatttctttagcaacaaggatgttcttgttaaaatttacattcaaaaattgctatgcttgccatttggcagatccacaaagagaagtataaaatcagagacccacacataaggtataggtatcagtcacctaatggtatggcagcagtcaggtttgggaatacagacatctcactgagtttcagaaaggtgaatgtaactttcctccaatagctttatttatgccaaagacatagataaatatactgtatcacttaacatcctcatttaaaggtcctccccctgttgccatgaagatttgctgagcaaagagggaataacaatctgtgcctgtcaaaaacaaaatattcctgggaaaaataatccatttgaaaatcttatcctaaattttatcataaaattctttgcttgtttagttttcctcttctgtaggagagtctcatactactactattccttgatgctaacaggagacccaaatgtgactttcctcctagcaccaacactataattatacctcacctatgcctgatttattacttctatatcctccaaaaacggttctctatctcttgatatttgtaaagaatattatataaaaattataaggtaaggccagcttcttaattctctttttcaaagtatccacatctacagtatccgtatgcacagtgtctgaagcatagtatgtccctcataaatacttgattagtaaattgagtaaacaattataatagtagctttttagtttataaattcctatataaaggaactatatgctaagtatataagtggattattttttaggattatcatatgtgtcatgttttcactatctttgtattccagcagtgctgaatgactatattataactttctgttgctattaacattaatgctttattatcaggaaattcacaaccagaaatgaggagtacgggttaatggtcaaaatcagcagcaaacatttttaccattctaattgctgtcaatatattctgcttccttaaaagctctcattcacatttaaaaaattacacagtatatgaattttagtaaataaaattaattccttaataaatgaattagaaaaaattaagagaaatcaactcactccagtctggtattagctccaacactactcttgcttaagttatcaatgacttttttactgccaaacctaacggaaacttttcaattcttaacctacttaacttttttaaagcagcatttaacacaaacactcttcttaatatactatattcgcctggttttcatgacaccatattctcttggctttttttttaatcatgatttcccactcttgctcctttgggtcccagtttaaatgtcacttttaagtctttcctgatggccttgaactaatttgaattttcctctttaataaaactgcagtttaccttcatagttgttactaatatttcctaattttgcatattttggggggttgttacgtgtttaatgtctttaccccatacataccagactgtaatctccagaagagatagtactatgtttattttgttcagaaggatcttgcacttaattcaagaatatttgttcaatgattattggatagataaagagtcacattcctgttagtgtctttaaagatgcatatgcttttgctttttaaactcattaagtgcctcttatatgcttctctctacttcatgccctggcccctaaaccctgaaactggtttaaaataactcttagggggctagggttgcaatatttggggcatgcatataaaaacacacacttatacacatatatacatatatccattatttatctgaaaatctaatttaactagacatactgtatttctatttgttaaatctggaaactcatctgatcccatttactagtcaagtaatgtttccctaaaattgtgaaaatttggcttgtttcttaaatacaatactgtttcacagctctatagttaccttgcatgaacctttattttagcaatatccttattaagcttatatatatatatatataaaattgtcttttcagcaagatagatatatacctatatttatatcttcatatatatttatcaaatatatatatatatattttttttatttatatacatttcttgaaggtacttcttgtcctcctgaaccaaaagttcattactctctatcttgttcagccacacacagattcaaattatataatggataaaaattattcacatgtttttcaatgatcaaatcctcaaaatattgaggaaatgatttagcatttaatttggaaagccactgtgactccatgtttgtaaatgccatagttacctcaaatctatctttgtgttgcattctttctagctttccccttaagactttaaaaaattgttatttactctcttcttaaaaattatttttaattaatattacattggtaaatcactgtcatctgatatataagcttttatcacccaatgtaacactatcacactgaactagaatatttttcattctctcattgaaccatcagtgtttgaatttagtcaaagcctggaaaatgaatcctgagggaataaatacttcgcatagattaccttccagccaacacaacgattaacagacataaggcttgtagttacataaaacatctgtaatagattgcaaaatttctgcatttatccagtagtattcaaaattttacaaaatttttattttatgcatataagcattatctgaatctgttatatttatggatcaaaaactttaaatgatataatcaatcatgtttattctcatacaattaaatgcatttttgctatgatttttgttatttaaatgtaaatttacaccaaataaaaagccagttcaagaattttatcaatttcttctctctttttcagtctatatgaacttcattgttccaagacttgtaaaataaagttgaagttaaatgtatcaagtcaagcaaagtcagcgtactgtgactttatatttactatcctgtagttctcaaataaaggtattttcatttggatcatgagtttgacatctagaaataatgtgggtgggatgaaaaaagctatattatatttatttagggtggggagtgaagataatgaagccaagattgctggtataaataaaaatgaaacccaattaacttctgctgccagctgagcaaaaaagggaaaggggagggaaaaacgtattgctcttttgcttacccatttattcttcacacacacaagaaaaggaggagatatattaaatatgtctatcacactaatatcttggcaacaaccctaagagaacaattaacccccttcccactcccagctgaaaggaagaagcaaacatcatggtggcagccaacacgtagcttaaaaaggcatataacaacgaaaaagtaaggaatttaatgttactactctcttctaatgtgaatttggaaaagatgcaaggaagggagcacagaatgatgtaactgaaaatttactgtctgaacaagttttttttaaatttgaaatattttgaatttgcatttaaattttaagaatttgttgagtcatacattttatgaaaatataaaataaaattttaagaatgtgtattatcatgctcttgttctttatactgttgaataataattctaactagcacactaactaatgtcaataaaaattcaattttttcctgaaccattttttattaaattagctctatatttgctatatgccaatccatttatattttgggtttcttttagaagttatatgaaagtttttatgtcccctttttcctcctaggattttaatacactttactatattaaaactttcatcctaaaataatttttacagcttctctgcttagaaaaattgtaattgttctgttaataaatccaactaaaattagaaagtgaaaaatttaactaacaaataatttttgttactagttattttgagaaagcatcaaccctaagagtttacaaaactaaatatatgataaggaaaaaaatgttttatcagcgttggggagataatttcttcattgctaccatttacatgaggctggaataaattttctggctagaatctgaaaagattcattctatcataactgtgcttgatctttcgaattatgaaatgcctcattttctgtcaaaaataagtttgaatcattttattgtcacaaaagtaaacaaaaatcactagtattttgtcattcggcatgagaatatctatcctatagaggtaattaggatttgctgaaaacaatgtatttaatgtgtagatatataattttcatatgtaatatttatatattatatcacataaaatatttaataattaaattcatatatattatacaataaatgggaactttacattcaatgttttcctataggacacttttactattcttccctctctcactgcttccttctttctttctctttaaattatttccaaagttacatggtccctataacaggctgaatcctcagatgacccccaagaatcctgctctgtgttcaggctgtgtgtaatcccctccccttgagtgggtatgggtcatatgaatacactgtagtttcattcccagaagtatgttattttctgctgtttggaagatattttgcagatataattaatatctcaaatcagttgactttgatgtaatgaaaagggagattatcctggttgagcctgatctaattgggtgaatctttcaaaagtcagagagattcaaatcggcaaagatgctcttctgttggcctggaacaaagcagtcatgttgtcaactgtctacggaggaagctatatggctaggaccccagaatggcctctaggtttggagagcaaccccaggctgttggccagtaagaaaatggggatccttgtcctacagctgcaagaagctgaattcttccaacaacctaactgagcttagaagaggacatcagtcaccagatgagaactcagcactggctgatatctcagtttcagttttgtgagacactctgagcaggatctagccatgctatacctgtacctctaacccatgggaattgacatagtaaagacatgggggggggtttgacccattaaatttgtgataatttattacacagtaatacaaaacaaatacaatcccaatgctttatctaagtcatagaaattctgttctctaggaaagaaaccataattatatagttttaggaaaatttactaattcttatttctatccaatggagaacaatcactgataaacttgttacttgctgaaagacagtgataactttatactactcctttatatcagtctatctaaataccctcagagatatgtcatattagtctatgttatatagaacataaagttgctttttttaatctgtcttatcagtcttatcatataactgtcatatgcaaaaataaataaatggaacactaaaaagttaatgcaggcaagtcaagctcctaaattcatagaggttgaaattcctaaaaggactcacacattcacagcaatcaggaatatcatatacctcctttaagctatttgtggatttccattaatatgagggaacctagttcccacatggaaatggagatagattctaagaaatattttcacaggcccgggtgcaatggctcacgcctgtaatcctagcactctagaaggccgaggctggcagaacgcttaagattgggagtttgagaccagcctgatcaacatggtgaaaccccatctctactaaaaatacaaaaattagccaggtttggtggttcatgcctgtaatcccagctacttggtggctgaggcaggagaattgtttgaacccgggaggtggaggttgcagtgagccaagatcagaccacagcattccagcatgggcgacagaatgagactccacctcaaaaaaaaaaaaaaaatcatatagtaaaatggagattacaagcagcaataagcagcaatatgaacctcaacaaagcttcaggaagaataatctctacacatggaaagcagactcaaaacctgagaaagtcatgattcccacatcccctttttgttcagaaaaggggatatatgacgagctcttctatattcatgaggtgttaatctttcctgaacaaagctttgctaaatacatgtccacctcagtatttctttcagcttgtagataatcaacgattaatttgaatagttactttatatattgagaaccaattccttcaaaataactgctttcttactccttttttctcctcttaaccaatgaacattaattgagcatccagacactgcagagcaccataaaaatagaaataaagaaatacattataagtaatcaagtctttgaatggtgctatgtgctatttccttacctttagctttaaaaatccaaattgtttttatcaatatagacttttataagattaaaggccgtggacaaggaggagagtttaaatgaaacctgatagattactgtccagtataaaaaaaaaaagtcttatgggaactcactttgaatgaaaatcaatgcacactcacatagcataaataataatgagatttactgtgatgcgacagcatgctttggcattgtgctgtcagaggcggagagaactcatggctttctgccaatcaagctgagcttaaagggcatgtcgcaatgttcagatcatgttacattaatgaaaagattacacaaaagagaaacagatatccctgtttcaatattctatgaaaaattataaaatactccttttcacctccccctccttggtttgtgtgatctttcttctgatttctatatataaagctagaaagcaccataaagattttaaaaataatcaactttggcaactaatcctatttaactaaaataaaagaagtatagataatcatctaaaaacttctgatgggaaaattagaagaagatgacaaaaccagtgtaaatttctgtggaggttttcaaaccccaaacctgaactttagatgatttgagaattataaagtggtgaagcctcctcagagaactcaccctgtatacacagtattgagttatgatatatcttagagtacaataccatagagtggaggagataatttataattaaaatcacatatttccaatagaattatgaatcttcaaggtcttcaatggatattttaattcacacattcattcagcaagaacatttttatgggactattgtattcatagcactgcccagaattataatattggagggaggcagaagcagtaaagactattttcatcctgcagagcctaccatgtatgtgagatggcagataaaaaaaatatataaacaaaaaatcagtaaaccccaccttgctgctacagtgcagtggaaagcaaatggagaataagtgtgtgtccgtatagcaccagttatctggacagacaaacaaaacgtcacataatcaaccagatgatgatatatgcaatggcaaactgccacatgcaccaaagcttccaaattgtttattttttttctgtaaagtttagagtcatctagacaataaatttcaacaaattggatcagctaggctaaaaatttatgtatatgtgaagtatgctggcaagttaacaatgcctgtcgtaaaagaactggaatctctgtacttgaaaaatattgacaaaatgcccaaggaagaaagggcagcatgagctctgtgtattggcttggaattggacatatcagtatggattcatgggaagagagagagacagagcactgtaagtgtgtgtgacacataggtgaataatgtacagtgttgcaattaaggaacacagtctaatgtggaaaatataatgagggaaaccttaacaataatagagaatgacaaagttagaagagagggaaacagaaagcactgtagaagcagataattagaacaactaaccaagtaaaaggggaaaagagggctcagggatcattcaaataaaaaacaaaaagatgcctcggtgaagtctggatggactcaagtcagagctgagaaatggttggggatatttgttgctgatgggcaatggtgctctaggtagaaggaaacatatatgcaaaagtgcatagttaatgccatagcctgttccatttgaaacactgcagaaagggatgaaaatgtgggaagaagcaacagaaaggtactaaagggccagtaaatcaagctcagtatttaacttttccagtgaagtcaaagagggtcataagagtactgaagaaggggtgtgtcatagtcaggttcaattcacagacatctctctggcagcagaggcttagaaagaggtaagactgaagctagaagggaagtttagggctgttacagcttatccaggtgataaataatgaggatctaagcaacaataagtggttctggaatagaaaggagagaaggagagacttgctatatgtattattttacagtatttaatgtttgatttcatgtagaggtgagagtcaaggaatggaaaacgagtcccattttcctgactcatgccattctttggatggcggtcctattaaaatgataaagaatgtagagaaagaaggaagttataagaggaagattatgactgttggccaatacctaagcaaaatgcgatagaaatgcacagaatgaacagaaatcagaatataggctacaaccgccaggtgcggtggttcacgcctgtaatccaagcactttgggaggctgaagcaggcagataacctgaggccaggagttcaagatgagcctggccaacacggtgaaaccctatctctactaaaaatacaaaaattagctgggtgtggtggtgaatgcctataatcccagctactcgggaggctgaggcaggagaattgcttgaacctgggaggtggaggttgcagtgagctgagatcacaccactgcattccagcctgggcaacagcaagactctgtcttgaaaaaaaaggaaaaagaatatgggctacaacatggaagtctaagtgtaggtatgctgcaaaactattactttatccataataaaatatgctactatctcagttaattgatttccaatggattttgtattgtaacagattcaaaatttaaatgcaaaattggctttcagaggctattgaggtaaaatatatttttgtcaaattgccaaattcattgtcaaacaccatcacaaacatcatcaagaatattccattttcgaagtaattactgttttaaaatgttaaaatacagaaaatatgtaccacacaactgtgtctaggattcagatgaattcccctacttaaatgtatgacagtgcgtatggttttctgaacatatattttacaaaatctacgtctatataatatgaatcatactacttattcaggttatcttttatctgtctctccatctgcccattcatctatctactgacataactatttaaaatcaggagttataatacaaaagtttttcactaaagatcagcatgataaagagtctagagtctcaaaaatccaatgagcagtaccttcccaggaatcatagggaaatgatgtacttattatggaacttttaaattagattatacataagttgataccattaaataaactaatttgattcactgatacctaaaaaactttgcaaaatactgtcatatttacccaaatttaagaaatgttgagttatctttctcttgaatcttcgaaatacagttagagtatagttagggtgtagatatgaacaatgccagaaatgtttacctaaataccttatttcaatgatttggtcttccaaaagtaactactttgttgtttcagaaattttttcaagaagtgttacagaacatcagagataactagatatttcattacagacatgttttgaaggaacgatttcacactaagaatgaagaaaacaaaaatccagtcatctcaaacggacaaaacctgagggtgtccgaaaggaaaaaaaaaacaggttataaaaccttttcacttcatttttgacatgttttaagtcatttgtctggactcctgatgggcttaaacctaaggagacctggaactttaaaaagaagaaaatatttttctttccatctttcattacttcagactgaaacggcaaagtgcccatgaaggtgagtgccagaagcagcattaaaaaattggctcttgttaaatgccttcaaagaaacctctgttttcatcaggaaatggcaattacatggataacatggactgccaaggtttattctgaagaagagggatggtccatattgtggatattttccttatgtttattaacacttcataaacagtcaggtctgatagaagcatatgacaaaaattaggatagataagacccagaactatacatactgctgtttttttatccctatagtttttactcctcctgtagtaacacaactaataccaatatgcatgtatttattttgacaaagtcttgcaatcaactaggataaaaaaatgctttggttcatttttctactaacctttttcttcattatttatttaacaattcatttttcaatctcccttttaagtgaatacaccaactgtatgagtgaaataattttcttcatttaatctgaagcttttacttattgtttttatgaccctgaatgatcttagacatgtgtacttcgcctcagatgaaaggcagtatagcactgttttagattcgaatttcctgtattatctgtgtgacagtgaagaaattaattaaactctttatgcatcagtcttctcatctgtcaagtgggtttgataataatagtactttttttctcaagggctgttattataatacaataaattaacatatttatcaatgagttaatatatgttgtttttatatgttataaagaaacattatgaagactacataagtgtttcataatgcttaaatattctaaccttaatgggaaactcagtgtttcctgctctttgattccattttcaaagaagaaatgctgttaaataaaggctttgaaggaaaacaataaatctacttaagtagatataagagttttcaggggagtaagtaaagattttactttttactattattattattttgagacagagtcttgctctgtaacccaggctggagtgcagtagcatgatctcagctcaccacaacctctgtctcctgtgttcaagcgattttcctgcctctgccttctgagtaactgggactacaggcgcctgccaccacgcctggctaactttttatatttttagtagagacggggtttcaccgtgttagccaggatggtctccatctcctgacctcatgatccgcctgcctcggcttcccaaagtgctgggattacaggcgtgagccaccacacccggccgggagtaagtaaagattctaaatggaagtgaacagaatctcacttttctttctcttctactcacatagatagcatggtaacatgagacatagcagtgcctccctttgggaattgtccccatccttagaagaccaagaagaaaacagggtaagatccctgaagtatcatttgtcccttgcgctacagagatttttaatgcaattattaaaataaaattcaaaagcaacaaaagttaaaaagaaatacttactgtaaattctagacagaattggaagagatcttcagggcaatacttattcctgaatgcattgaaaagtccacaaatattataagagatcagaagaagatacaagttgggtaggtccaaaagagattggaatattcaggacatgctattggattccttttttaaatcactatttttgagatccacttttaagaataatattaataatgatataatgaccatgctttacacctgtagaatgtactttctagcaaaatattttacaaagaaaatagggttgagagagtttcacttcagggaaattcataaatcttgaaatccactctaaccccactcatttaggagaccaagacttatgtggtgaggtaggtaggagcaaaatttcatttgaaataactatatatgtatatatttgaaagctttcctataacacttataaagctcattctaagttatttttcatactattttcaaaattttaattcctgaaatgattacgttagcctccttaatggatatgtttttactgagtattatggaaaggcaaatataaccagtaagttgatattaagaaacataaggatctgagttctaaaataacaccttaaacatgccgattagacagatttatcattatcacacgtttatatttacttttattaaacactcaatttctgttgacttctttttaaaattttgttagaaagtaattcacataagagaatctcattgagatgcagcctcttgtgttctataatatgttggttttatattcccttttaattttatagcaggtttggccaaattatgagcaagtcaaataatttgaccaaagccaagttgagttggtaattctgtctacttacacttttgtgcatgtatttatcttatttgggagtttgcttctttctacatttgacttttcatttgtgattaaaagttatccagagttctgtcctaaattaacagtatttctctagatgtttttgtatatgtctctttgcattatttattattattattattattattattattattattattatgctttaagtcttgggatacatgtgcagaacgcacaggtttgttacataggtatacacatgccatggtttgctgcactcatcaacccatcacctacattaggtatttcttctaatgccatccctcccctagcccctcaacctctgacaggccctgttgtgtgatgtttccctccctgtgtccatgtgttcttattgttcaattcccaattatgagtgagaacatgcagtgttgggttttctgttcctgtgttagtttgctgagaatgatggtttccagtatcatccatgtccctgcaaaggacatgaactcatccttttttatggctgcatagtattccatggtgtatatgtgtcaccttttctttatccagtctaacattgatgggcatttgggttggtttcatgtctttgctattgtgaaaagtgctgcaataaacatatatgtgcatgtgtctttataatagaatgatttataatcctttgggtatatgcccagtaatgggattgctgggtcaaatggtatttctggttctagatccttaaggaattgccacattgacttccaaaatggttgaactaattacactcccaccaacagcgtaaaagcgttcgtatttgtccacatcctctccagcatctgttgtttcttgactttttcatgatcgccattctaactggcatgagatggtatctcattgtggttttgacttacatttctctaatgaccagtgatgatgagcttttttcatatttttgctggctgcataaatgtcttcttttgagaaatgtctgttcgtatcctttgtccactttttgatgggtttgtttttttcctgtaaatttgtttttctttgtagattctggatattagccctttgtcagatggatagattgcaacaattttctcccattctgtaggttgcctgttcactctgatgatagtttcctttgctgtatagaggctttttagtttaattagattgcatttatcaattttggcttgcgatgccattggtgtttgttgttttagtcataaagtctttacccatgcctatgtcctgaatggtattcactaggttttcttctagggtttttatggttttaggccttacatttaagtcgttaatccatcttgacttaatttttgtataaggtgtaaggaaggggtccaatttcagttttctgcatatgactagccaatttccccaacatcatttattaaatagggaatcctttccccattgcttgcttttatcaggtttgtcaaagatcagatgattgtatatgtgtggcattatttctgaggcctatgttctgttccattcatctatatatctgttttggtaccagtaccatgctgttttggttactgtagctttgtagtattgcttgaagtcaggtagcatgatgcctccaggtttttgcacaggatcctcttggctatccgggctcttttttcgttccatataaaatttaaagtagttggttttaattctgtgaagaaagtcaatggtagcttgatggggatggcattgaatctataaattactttgggcagtttggccattttcaggatattgatttttcctatccatgagaatggaatgtgtttgcatttgtttgtggcctttcttatttccttaaacagtggtttgtagttctccttgaagagtccttcacatcccttgtaagttggattcctaggtattttattctctttgtagcaattgtgaatgggagttcactcatgatttggctctctctttgtctattattgttttataggaatgcttgtgatttttgcacattgattttgtatcctgagactttgctgaagttgcttatcagcttaaggagattttgggctgacacgaaggcgttttctaaatatacaatcatgtaatctgcaaacagacattttgacttcctctcttcctatttgaataccctttacttctttctcttgcctgattgccctagccagaacttccagtactatgttgaataggagtgatgagaaagggcatccttgtcttttgccggttttcaaagggaattcttccagcttttgcccattcagtatgatagtggctgtgggtttgtcataaagagctcttattattttgagacacattctatcaatactagtttattgagagtttttagtatgaatgggtgttgaattttataggaggcctcttctgcatctactgcaataatcatgtggtttttgtcattggttttgtttatgtgatggattatgtttattgatttgcgtatgttgaaccagccttgcatcccagggatgaaaccaacttgattgtggtggataagctttttggtgtgctgctggattcagtttgccagcattttattgaggattttcacatcgatgttcatctgggatagtggcctgaaattttcttcttttgtggtgtctctgccaagttttggtatcaggatgatgctggcctcataaaatcaatcagagaggagttcctctttttcgattgtttggaataatttcagaaggaatggcacaagctcctcttaatatctctggtggaatttagctccgaatccatctggtcctgtgccttttttggttggtaggctattaattactgcctcaatttcagaacttgttatcagtctattcagggatacaacttcttcctggtttagtcttcggagggtgtatgtgtccaggaatttattcatttcttctagattttctagtttattagcttagaggtgtttatagtattctctgaaggtagtttgtatttctgtgggatcagtggtgatatctcctttatcaaattttattgtgtctatttgattcttctctcttttcttctttattagtctggctagcagtctatctattttgttaaccttttcaaaaaatcacctcctggattcattgcttttttgaagggtttttcatgtctctatcttcttcatttctgctctgatcttagttatttcttgtcttctgctagcttttgaatttgtttgctcttgcttctctagttcttttaattgtgatgttagggtgttgattttagaaatctttcctgctttctcctgtcggcatttagtgctataaatttccttctaaacactcctcctttggaggagaagaaatattatcacttttggaattttcagcctttctgcgctagtttttcctcatcttcgtggatttatctacctttggtctttgatgttggtgacctttggatggggtttttgtgcggacatcctttttgttgatgttgacgctattcctttctatttgttagttttccttttaacagtcatgcccctctgctgcaggtctgctggaatttgctggaggtccactccaggtcttgtttgcctgagtatcaccagtcgaggctacagaacagcaaagattgctgcctgttctttcctctggaagcttcatcccagagggccacctgccagatgccagttggagcactcctgtatgaggtgtctgtcgactcctgctgggagatgtgtcccagtctggaggcacgggggtcagggacccactgaggaggcagtctgtcgcttatcagagctcgaatgctatgctgggaggtctgctgctctcttcagagccagcaggcaggaacatttaagtctgctgaagctgcacccacagctgccccttctcccaggtgctctgtcccagggatgtgggagtttatctataagtccctgactgtggctactgcctttctttcagagatgtcctgcccagagaggaggaatctagagaggcagcctggctacatcggctttgcagggctgcagaggactgtgcccagttcgaacttccaagtggctttgtttacactgtgaggggaaaaccacctactcaagtctcagtaatagcggacgcccctcccccaacaaagctcaagtgtcccaggttgacttcagactgctgtgctggcagcatgaatttcaagccagtggattttagcttgctgggctccatgggggtaggatccgctgagctagaccacttaactcctgggcttccgccgcctttccagaggagtaaacggttctgtcttgctggtgtttcaggcaccactgaggtatgaaaaataattcctgcagttagctgggtgtctgcccaaatggctgcccagttttgtgcttgaaacccagggccctggtggcataggcacccaagggaatctcctgttgttgggttgcgaagactgtaggaaaagcatgcatttgggccggaatgcaccattcctcatggctcagtccctcatgattttccttggctaggggagggagttccctgaccccatacactgctgtggtgaggcaacaccctatcctgcttcagctcacccttcactgggctgcaaccactgtctaaccagtcccagtgagatgagccaggtacctcagttggaaatgcagaaaccacctgccttctgtgttgatctcgctggaagctgcagaccagagctgttcttatgcagccatcttgctagccacctgcattattatataaatttcaaacttaaatagtttttaaaatgaagagcttgattgaaaactatatattatattaaaactaaataaatttataacatagcttttccaaagagaatatggggctatatctcacattttcaaatgagtctcagaaccatgagtaataagaaataaaaagatttcataatttttaagcaacgagtttaaaaattttaatggtaaatgatacagctatcagcaagacttttatgttgccagcaattttttttttgtttttgtttatttttcaggcttcctatatctcatgtcaaatataatggcttaaagaatctgaaatgtaatattcgggtcttatgtagagtgctaagtatacttactcccaaaaatcttcatgaaaagaataattgaaagaaaactgaatttggagtctgggcttcaagttctggttcagttcaaacacttattaattaatggcctttattaaatcccttaatatcactgagatttaatttcttttttaaaattttttaaagagatagggtcttgctctgttgcccagcctggagggcagtgattcagtcatagctcactgtagccgcaaactcctggatgatcctcctgcctcattctgaagtagataaaactacaggtgcatgccatcatgcctggctatatttttttatttaaaaggcaggatcttgctatgttgcccaggctggtctcaaactcctgggctcaaataatcctcctgtctcagcatcctgagtaggtgagatgacaggcatgacccatcacacccagctagatttaatttctacacatacaaaaaggagtaattgcatatgccctacatttctgacatggttgtgtgaatgttacatggtacaatttgtagcaaagtgttttgtagggagtaaatcaccatccaaaatattatcaaaatagtgatttctacctcagtcgtgttcctaaagctactcctgaaggtaattttcatcatcttcctctgaactagtgagaaatttttaatgtggcttccagtcccactgctacttattactctcaagctatctgactgagctgaaatctattcaaagtacttccttgctggagaggattgcttttattcataatctcaggtctgtctccacttgaaagcacaattcaactttattaggaggtttttgtaatgataatgtggtatattccttcagacataaagaggtatgaaatagaaaattatgctaatatataaaaacaaaagcaagagaaagacaagaatgtttttatcctgtcagaactctaatcctaaaggaattaaataacaagctttttagagggggaaaatcaagttaaatcgaaaatattgttatacattaagaggcaaactaatacacaaagaagtaaaaatgggaagtagcaggatcacctaacaagaggttctaaaatccaaatcttagattaaaatgtgcatattgttacttctgtagctatggttagacacctgagtcattctgaggtgcttattgtgaaatcttgtactgatactcgtagcaaattaaatgcgtcttatttgatctatttgatcttccatgaggctagggtaagattaaataaaaagaccatgaatgtttgcttttgatggggttcagcaacactatcccaaaatatggtaccttggctttttagaaaaccgcagaagcaaaaacgtcactctcaccttcccctcacctttctcctttgaagcagatcataacacacttattggagaggtgcccttcctattctctaaggaaaagaatatccttatctctaaagacgaagggggcaggagctatggttcacgtctgtaatcaaagcaccttgggaagccgagatgggcgtatcacgagaccagcctgaccaacatggtgaaaccctgtctccactaaaaacacaaagaaattagccaggcgtggtggtgcacacctgtattcccagctactcaggaggctgaggcaggagaatcgtttgaacccgggaggcggaggttgcagtcagccgagccgagatcgtgccattgcactccagtctgggcaacagagcgacactctggctcaaaaaaaaaaaaaaaaaaaaaaaaaaaaaacagaaaaaaaagaaaaaaggacagataattaacagaatcaacaggctgtgctaagttccccccagtttattgccattagatcatatcgtttgcctttcagtaatatttgtccacaactgtcccttctttatcaaacctaagcataaaatacacaagttcacatctttgggtcttgatgttaaaagccttccatgtcttgcaagacggacatttctcttattagtctgcctcttgttatagggtcctcaaccatggacatagtaatggataaggaaataaattttttcctctcctatacttcaaattatctaaccatggagaaaattggtgatgggcatttgaatgctttcttgaaatcagatataaaaatgtagatttatttccaggaaataactagaaattaaacttatttccaagtaattaataaaattaaagcattcagggctatgcatactgcctcatgcctgacattccagctctttgggaggttgaggcaggaggttcgcttgagcccaggaggttgaggctgcagcgggctatgatcatgacactgcactccagattgggtgagagagtgaggccctgtctcaaaaataaaaaaataaaaaaataaaaaaaattttaaaaccattcaaacagtagggaagagaaaaccttggaaatggattcaaatctttatactacatctttatataacatctatatataacatcatcaaaatgatcttaaattgtataaagcatgtatatgaaacaggtccaagattttattaacttacccacactatattaagaaacatttaacacaggtaataaccacattgtataatttcatctgattgttaatattagctattatcttagaaactaataataacaatgtttctatccacagaaagatgtaacaaattccagtgcatgattctgttgcttttcccatcattggctttggtgtgcaatatttttccttggtaattattttagttgagtattttcaatatttgcgaccatatcttttagttatttgacatactgtctaaaatcagtaattttattgctttggtaaatctacctattatttctattttccatttaaaacctcaacaaagtaagtgtttgtatggcctagagcaacttaatcttattttcatcatgtttctatttaatgtgtatatgtattttcatgtgccatgtgaattgattcaacatattaataacaagatgatctaaatttattatataagtaataaaggctaaacatttatcaacacaaatgagtccactagaaataggagtcataatttgatgaatgaaaaaaaattcaaatatgatttttaagccataaacatttttatactaggacattttatatgctatagattaaaatatgaataatcatcatcatattggttttacatttccaagttaaacaaacctcaatctcaacataacaagatgtttagcctaaaaccttacaattttatatacctgatttaaatcagattcaagtaggcaattttttccaattatattaaggaaaacattcctcttgttaaagaagagaaagcattaatatttaaaagacatagaatattttattgatttgatcaagtagttccgagtcctagttataattttaaaatatcttagtaacattttattaaaattcacctagcatagacatatgaaactaattgatactatattttattaaaacatgtacaactttacacagtccctatgaaaataactttagagtcataaagataataatggtaattataataaacaatctctcatctcaagaaaatagtttgctttaaacccatcaagatcattagcccataaacttgatcttattggtagaaatttccaatgagaggtgaaaatgtagcttaatattaagcagggaaaaataagtgaaagtgtattgataagttttgtcaatttaaaataacacagagataatccttattcagttatagcatgttaccatgagtgaaaaaacaaaaaaaaaatacactgaattctcaaatttgtattaaaggtggcacagcaggttgtaaattttaacataagctggtactgcatgttttgttttttagcatttaaattgtggcactacaatttggaagctgtgcagcttgttactccaagacaaatctcacctaagaggatatggcagccttccacactgtggtctgattgcattagaccaagtacggctaaagaaagaaatattttgacaggggagattgcacttgaacacatcaaagtgtcagttcagatatgtggcatctgaaaagcaccctccccttttccccattgcatgaaatttgccacctctcattgtctcttccagatggtgtactgagttctcttcagctttattcctagagagctcaagttgacatcaatctgttatgccattttcttgtaatactaatgtggcttatttatcaatgccaattaatcaatggcacagaacgggttcttccttagcagctaatgttgtttcatttttttaatattcaaaaaaaattttaagggcagcgaccagattgggaagccacgcatctggcagactgtggccacttaggaggcattcaactgatgtaaagatgaagccatttatttcaaaatatgattaagaagcatattgggaggttattatttctagcagaagggtgagagtaattctgtgagataagaagaaatttaattgttttgtaataacaaatcatgtctgtcttcatgaccttgtatcaccatataaagaaaaagaaaagcctatcatatctgtaaatttttagctttttattaatcttactgcagcatcactgcacaaaagatataaagaagtccccacatctactacagttatactttatcactgtgatcttctttttttcagagtaaatatactgtaggataggacttatataataagagatacccaaaatgttataatattttcaggcaatctagattactgtaatagttgctctgaatttcagttctgggggtcatatcccaatcacctactttgtgggccctagaattagggcaaaaattacataagatatcaaatgatgccaccatcgatggaataatagctattgagccagattccccaattcaaacaagaaaaagaagaagaaaaaattactatttagcatcagtaatttggatctaataaacaattataaaaatgatcttaatgatccctagttccttcaagtagcttatcaacctcattatagttgtatgaggaaaggtgtactttgaaaacattagaatggaatatggtattcaagttaatttagtgtaagcattctaaaatcaatattttgtactatctacttaatattgattatgtacacgatcttctaggggaggtcctagcagtgtaaaaaccttacggtttcaacaatatgataaagaaaatatgagagaaagagagactggtataattcattaataatgaataatgggcatattaacaaaaataatttttcatgatacatagacatttatgaggtatgtggaagaaaataaataatgaaatcattttttttccattgtaaatcaacctcataagtccatcctttttacccctgacttccaaaggcaacacggaggaagtctagccaaaagactgttagttttactctagaatttgacacaaaatgaaattcacgggtcatgacaggagcattctgacaagacatacaactgtgatcttgcctttgaaaaactctgcaaggcagaatttgagatcagaattaactaaaaatgttaaaaagttggggaatgggcattgagaaagtaatttctgctttacaacaaccatgcccatcttaacctgtttatattttcgagcacttatataaagagagacgtctaggagaaaatatatttctctaaaccttctatttcaccatatgttttatttgacccataaactttccctttctcaaactttatcatttccctcatgatttgccattcctctcaccttgcaccaaagcaaagaaaatatcttttcagattttatctatcttctacagtctggtttaactttcaattcttccaaaaccttgccagagaatcccaatgatctcatcccactttctaaatatgtgccttgtttccttcctctataataattaatatgttctagctgacattaattaagcacttaccacgtgccagacacacattcttacaagtgatttacatgtatttcctcatttaatcctcacaacaacccaatgaagttgggttactatcatctcccttttatagatgttaagggagttttccaatgttatacaagtgcagagccaggatttgaatcacagttattttattgtagaaccataaaaaaactctcagaagtctataaattatttcagtaaaactgtgctttaaaaacagtgtgtatattatcttttcaaagtaacattttcctgattattaaggaaacacacacttatcatagaaaatttgaaaacatctgtaaaaagagttgaaaaaaaaagtattttataaatcctcctcctgactagtattaggtcagagtattttttgggtgtattttgaatgtggatgtatatgtgccaaaagctttgtaaaatattgatcacattgaatatataaactggttttctacatttcctgttactatctcatgaaaattttccttatgcttgaatagttttgaaaaataattttgataatcgaatggaagctatcctcctataatggtaagtgagtaactcaaacagttctctatgtggttgtcatatattattaataacaaaaggttatatcagatattgacgttaatattattcatattgtcagtgaaatcttcttgccaacactgggatgaaactgtagagaaggtttaattctactgtaaaaggtgaaattatatcacagaatcacaaatgattttcccattatggaaaaacatcctgagaatgtcacgaaggcctgatatcaactgctgtttccaagagtttagaaaacaactgtcaatgttcctatccagagagaaatctggattgtgctgccaatcttataacctggccctcaccttgcttacagcggcttgtcaaggaaagagaaaaatcccaaaagagccctttgctctttttcttgtgctctctgagatactcccctttccttctcactatttacaaaagggagatgggagaaaaattcagggataatgtattttaaatgatttctatggctaagttaaatgttgtggggggtgtaattttcaaaggatgtaggcatcctgagtcaacaggctttgcatctgccagtgttcctttgaaaacctcaggagagtctttaaaagcaaatagatgatcctctatgggagccggcttagatatgtgctgtctccaagagctctgtaaatgtagattaactgacctctctgggtccttctcttaatcccatgctctgaatatggaaatgacagttcacgtgtatctccaatgcaacagtcaaataaatttaacttaaaggaattaatttatgctaataagactttcagcaaagatgagaactgtaaattgctttgttttaaaagcttgaattaattggattaatatttcattttaagcagcttgaatacggccacatgactaataaatgtgcatgaggtaaaatctattcactgagtgtactattccttctcaaaaaataactagcatgttatctacattttaataacggaaatcaacattgcattccatttatttattcaacaaatatgtattgaatataattaaatgaaaaagctctgttgagtttgcaggagatgagaaaatgaatatgatgtaatcaagtagcttacaagttagtgcaagaatatacacaaaatacaagttagaaagagatgtcatgaaagatgtagcttaaaaataagtggtgtgcagaagatgagaaataattgacagctctagaaccagaaagggccttatgaagaaagtaatattccagctctgtcttgaagggaattagaaacgtgatgctgaggaataagtactcaagaagagaaaaaaataataggaagaaaggcaccagggaaggaaatctttagtgtaaatatagacagcagcacagcttctttacttcctatgtgactaaatttcttcaggtgcacagtaagttctcccagtatttaccatctaagttatttcctgaatttcattcagtgtttttgggaatgccttatgtctcagtttcctcaactgaaagaaacctataggattagatgatttacaagttctttctggttcaaatctctgaaaatgtgagtcattcaaaaatcatgttgattaaattgataaccaaatacttaaataattttagtatcaataaattataggaaataaaattatttaccaagagaaggcaaaataaagtgatagtttgagaaaaggcaaaatagagaattattgtgtcattgctgttcatttaaattctgaagagatatggatgccttattgtatcttccaattagtatctgatatttaccacaacctatgattgggacctgaactaaagcatctaagtagatataattcttctgtagaaaacatttagaattgcacctttatgccctcatctattacctctagtggaatgttatttgtgttcccttttcaaaaaaaattactgctttatgagtaaactattaatatttcaaaactatttctaaagttttccccctgatatttggggttaagagatctgtggctgaaaatttctaattaatgttgtcatgatttccagcatatttttatttagaaatataagtttgtgtggtaaaattattagaattggttgaaaatatttgatgtatctacttgcaggagccttcaacatacattcaaaaatttgcttgtctagaaagcaattaaaaccaaaaaactagtttgttttctcatttaatattttatcatagtactttagaaataatggtgtattaggccgggagcggtggctcatgcttgtaatctcagcactctgggaggccgaggcagacagatcgcttgaggtcaggagtttgagacctgcctgggcaacatggtgaaaccccatctctgctgaaaatacaaaaattagctgggcatgttggcgggagcctgtaatcccagctactaaggaggctgagacatgagaatcacttgaacctgggaagcagaggccgcagtgagccgagatcacaccactgcacaccagcctgagtgacagagttaggcctcatctcaaaaataaaaaataaataaaaattaatggtgttttaaagcaaattatctacagtgattatcattgtggtttgagtttaagaaatactggagatgttaatttaaaatgtttatagtatacacttctgcatggcttgaattttgtttttacttttgtgattaaaaaatcaataaaattaataattaaaataatttaaaatatagatcaacaatttaatgaaagaaatatgtgtttagtgccttcataatcatcaaaattaaagaatttacttgaagactttttgagcctatgccaaatttttgcgtttacatacatgatcattttaaggttccatgtggtagagctttatatgcacctaatatgccttttccttaatttgggctttgctaaacacaactttttgtgtcctctgacaacaggtaagtgttcttgtctagaaagagtatatacttggtttatggcatggctataataaacggctgagttctatactgtcaatgataaaacttggtctcacatcaatataatggccatgctgtatatgattcttaactgtgatatactttaacaaaggcatctacctatgctgcctcaaattaagaagttttcccaagtccagactacaatcttggagttatcctacctaggtcaccacaaatttaatccgccacgttaagagaaaatttaagatgtgagaaaaataagtaagatatatgtagaaaggtacaggtactcagcattgtcatcaaaattagctagattagtactaaacggttgctcaaaatgtcaactatttcagctttagattggctgactgctgctgattcttaggaaaaaaaaaacaggtttattgatacatgattcttagtaaacatccttagatgactgagtttctttttgctcaccaacaggagctatagtatctgaagccacctattaaatacatttctattttctcctgaatcttttggtcatatttatctttttcttcaaagtaaaatggactatgcatataattttgggagtggggtattccattacatagtcaaatgcctgatttctacaatgtaattatatcgtttctaatttatatttggggttattttaacaggaactagaccagcaacagaccttcattcaacttgctattagcactcactgacttggcttattgtttgcgatgaagcatagtaattaggtaaattcactgtattcctgataatcatcaaaatattggtgggctttgatttcctgctcagaaaagcaaggaaggtacaaatctcccacatatgactaaggaaattgtgtaaactgtattatttattcatacatatatatgtatgtatatgtgtgtatgtttttatataataatggagaatggaatgaaatttaaaatgtaggaagactctagataattaaatttatatagtaaaagatattgtgacaatcaaaaggaaaaatatcattcatgatatagaaaagataggttgaaacatacaattagctagagggaaaagcaagcagtttttgtctatctttttagcttcatgtcattttagtgggagaacagtaaggcaataaactaaactgacgacattgcaagggagaaaagtttattaaaaacaccatagaattaaaacaaggatgttttaaacagagaaaagttactgagctgctgaaagctgctgcccccacctgggcattaaacaacaagaacttcacaacttaacagctttctctatatttgtaaaattctaggatttctcatttatgggttaagccacaaactaataggaagcaaacattgtattatgcttgtcaaccaatatacaagctgacctcagaaacactgcatatgaaaagaaatcagccgacattttttcttatttatggcaaatcaaatactgacttatgtatatgaatatagtaaagaagcttgacaatgtcaaagagcttatatgcaattggcaagggaaccaaaatcagttgcacgatgtaaaggtttgagttgtagatacccacctgataccgtgtatatgtattgcaagataaatatgcataccattatcaatttaatcattgaacctaaatctaacttctgttcatacaataactaattaaatttattggggcttaattctttcaacatcactacttttaagaaaaatactttagatgtttcctcctttgttgtatcagctgtaatgtctctaagctttagttttctttttattttcatgtctcacaattatatttgttatgggtttctatttcattcattgctacctgctgacatttgtctcagctgtgaatgtttttacctatgaaagataatctccttaaacatctattaatttacacttccaactgggtgtggagtttccaaccttatgtaattgtgagcaaatctgtaaattagcactaagacaactgttacaagtataaggtgtttgaaatttctctcaatgactttttatggtagttttggctgctcaggaacctccttatttgcttcctcatttatactctgttctagataaatgagattgcgagatatttaacttcattgagtaatgaaattatattttaaatttgggacacaggattaataacaggaaacatcagacaaatgtaaaatgataccatctgaattgataatattccaataacattcaatctaaattcatgcattcacttattcttccatgttagacaaacaatttttgaatgaatgaattcaaacatcttcccttcacgttctaggcagaccacacagagccctgttgttttctgtttttagtcaaaaataaataaataaataagattatggtgaaaaaaaaccatgctatcagttcacaagggtaaaaagtaaaagaggaaaagccctgctcccctgttttcttatttccatttgtcaaaattaaatactactaacacagttatttttaaaaagattttcacaaataaatagtggtgtgaatttctgatattgactgagagattttgcaacaaggggaagttttaaaactctggcacacaattatggagttagtttgtttatcaaatagtctagggctggcaatagcaactaagcttcaagttgatgggtacaaaattatttcaaattttctgagttgaaaacttgttattctattgaggatatacttgactcaatctaaaatgtctttacatcctgaattccagtaagacacaaaatttctattaggaagaattatatatacagtttgctttttatttacaaaaatgctcttattagaagcttattgaaaactgccatattagtctaagaagttaaaagcatccagcatgtatacattcatttatttattcatttatttgataaacatttattcatatttaatatgcagcaggcatcattctaggcacttgaaaaacagcagggaataaactaaaaacataatccctgtcctcaagtacctcatatcgtagtgagaagagaaaacagacacgataggtaaaacataacatgcttttgacagtagtaaggaataaggaaaaaataaaaagcaaaaatgaggatcagtagctttcaggaacttacaagttttgattggaggacttttgggaaactagatgaagaaagtgagagaggaagccatgcagacatatgacagaaaactatacaggcaaaaggaatagcaaatgcagatatcctgaggtaggggtgtgcccaatatattttaggtattttttaaaaaaaaggttaatacttcagaagaaaagcaagcaagggtgaaatggtaggaaatgaatttagaaaggtgacaggtggtcagaccatgtagttatttgaagatccattgctggctgttagtcaaaaagatataggaagccatgggaagttaaccactaaccagaggagtgccatggtctgatttacattttagcactctagcttttatactgacaatggatcacaagggtaaaaacaagactagacagaaagccactgcaaaaatccaagcaagtgagaagggtagcttttacaagggtaatgacaatggaggtgttgaaatgtggttggattctagatatatttttaaagtagaacctcaaaatgtttggcatgtggataagggcagtgatgagaaaaggtcaaagatacgttccaggtgtctgacttaagcaactaaaagaatctatttgcaatttactgcgatgacatataaatttgaggggtcatttatatacagcattaaataaatcacgacgatggatatgactgtagatagaaaaaaggtatcctagaattaatccctgtggggaactccaacatttagaggtagaggaggtaaacacaaatgaatgaaagagattaagaagagcagaaaggtaggaggaattttggtgtcatgaaagccatgttaagaaagtgtttcaaaaagaagagaatgaccgtctgtgtcaaatgctgctgatagatcaacgaagactaaaactaaaatgtaagcatgccatatgaaggtcattttggactttggtaagagtcattttagtaaaatggtaaggtccactggctgactggagtgatttcaagaaaagatggaggagcaaaattagagatagtgaaattcagctagacttctaagacttgttttttcttggaaaggaaagaaatcaggatgtagccaggggaaaaattggggtccaaagaaagtttttaaaatactggataaatatcatccttttatgctgatgatcatagaggaaagaataatgagacttttagacagacaggtcatctataataaaaagagagaagatagcatatagagtcacagatgctatcacttacacatgtaggtgtgatggcagaagcttctattccaatgcagacatatgtattgtaaaaattaaaagttgaaaagtgacacatatctttagagtatcatctacagacattagatgctcagacacataatcaaaagatacattacaatgagtgagcatcttgtgggaaaatttgcataacatcatttgcatttcttctaatattcatgacagtttgacatctacatcctatgtttacattgagaaaagtcgtcagttatatattacatgcttcattagcttacttttcttagaatcaaatgtctgtagatttattctattaaatgtgaataaacatcatgagtagcagtcgccaaagtgataccacataatctgtaatcgttctggggctccttgactaacatgttcaattaaaagttgttacaaatttcctggtaaccctcttattttgtatatgaatttaacaaagcaataaaagtgagatgggattgaagctgtaactacaaataaaaattaaatatttaataatgctgaagtaaatgaaaattgagtgaacatctcaggtagttattatatgactacattttggtgcatttttcttgatcttatcagttttctcattactttttccattacattaaaaaaacctataataagtaaatttgcttctcttcttcatcaaaaccagttcttctcagaatttcatgttcataggaatcacttaagatcttgttaaaatgtaggttctgattccgtagtctggagtggggcccatacttttgcatttctaactagatttcaggttttgcccatgcagctggttagcagaacacacttggaaaacaagggtctaaaccactctgttcttggcatttgtgcagaggttgagataaattaatcatttcatgcctaatttttgggttgccgttaaaaagttagttaagtagttaagtaaagtcatatgccagttaatgaaggggatatgttctgaaaaatgtatcgttaggcattttggtcactgtgggaacatcacagagtgtatttacacaagtccacatggtgtagcctactacacacataggctatctggtataacctatcactcctagcctgcacacctgtatagtatgttactgtactgaatactgtaggcaattgtaatacaatggtatttgtgtacctaaatgtatctaactaaacacagaaaaggcacagtaaaaattcagtattataatctcaggagaccgctgtggtagaggtggtcagtcattgactgttattatgccacacatgactgtaaaatttaaaaaaaaaattagttgattatcaatatgtatattcctagaagaccatataaataacatacaattttaaatcctacttaaaatattatggcctctaactaaaaacaaataaatacattttataacaattcctcagtccaaacgtatttgctcattattttatttaccaacccagtgcctaatttcataccagcccactcactaaataacaaaaccaaaggaatgaagattaagttaaaatgcggacagctatgttgaatctgacacactgatcacaccacagaggaaacaaacaactcgaatagtgttatttaaaattgcaatcctgtaagtggcaatgaacattttgctatgactatgctgtgctgttttccccacacctactcccacttgccaggttagactggctcaatctgctctaccgtgggatcacaatcatttgaacaaaccccctcagggcagtaatatccaggcagccagtgttgtctcagaagagctcctgacaccattccccacgaatccgtaattttgtttatgtatagcaaaagcatggcataggaaaaaagacagcatgccactgatgggaaaacttcctaacctgctttcacaaagcactaagatctctctgaaatattgtgaatattcaggatgtgcagtgtttatgcattaaaagaggataagggacatgttgtaaaggtctgatttcacaagagtcattctagatggctagttatacaaaccactcttacagtttaagatttaaataacagatatactgtaaatactttgttatagtgtgagagatactctctgagaaagtctaactttttcaaaacattcagatgtcacctaagagccgagtaaggagtaattcattctacattacattatttcacgggtatagtgttatatcttaatccacctttatacacatgtgcaaacacatctacttatgcatctatccatattatttagaccatcaaaggaggtagaagagagttcaacattttataatactttcatccttctcgctgttgtgcattaggctgtatacctgaaaatcttcatattactgaatactgtactattaagaggaaaaaataagaataatattttaccacaatgactatgcactatagcaattttttaaaatttgaaaaatatatgtgtgtatatatgaaagacagtaagtgtgctgggggaaagagtcattcaaccctttttaaagtggctaattcagcaaaatttcattttctaactaatgtaactccaatttaaaaatccataatattatactacaagggcacagtttacctaatctgccaattatgtttgttgtacaaaagagaaacccagggcaaatatataaataaaacaatttgtatttttaagaccaaatagtctatcagttcttgctgtaagaggtacaggtttagtgttccttaaccaaaatgcttggggctggaagtacttcagagcttcagattttaggtttttggtgtgtgtgtgttttttttaaatatttgcattatatacacttactggtagagcatccctaagctgaaggtttgaaatctgaaatgctgcaatgaccatttcctttgaatgtcacattggtgctcagaaagttcagatttcaaatttttggacgtgggatgctaaacctgaatttaaaaatatattaactctttcaaatcactgggtaggtgcacatagaatactttgtgtcatttttttaagggactgggtctccctctgttgcccaaggtggagtgcagtggcatgatcatagttcactgcagcctcgaactcctaggctcaagggatcctcccacctcagcctcctgagtacctgggactacagaagcatgccaccattcctggctaagttttatttatttattttttttttacaaatgggggggggtctcactctgttacccaggttgttcttgaactcctggtgtcaagcagtcctcccatcttggcctcccaaagtgctgggattacaggtatgagccactgtgctcaggtttgtgttgtttaatatagattacatttatttattctgccaaagacaccattgatttttgccatatatttctcatctgattctcacaagcactttaataacatagtaaatgaaaatattgctttaactagcaatttttatgaacattaatttttattaacataatataaagcactagtatttattatttttggtttgatgagtcagataatttgccttatcatcgtcatcattttattatttaaggaatcatatcagttgcctcttgttggactgtaatgagttaggtcaaaagaaagtgaatttgatagtcagaaacaagggactgtagatctgcattaccaaaatggaaatgggaaaaataagaaagttacatgcgttcttttggaaatctctttcagaggtggaagggaggtggtgttattaaacatttattaaggatctgcacatattaagcactatgctatgtgctttgtttaatttacctaataatgccctgagatagttactgtcatccttaaattataggtaaaacaaacacagaggataagtcagtagcctcgcatctctgggccaatgaggaacagaaccaagactccaacctggatctacatgattttaaaacctacacatttttctcaactgggtaaaatgagtgaactaataaagttagtaaatttcccagataaaatatttttctttgtcataatctaagcaaatatcaagaatattttaatgtttgatggaaggggacctgttagaaccagcgtttgtgttatttaaataatttcaacatttattttagatttagggggtgcatgtgcaggtttgttacatggatgtattgcatgatgctgaggtttagggtacgaatgatcccaccacccaggtagtaagcatagtacccaataggtagttttccagccctcctccacccagcagtccccagtgtttattgttcccaactttctgttcagtgttcccaatgtttaggtcccacttataagtgaggacatgcaatatttgagaaccagtattctaataacttaaatccaaaacttgtagattccaaaaagactgaaacaagtcaattttacttataatttgactaaagatatattaatagatcaattttcactatgctttaggtgatatggaatcttaaataagcttgaacttcatgataatgttttctatgttttgtaattctgaagtaattagggttcactttttcctaatcaaggccaagatctttcaacagttaagataattctaacaaagaatcattaataatcagcaaactaactcttttgttatctagtacttcacttatttaatattcagtttctattattttagaaacaaaacttcaactcctatcttcaaggtctttaagtgcatttatttctgtattcctgaaagacagcttttatccaagaaataaaatttactaaaatgttaataccctaagcagtaagacccgaaactttaaccaccctgctcaatgttgcataaacaatcatggaattgttaagaattcactctaaatgcgatgtcacgtgttgaacataaaattcaactctcttaatgaagcaagtaaacaaacttctttgcactttgtaatatgtatatattatctactgtagtaatctaagaagaaatagattcagttcccacttgtaaacagaacctcattaaatgcatgaatatgtggaagaaatgtaaaaaaaaagcatggtctaatggttaagtgactgtgattgtcagtcaataaaaacggtccccaatctgtcactgactccagtatttgtccttgggaaaatatcctgactctttcacagctctcaattcatcctgtttataaaagtggtttatgaagtattttagcatttataatgtgcttaacaatatttcaaaaccccagtgtatgaattattacttgtgtacaaaactatttataggaatgtcagtttcaacataattaaaaattaaatatacagttataattccctatttttagtaaaaattagatttttaaaaaaatttcaaggttctgaataccctaaaagtattagataatttcatatgctatttgcaaaataatattttcatgcattttatttgttttcaaaacctctcattaaagactactttttagttacattaacaaaaatcaaagaaaataatctgaatctataatgatcttttaaaaattcaaacttggtttacctaaacaaaactgtatcatagaattttaacaacaataacgaaaaataccgtccactgtctcagttagaactgcgcatcaaatgataaacagtttactttccaaataataaacaaaaatattgaccctaaaatagttacgctaaaataatatgttttaaaaaatatattggtaataaaaggtaaattttaaaaagattttcattccaacaagccagggaacatacttgccaatttctctttaaaaatatataagatatatataatatatataataatatataatatgtttttaatagaacattgaggcagtctagttaaagctgcctaaataacaaaacctagtctcagaaatgtgtttctggacattatttagctagtgttcaaataatagtacaacctgcattacaagcacctcttttctttttcagtgcatacaaaactcatgagttggcatatatgattttggtaaatactaaaagcttttgtatcttccattaaatttattacacaactttcctgtgtctcaaacaatgatcatcttagaggaaagtaataaggaaagtcatcaagaaaatcaagaaacaaaataggataaaagtgaagtctactggtgctcaccatgctgtgaaatacatttttaaaaaaagattgacttatggatggaccaattggagcatctaggaggtgggtataaaattcttccaacttttaaatatatctgaaatttttttgacaaaatattagaaaagtagaatccaattaatgttcttcatcagagcattaagttctaaaggtgagatatgaatgtcaatattttctttagtatttgtccttttctttgaacatgcaatattaaaataacagtctaataaaatgatttaagaaatctattaaccaacacttcctctttccatctcataaattatactttaaaatctattctgggacaactacttgaaaagccaatgagtcccctcccaacatacacacttaagttaagaaattccaggtaaagcccattaaacgctctgacccaaacctaagaaagcaacacttgtttaaacaatgacttctcttcctatccctgaaattaatgagtcaaccatgtgaatacatttattggtaagaagaaacaaggacacaagtacggatctgttggttcaaatgatacaatatatattataactaaagcaaaataaattcatttaaaatgtttcctttgaataacaatctaaacatttaataagttccaatttctaaaaatcacacaaaaataaaggcaacgaatattccaggatttttaatgtaaactccctttgttcaattatacaagagtaatactattcctctattttgagtatttatttttaaatggtacgatttctaccgatggaaagaataacagagaataagaaatatactacttgggcctggtgtggtggctcacgcttgtaatcccagcactttgggagaccaaggcaggtggatcacctgaggtcaggagttagaccccagcctggctaacatggtaaaaccctgtctgtactaaaaatacaaaaattagctggacatggtggtgcatcctgtaatcccagctactcaagaggctgaggcaggagaatcgcttgaacccgggaggcagaggttgcagtgaaccgagatcgtgccattgcactccagcctaagtgacagagcgagactctgtctcagaaaaaaaaaaaaaaagaaaagaaaagaaatgtactacttgtacagatatatgaaacaaactctcctttatgaaatatccaccttaaaggagatatgagaaaataaaatttttacttgtttttaaatgaaactgtctggcaaatagagtatggggatatggtatgctaaaaagaactagaaaattcagagtccaaaaggatatttgcagaggaggaaaagaaacaaaagagtagagagctggggaaaataaaagataggcttaatttggtcctgctatttgaaattaggttgtatacttgattactggagttaagaaaaatattatgaccaaagtttgaaacaaagttttctacaaattcatagaggacaaacatttggtctatagcattagcttacttcagcgttttcaaaatgccatgagcagcttgtaagtaatggtgatggtagttaagaaagtaggccctctgcgcagtggctcacgcctgtaatcccagcactttgggaggccgaggcgggcagatcacttgaggtcaggagttcaagaccagcctggcaaacatggtgaaaccccgtctctactaaaaatacaaaaattagctgagcatggtggcgggtgcttgcaatccaagctactcgggaggctaatccaggagaattgtttaaacccaggagacggagcttgcagtgagccgagatagcgccactgcactccagcctaggcgacagaacgagactctgtctcaaaaaaataaaaaaaaaaagtaggcactctaactgtctctataatggttttaaatggttatttgaagaaaagggtgacaggaaaatgggaaattattattctgaaagaaatgaaagttatgcataacggcctagatatagatatgagtaaagtatgtattacaggcataagtaatacaaatgacagtggactcgatctggacccagaatgagaaaacctgggttctataataatccggactttgctccaacaaagcacatctcctctttgaagcagcttcctccctgcaagatgagaagtcccacctgaatgttctcaaaaagtctttctgcatgtaaaatttcatgtttctgtggcatcaaaatatctggaacatttttaacttgtgaccaagatactgtttgattatatacaaggttacacaaaggatatatttgattatatacagggacatgtggaaaaaaataggaaatcacattgagaagaaatgaggaatgctcagtggtttaaaattcagatgacgacgaacaacttatgaggatcaatcttaggtaggactgagtaaagtttgaacagaaagataaggataaaaaagttaacaactgtgtcacctctgcatccctgaaaaaaagaaattacaaaaatatgaggatttagggagtaagaagataacgtcctggacaagaacaaatcccaaaatagaacccaaattaacatctttttcatagaaattaaaatactatccacaataattttggtcaaagataatcaaaggaaatgaagaaataagagataaaggcaaagacaatccacatatgatgataattcatgagggataaaaagctacttagtgctcagatgctttaatgacctagagaagttaagatgggtaataatataaaggatatctctgtaagagctttgttttataatcttatttctcaagagaaaaaattatcaaaaaacaattgtacatgtgttatatatgtggcatttttgtttcattttgtattataaaagaaaagttaaaagtaaaaatgcactctgtttttatgggttttgatgcttataaaatgtgatgaaacctctttataaaaaatataaaattaaatttacaaaattaggtacaaatgtaaaaatttatttttactgtgaaactaaatcacaacagatttctttctataaatccaacaaataccaacattatcacatattcaattagaaatatcatagtttaaattattgattaactgatataatcttattctaattgttcccactttttggctgtgtactctgaccacctctttacatgatgaagattttgcaaaatcattttctatagggagaataggaaaatcattcaaatcataaaagtagatggcttttatgtttctttcaacttcacaacctattatcggttattttgtgtaaattcttagaacacctgccaaacttggagaaacattcatcaggtttattctatatgagctgtatgattcagaataattttctgactccacgcattgcaagccttgtttctcctccattatccacatatatatatctatagccaggcatcattgtgcatatgagtggcattctcctgtctttggcccttttttaaatattatgaagagaagtactatgaaagaaaaatcatgaaaagagagcaatgtcaactaactatggttaaaatatatttatatcataattttagaaaaccttacaattatgtgaacccattgttatgctcccttccaatgctttgaataaaggtagttggcaaaatttcgtctcacagtggatatggctctatacaaaagtggctttatttaaaagaagaagaaggagtaaggaataaatccattttacagccatataagggtatctgtgaagtgcaatgggtttggtgaattggatccatgggctcatatattttagccttctctttattttctctctgtaagcttatggaacacatataacaaaaactataattctaaataattaattatatgtaaatgtatgtctggaactatatattcttatcaaacaagaaacaaattaatactcaggaatctcctgatacattcatgttcatttgcagttatttgtattgggttgaagattgtcccctcaaattcatttgaccttatttggaataaggtcaatttgcagatgtgattaaggtaaagttcatgataagaccacagtgaattagggtgggccctaaatcttttgaaatatcttacaagaaagaaaaaaggagaagataaggagaaggctgcatgaagatggaggcagaggtttcaatggtgtgtctacaagccaaggaatggcaaggaatgccagccaccaccagaagcgaggagagaaacgtgtgacaggttctgcttgagagcttccaaaggaaccaaccctgttgacaactcagtttgggacttctggcttccagaactgtgagagaacaaatttctgttgttttacccactcagtttgtgataatttcttacagcagccccaggaaattaatgcactttctatatagaaacattaccaaattggttagcatgacagtggatttgtaaactgtctttttatatgcgtgcctaaaaactcaagaaataaagggattcctcttggattacagcaaaaatattttcacagcggacttctatgcaccaaattgcgtttttgcagcccctgtagagcaaatactgtgttaaatgttcaaacatctgagatgtcaacatgggaaaataaatgatccttcatttctggaaaaaattaacaattctataaagtaaattgctttttaataaaaactgtattaatacattataatataattttatgcttaatacatttttctctaattttcaaaatttgtattggtcccataataaaagagttccgaaaactatgttaataacccatcctagggagaaaaaacagtaaaacttgaccaccagaatcaactttccatttttccttttttttcataattagattctctcacattctctcttttcactttggattgcaagattctaataataataatattaaatattaattaataatcacttctcagatgccattgtaattgttagaccctttgtaatatctatggcttgtctgtcctactaaatggtaagctcctatattgctgtggtcatgttgtgtacaactttttctttgcttactatgcctggaatagtgctggaaatctcttagatatatgttatatgcttattgccttggttgaatttgttatatcaactacaatgtggatggctccacagaaaggggctaagtttcaaaatctcttcaagtgtaatggactaccaagcaatccatgtgagaatatttgcattcctgttagcacaaaattaaacccatacccaatgtatttagacagtgctctgtagctatgcgcctggctttcctttcactaaggaaaagctctcgttggtcatatttaaccgtgctggtggaaggccaaggaaaagctcttcattaacatatactcagtaattaccaaaggcacatagacacatctcatttctaccctgccattatgctcactggcctggaaaatgggattgggccaagtggaactgtcccaagcacttgcactgtatattactggaagaagaaacacacagtgggctctacagacaagaactctctctgtgtacctagcaaacttcctgtggacagtttttacagaggtcctggtcaaaattatcaagataggtttactactaggcattgtcattctgctttaaactatcatgattacattaaggatgttatttcaattaaaatgattttaaattattaaattcataaatattataaaatgggaattaagtttctctcatattttattttatgtctaaatctgagatcagaaaaaaagcaccgtgaatattatgtgtagaaaaggttcacatttaaatctttagtctactaaatgaaaaggtaatagaaaagtaacctgagtaaatgatcacgtgaatgaacaacaaaatgctgtctacaggctcattataaagtcatctgaaataaataaactctggatagctactggtggcagtgtttccttcatcatatttccacataggaatggaagtggaattagactagttggctgcctcctactgtctctattcttcccctggaaaatcccctatgtggagaggggcccactggggtccattctaacatgctgcaggagaggcacaagggtagatatgtgctatcacttattccttctatcaatagatattcagtgctcaggacactacacttaacaaagggaagacaaataggaccaggcccctgcccttgagaagctcacaatctatagcataaaacagaatatatattatacttattttctataggtctcaatgccatggtacgtgtatacacatgacaccctaggagactgatagagataaacaaaatgaagcaatcattttatgctgtctgaaaggtcataaaagctttcatcaagaaggtgaattattgtacatgtgtagatatctgagttgataatgagatatcaattattagatttctttatagatttaacttaataacagtaaaagaaagaatccatttcctaagaaacacatttatagctcctatcctaagaactgccagatagagtaagagagaagtggagtctatctcattggctttgggggtctctaatgtttctttaaaatataatcatatctttcagtttttttcttcactgcccaaagatgacactgtcctcccagttccactcagcataaaaaattacaatatacagatcccaaaacttattaatgtaacttaaaagacaagaaagggagattgaaagctgaatttgcaaaatatactccatgatacaataaaacccttctctgcttagactgtaaaccaacagactgtgtctaatccatcaattactttgtctttctgaattagcttaaaagtgggtggtaaatgatcaaacacattttaaatataaagccagcagagagtcacatggggtccttttatgaatcaaagttttcacttctccatgtcctatgtgttactgtaaccactgaagtggcatatagtatataggacacagagagccacctcgctaatcggtccccacagacctgatggtgctctctgctgcaaaagcaattttcattttgaactccaataccctttaagagaacccttcaaaaataatcatatcacagtttgagtgactagagcctccgtctcaattgcatgcccccctctcctattctgtgtctccttcccccttcctttgcccttaactttatgcctagagatgaaattcctttcattttcttttcctggaaactaatacgaggaggagggatattgttatactagatattaaataatttttttctcaaatatcttttctttcaaaataagatataaccataccaaaagaaggacttctaatcagagatttctatcctgaggcagaagagcttttctttttgaatggaaaatcattctatgaggaaagtctgcatcaaaaatcaaacaaggactgttgttacaaaagagaaacctgccagcagtttcagggtaacttgatggttctttcttgggtctttcttagtgggctctaaagaggctttcgatttttttaaaggagaatctcaaggcagttacctcctgaaactactcatctttcactactgctgctaagaagaatgctttcaaatggaactgcacagcctcctctctaggagatcatcctacagatgaatgaagtgctggtaaagaaaaagcctcatatttcacctgaaaagtagaattggtgacaggattattattattattagtggaatattctcagactatttcttcaggctgacaaaatatttcaaaataaagaaaatattgccaactaagtttgaaattagaatgactgctaaattaaagctgattataaattaggttttagattaaataaaaaggttaaaaaaacacaacaaattaaatgagaagttctattcagttttgtccacatagtatcagacattacccacactatattcttaattttgatttatttgcatcggacttaacgaagagaacctatgctaatccatagttatgtaactagtgtatacctgaagtttggggctttgaaatctgaattgagcagataaacaaatgcctaaatatgtagtgtagatcattaaatgctactcggagcttttctaaattacagctgtgcacacagagtataaaaatgccaaaatattacacaccaccaaattcagttgcctcttgctcaacaagccttaatcaaatgggaaaagttaaattgaagagctgctttgtgaacatgcatttcaataaaccataatgtttgtaaaatcagaacatgggaaaagagaattatcaatagaaagaaaataattccccatgaaaattaccatttaccatttttcaagtacaaatttagggaatattactgcatactgatacatagtgattggaggctcatagataaaaaaagattccagaatctatatacaagttaaaaacaagaacaaaaaacttctgtgacctatatttgaataggtctaggttaacagtttaccttagcttattttagtgtatacttttcaggtgactgctttagtagagaaactcagcattgaaataaggtatcttcattggtttacattaataaaatacaacagcccctactccctaaaaatcatagttctcatttcttttttttttttttattatactttaagttttagggtacatgtgcacaatgtgcaggtttgttacatatgtatacatgtgccatgctggtgtgatgcacccattaactcttcatttaacgttaggtgtatctcctaatgctatccctccccccttcccccaccccacaacaggccccggtgtgtgatgttccccttcctgttctcatttctttatcatggccagacttcaaaatttctatacctggcactattagatctggcaccagagagaattatatagcccaacagcaatctatttatcatattaggtaattcttagtaaatcagggatattttgggagatgaccatatcacaagacagggcaatcttaattacaatatctacatatcaacagagtgctatgcccaatacagaacaaatctttttagcagagaagacttaaacatcaccactatatcaaatgcctgatgcaatttctagttagcattctctagaagaaggtaggaaccataaatgttatctcacaaaagctgaggcagtttgggagggggagcagaaaagtttgcctggggttagcatgtggccaagatatttcactgcaattctctgtatgatagcctgaaattttcaagaatagaaattgttttgattatactttcaatttagatcctctgatttaatgagatagaaatgacagattttaagaaaagtgagataaaaaatggaatagcacaaaaatcaagatcttagtgggaacaaaatcatataaagttccttgcagctctttgaaacattaattttcgtatgtgctgtgctaacatgctttgggacacatgacttaatataaatatataaatatctatgtattagcatttctatcaaaatacacagggacataatgaaaaaattgcatttttgaaagaataaagtaaaaacattatctaagttaattcacacatgcatttcattctatttcaagggtcaagaaacttctgcaaaggtttggatagcaagtactttaggcttactaggccatataatgtctgtcaaaagtactcaaatctatattgtaggaggaaagcagtcatagataatagataaacaaatgattggggctgttttccaataacactttatttataaaaaacagctggtgagccagatttgatccttgggtaatagtttgccaaatcctgctctagtctcatgaactaggagggatgctgagctgaaattttttctgtatagcattataaattattcacattgtcacactttgttccttttttattgaattatcataccagaaagaaacactagtagtactcaaaataattccagggagtttaacttctgtctattcaaaaaaccattagcactttcactcttttgcaataataaaatgatttaaaatacaggcaaaaagaaaaaaaatgtagttttaaaatcctttcagttatataatgcacatgatgtgcaatggaaaataaacacaaatgggtacttgaaagagagagcagaaattcccagaaaacaatggagacctgtcaccacacagctacataaatttctatagttcaaaaaggttacttgcccttttaatgttgctgtgattcaattgtacagatgggagttacactgactacacgtccaccttaatgccatttactcacatccccaggaagctatatgccagtgagaaatcagaaatataggagagtagatcaatgaacatgctttgtgttgagtatgcccaattcataccttaacaacatacaaaatcaggatgcagctctacccatgtgtgttcatacttattcatgtgtggggaaagccagctgattggcatgatccacatccatcaaaagcatgtggatatgccatcaactgatagaaaggagtcttgcaatacttacagtgtagacttttgcccttagatattatttgtgcaattaagtatatgtactcaatttaaaattcaatgtaataaggttaaatacttagagatagctatggtcatacaaataaacatgggatgaagaattacaagtttttgtgtctaaagtgttgatataatgagattcaaagacccagagtcaagaattgtaatactcaagtctagtttctttctactttatgaataaatagtcatggaagtgtgaggaagaaatatcacaacttttacatgctaagcccaattgagtgttcactgattgatactctactctttgccttgtttcctgctggtaggtacactcctttattctctgtccataattaggctctgtaacaccaagtgcctctaagtatcacgtcaaagaaattcaatatttctgcctgcttcctccgtagtttttttctttactgttgtgtgtgcttagtgactatagcacagagactaagaaaactattctgtatcagaaattccataaagtgactaaggagttttgtcatttgctcctctgaagctgcatttatcagattttaccagggatggtaaattaaacagaatttttataatctgtgtcagaactgtcattaataatatgcaatatacacttaaaagataatattgttgccacttctgatgaccaaaagagtagacatggtaagaaagtattgacaaacaaaatagattatgacattagaggaaaaaatgttagtatatgctaataaaaaacttaaaatggaaggatttatgcagtttggatgtctgtactgaaattgtcacttagctcaagtcacaagatctttgcacttgaacagctttctccaagttcttcctatggcttgttctctttcattctttactcctcagtgaacatatcgtttttacctcgcattctctcagtgattcctcctcccatcgtttattttctacggcagattcaacattgttggtaattctttgatagttctcccattgaaaaatagtgaaggagtcaatatttgaatctgggctgcaccatgaccaaaagtgaattgccagaaacgacactatgccacttctggtctaatctttaagaggcctggaactttctacgttttttggccttgaaatatttactcttggagccctaaaccaccatgtaacaagtctgatttccctgaggttcttatgttgtaagaaagctcaagctagctatttggaaaggtctgttcagggagagagaaagcgggggaaatgaagaaagagagaatgattgagagggagctattgggagaggaggagagaaatagagagagagagagacctgactatttcccagctttccagaccctggacattcaatcatttaaatggaaaccctagacatcgtggaacggaggcatgccatccacactatgtcctgcccaatatctgtcccagagaatgagataaaattctgttattataaattgtttttagccaatgagttttgcagtgcactgctatgtagtaattgataactacaattatctccatattctagtatcctattttatcgagcagttatcatataatacataatatttggaaacttgtgaatttacttatctaatgccttttgattacagaatggaaaatctatgatgacagaggcaatacctgagttagactttcagcattgttataatgcctgacaaaacaagtaaatatttgttaaagaaaggaagagaggaaggtgatctgattgctaataataaggctcttttttattacttcaacgtcttaccatgcttatataaaagtgacacttaggttagaaaataggttaggaaagtattttttcatatgtggtatttttctaaaccatgtgtatagtacttttatctacaactttcagaatttctctctggaaaatgatgccaaaagttatcagaaaggtaaatttcattttatgttaataaatttaaagatttatcagtatctttaataattttcttacctattaaaattaatctttcaaaatcacaaagcaaaataatagtcagtgattgaaaaacattactatgggctatgtataccttctaaaatgatttttgtttacaattgtcaatgtatctttcttgttccgaacagcaagtagaaatcaagaggtcacttcccagtagacttctgataaaagcctgctctttatctcacaaatatgaactccacatttagagctggaattcctccagatagagttggtaataataccccaggaagtttaaggagatggttgccaggttgatacatatctacattctgcttcagagggagcagaagccaagttaagagctgcaaaggcaagatgctctagacgtttagcaaagataaatattagtatttttcatattttaaaatgaggttctctagcaaacttaagagtccggttctcttataaggattaaaattaactggttaccaattaacattttttttaaaagacctatgcctaaggcagaaactttagaatgtgaaaacagagcctctcccagttttcatagcaattaacctcagtatttgccaatatacccttgatttaacactacctgtttataaggcaaatctaaaatttgccttataaatataaacatatatatttatatctgcctgtatattctaacatacacacacattttgccaaaaaggtatttaatttaatcctgacatatagctaaatatatggatcattttaaaataaaattttaaaaagcaatgcacaaaagttaaacagtccagaagtatacacaaagccaactgctcaacaattcccatttatttttcctctttctgggcatataaacagattttgcatttcactcttccctatagtcagatggggcaatatgagtaggtcatggccgttgaattgtgaaaaggaataatgtggcatttccaggcccagagaagggggttccccatgctcacaggttttctctcttgcagtgacctgcagttatctgttccatatgaagtagccccaggctagaggagagtcacctgaccaacatcagactataatgtcagcaagagaaaaaaactctgtgggttaagctattaggaatacatagtttgactgatgcgccagcttgcagtaattgccatgagccatactgataatgcaagtttcaagatttgattcaataatccataaaattatgagatcaaatacttttttctttgcgtagaaagattctactgttttttaaaattacagattaatattttctatttctgtatatgaaattaagaaaaaaatcaattgaacttagatttcattatttatattgaatatattacgtatttgaacacagttttactttaaaaatcagctgttaaatataatttaattatttctattattatataaatatccctactataaaaaccactacattttacttacttggcaagttaggatggccaacatatttctataagggtacacactgtttattgaaatatttacatatgtttactgactagggagggccactattacgactttgagtatgtggattttctgaccaacatagcattctttctttcaccatttctggaaaaagaaagaacataatttgccactccagatatattgcttagtggctaacattaaagtaacatgagaacatttttcatccagaaaagagtatcttcacatgcaagagtttcatgtgaagtattcaaactgtgttttttattatccaattatatacttaaatcatacataatttcacagttagcccaattcattgataaatagcaagtcaataatattatctattcaatacattgaattttcttcacttctgactaattgataatgttaaaaatgctagcagaagcactccagagttatttttgaactcatggcttaagaaaagtccagatagaaatagcaaatatgctaatagcacttactacaagccagccattcatggatccatgtggtttacatccttccaaggtccgtacaatcacattagcaggccagaatattattactcatattttaaagatgaagaaattctcatcataaagtaacattcatccccacacaaaaaagtaatcactaataacatttagttagctctattttggatctgtgtcagaggtaaagtattataatacttcagggatcataaaagttttggatggtttccttcacatatatgttgctgattataaacttcacacctttgtaaggaaaggattttaaaatcaaatgaagaaatgagccatgaaaaaggttcactcacttgtcagaggtcacatagtgagtaagtggtggaggcaggatttaaacctagagtataatgtatctttgaacaacgtaggagttaggggtgctgacccctgtgcactggaaaatctgagtataacttctgactcccacaaaacttaatatcctactgttcactggaagccttattaataacatcaacagtagattaacatatattttgcatgttacatgtgttacatactatattcttaaagtaagctagagaaaagaaaatgttattaagaaaatcacgagaggaaaatagatttacagtactgtactgtatcaatactctaactgtatattatctctttacaagatgaatcctgtctgaaaggtcaggaaactgcagttgcaaacctcaatctacaggacatatcaagcagttcaactttttcttgtaatgttaagacatttctctccttcttgggagcacttccagcatcactagtgacacttcatatgggtcccatggtgttattcaaggtttacggtattgcactaaacacaatgaacaatacaggagaactgtgacagatcactttttactgacatccacaatttattgggagatgaactgctcatgctgagatgattagcatcacatggcatgttaggtggctattcacatcacttaagctcaccacaatagcaactagcggaggctagaaaattaatacagtaattcagtatgtaatgcagttaattttatgcaattatgatctaatatggcaccttaacattagtttatatttctctcaactgcaaatggcaccatgtatggtctgcaagtgttactgtgcataagttttaataaactttaacttcttataataggtttgtgtatattttatggccataaatgagaaaataaactagtatctacaatattttatgtatctatgacatacttaactttttcttaatttttttattacactttaagttctggggtacatgtgcagaacatgcaggtttgttacataggtatacacgtgtcatggtggtttgctgcacccatcaacccgtcatctacattaggtatttctcctaatgctatccctcccctagacccctacccaccagcaggccccactgtgtgatgttcccctccctgtgtccatgtgttctcattgttcagctcccacttaagagtgagaacatgcagtgtttggttttctgttcccttgttagtttgctgagaatgatggtttccagcttcatccatgtccctgcaaaggatatgaactcatccttttttatggctgcatagtatttcatggtgaacatgtgccaaattttctttatccagtctatcattgatgggtatttggattggttccaagtctttgctattgtgaacagtgccgcaataaacatacgtgtgtatgtctctttatagtagcatgatttataatcctttgggtatatacccagtaatgggatggctgggtcaaatggtatttctagttctagatccttgaggaatcgccacactgtctcccacaatggttgaactcatttagactcccaccaacagtgtaaaagcgttcctatttctccacatcctttccagcacctgttgtttcctgactttttaatgattgccattctaactggtgtgagatggtatctcattgtggttttgatttgcatttctctaatggccagtgatgatgagcgttttttcatatgtttgttggaatttcatatccagccaaactgagcttcataagagaaggagaaataaaattctttacagacaagcaaatgctgagagattttgttaccaccaggcctgccttacaagagctcctgaaggaagcactaaatatggaaaggaaaaaccggtaccagcccctgcaacaacataccaaactgtaaagaccatcgacactataaagaaactgcatcaactaacaggcaaaatatccaactagcatcataatgacagaatcaaattcatacataacaatattaaccttaaatttaaacgggctaaatgccccaattaaaagacacagactggcaaattggatgaaaagtcaagacccatcggtgtgctgtacttttaatttttagtatttctaggctatacagattgttgagtttttccaaactgcagaaactttcactttgtttctaatatatttattcaaaaataccctcagataagtggacccatgcagttcaagccagttgttcaagggtcagctctaatgtggttccagggtccatatagttaatgaaagcattattctctcaaattatttcatcacaaacaaaagattttccttatcctgtgtcttgagtttgactgcttctttttcattttttgtttacccatggttgaccagaatgcctagaacatagtagtcaaaaaggatttttaatttaattaaagaaattaagggaggatgccactttagatatctgttcataaagaatatagtcataaagactatattactatctggagagcagaatctaaacaaaccatcagatttgtaaacccagggctgtgaactgtttctgttcccaattcaagagactaagctggtgtgccttttggaaagtaagtgaggaccttaagcaaaaatagattaggtaattaaacagtcatgtaagacacatggcttagacacagcttccccatggaaaccagtcattcacaaagggaaggagcaatgagaagaaagttttttgcaaatgtgcacagagattatggtcaacagtatacatgagaagacttcattcttaaaagtaaagaaacaatttaactattcatactcattcctgagatcatccagggccaaaatgtgctcgctatcagatgagtaactcatagttcagaagaaaattactatgaaacaaagagaattatttttctctctgattacaattttaaacctttacttttcaggcactttagccctaaatttgttttcactatttgtttaatttaattccttagaaaagctatgtcataagccatctgatgactttgtaaatgcaaagggccaatgttgtggaacagacaatctaatgacatagtgtttagtgttccctaaagcaggagacagatgaagagaaacggtgaaccggcaaccttagcataattaagacaagcctgagtgcttgccatggtgccattacattaatctcacatcagtggcacctggctaaaatttatgagatatgtaaaaagggcctttccaactgaccttgataaggcagagttatttatcatgtgagagaatagtcagcaagctagggggaatgaggtatattagaaataagttgacagagagatttaagggcagtgggctgcgatacacattgactgaaaagatctagggaagcatttccagcactatcaatcttaaacatctttgacaagtaaaatataaaatcatgcataatgttaataatatatatgagaagaggtaatagtaaatgtcaagttttaaactgatgctagttcattcatttaatattttttgatgtgtgtttattgagctaatataatggaacttgcaaccacaacggattctacacgatttcacccccgaataaataagcacaacatattcaccgtgagttccctggagcactgtctcattttattcatcatttcatttcaagggcctagtgtagagtctgaaacagtttaatcccaataaatacccagatctttttaatggctaactgcttcctgttcttcaggtctcagctcatactacagagagtctcctagccacagaggaagaccacaaagtgtcccctggccacctcatcaaaaagacttaccactgtatttaactctcttatgtattgcctgcatgcttattatttgcttttcctccctggactctaagattccctttcttgttcatctttatatgctgacacagattcattattagaacaggacgtggtaggtgcttaatacttgccaagtgaatagaagaaggggtgcttattaaataaattgtggaaatcagtaaacagaggagtatgattatgtttcaggttatattttggaaattacatacttttttattttaaaccattgcaatatcagtaggaacaacttgaaaaaaaatcagacaatggcctttcttcactccggacttcactgggataaaattagtatcacaataattcattatcgattgttgattgaaaaaatgtctcttttcttttcagcagttgccgctaatattgttaaatagaactaggctttttaggacataaacagttttgtacttgaaatgtttcaataagaaatatgaagggaaacaaagtggtttggttttggttgaggttttgtttgctttacttccatataaaatgtacacataaaatattggtagctgcaatctgtagaaattgccataatataagtgacattttacttctgttcatgggccaactcatcagcacaagggtcctttattttattttttgtgtaacagacaatttgaagatttccttttgactttatcaaacataattgaatttatacttccactaaaatggagatggatgggtaaaattctatctttatacaatgaaagccttatggtcttttcagtgaggggaaacagcagcacagatttagaatgtcacatagaaaaatcacattgggccaagcagacctgaatgattttaggccacaccagcaagaaaatggcttctaacatttaaattctacttcttcaccattgtgtacttggtaactcttctatgcaaaagcacagactagctgaaaacagcaagtcacaaaaaataatcttaatggtctttcattatatcttaaaatctgtattaaaagtaaggcacatttggtagctagtattttagaatgaaggtagaaaagcaatcttcactttaaaaaaagctaaaattaataaaatgaatatatagatacttgaaagaaaaggttaacttgcctcaattcctagcataatcggtcactttataatcccaattaacattcattcccacacagaaaattaatcactaataacatttgattagctctattttggatctgtgtcagaggtaaagtatataatggtacttcagggatcataaaagttttggatggtttcctttgcatatatgttgcagattataaatttcacactttgttaggaaaggattttaaaataaaatatatcagaataattaaatctctctcttttactgtaaatttgtgtgtatttttaatgcaacataatttgcttaattttaaaataaatattgtataaataatgagttatgagtatagaagagagtagaattaatgaaatttctctacactgtctccatttgaactgaatttctcttgctttctagaacttttgcagaataaaattaaaaggtgcataaaatatcagatttaatatttgctactgatcttacctaactctggcagatctctactgaaatttacttattttaatgattggaattccataatgaaaatttaaaacttcatacaaataatagaacgctgctgatttctatttgtaatgaatacactgaaagagggtaaaaggggagatgaggtttatattcataattccataacttagcaatcctatcttaattaaagaaaatctgccatatacttaccacataattatcatcaaagcaataagttttcattatgattcaaaggctgattctatgaccattttatcttgtttctatttatcttcatcccatcaatttttgctaactttgtcttcagattaattttaaaagatagcttttgcttttttaattaatcaaaagacctgtggtatcatccttcttcaaaaaatatgccaatatgagtcttacttttctttcaaaaagttggtgaatcttgatcttttttattgtttgtgatgaaacagacatttctttttaaaattaaattccaacgtcgtgaatgtataggtcattggtttctagagaaagtctttaaattaaggacaatattttaatctagaaaaggatacaaaaagttgttgcatataggccaaaaatgtttaagtgtgaaagagaaatgtaattacattataaagttttagaaaataattatttatcctaacaaaactcattcatttcaaacaataatcaaacaacatctagaataattttgatatctgcaattgaattgcaatgtaaagaaattttcttcaaaaagaacttgaaaatctgcctcagaagatgggaaataaattatttgaaaaataaaataaaatcctaaatcacaatgtgataccaacacagactgagtaaataataaaaggttgtacctcattacctgtttgaacaaccagccacccagttgctctcaaaaatatagtagttgttagatatataggcaatttttgctagtagaacatattcattaattttttcctgtagcaaccaacatatttttaaggcaagacatgaaaatccattatttaatttatctgtcaatgccttgggtctgggcatctgatctccccacttggaatggttaattcaccaaaaatgtctgagacaaaaaagccaaaattctttaacacttgctgaaaggttaatgaagaatgaagtgattcatagttttccccaaagtcaagcatgtaaaaatcaatattctacatcttaaattttttatatacaaattaagccaaatttgggccaatcaccttttagacataaaaagagttgctcctgaacatgcctcaaatgtcttctctgcgtttctgttgctgttgttgttgttttcctgaagtaggcaacattttttatcaggagtattacagttagataactttattcacactgaagtagattccagaataatgaaatcattggcagaaagaagcaaaccacagtggaaaaagatgcaggcatgaagtaaaagcatcatgaattgaatgaaactaaagatggactaaagtcatagaaactgttaaaaccaggaggaccctagagatgttctcactcaaagctctcattttaggaatcagaaactggggatcagagaaagtgtgtggctttctcatgatcagaagaaccagacctagatccgaggacttgacacacttggttttgtactgtctatactccgtcttttgacacttaatgaaattaagcaggaaaaagataagaaaattttttttgtaaagtcacattcctctaggaattatttactaaaattcttcttcacaactccccctcagaaatactgaaagcccttctttttttttctaaaaaacatatttgcaatttaagaaatcttctgaaaccgtcacagatctcaatttgctcttctattatcattagtctactaatttcattaatataatttaactgattttctttaagagtctgatgaatttgcctccctctttccaagatgtttaaagcactatgtgaattactttatttgtaaaatgtagaagtgagatgttacgggaattagtgtaaaattttaaaagtgtgcaataggtaaaaagttttccctcaagatgtaaaatcctacaagactaagacttctaaacaaatgccatccccagtcacatatggatatttgggaaacagaaatcatccacagaactgttgattcctctgtgagctcgcatttttaaaatttctatttgtagtagtcaggattacccatttcatttacatcagttgctctagctctctgtgttccagccatttgggtcactctggtttctttcagttctttccatcttgttctctccttacaaggcaagcatttaaatagctgaagtgtattgtttctagaaaatttctgcattgaaagccttgaagtctctatggcacattatgtggttcatcaaataacctggagcttaaattagtatattatttttccataatttaccaaatagcatctttccatctacttaaattctgagcctatatgtgtgacatagtagaattttaggcctatttaccttccaaaatagtaacaagggtaatttatgcaactctgcttcaatgtgttataaagtgtaaaaatcaattgtctaacccagactgcaaaacctatgccactcaatacacgatacgtttataaaactaaaagtcaaaaaaagtatgcattgtgtgccagagtataaaaatatattttaaaaatcatttgataacatgcccaacattgcaatgaacaatttgatcatttagaagttatatttgagagaatgccaaaattctcaggttatcataatattctctgatggtcactaaataacaatgaagtgaacaattctaccatctggactttgttacgtagcccgatgctgcccatagaaaagattaacctggcaggcaccacagggatatgtattttttcaattccctcattttataggcaaggcaaataaaattcagaaagctaaaataattgtaaacttggttacaaagtgacttggcaacagagctgggagtaaaacccaagtctctgagttgttcattacaagcaggctactttcacctttgaactctggaaagcactttttaaaaaatatttctctttatcacaactgcacttgaggtaactcaggtgttatcgccctgatttactatgggaagatacaaactctatttgattattcgacttgtatgaagtaacccagggacctcgagtgtgtccatcatatttatttcataaacatttcaaggccaataaggacaaataatatacttgttatttactatggacaaaaataatgggatatattttataccacttcatgagtggttttccagcttggctaacctccataatcattagagtcacttgaaatcttctggctttgccccaaacccactgaagcagaatctccagggaaagtgcctgggaatttgtatttttaagtggctcccccaggtgactttggtaattagccaagtttaggaaaccttgacaatatcactggaagtaacaggatgttgccttacgtgttcagaatgttcagaagcaaaatgtacctattgtaaaattgacccaatccagtttctctcttttacaaatggggaaagatagatgtctttgtcacaagtgggtagacaaactgccaaataccacctatatttttgggtcagagacagattggaactccaccaagagaaactgggcattcatactcggtctatttccatggcagggacaaaacaattctaatcttactgatcatttcattaaagaataaagcaatctcagggcattaactgctgacagtaatgcagaccatggatttcacggattaaccaaaccacaaacaatctagaacatgcccacagaacaattctttgtttgtgtagtacaggaggcaaaaaagcaatcagtatgacttgaactgctgggtttaattactcaatataacacttgccatttaaaaatccgtatgcccatcagcatggcaacagtctctcataaagattccggtatcatatggcacaatttgtacggtaatcccacatttcccaagcactttcacatatattagtgcaccttatccttacaatagccctgtgaggtagatagtaattattgacaaactgaaaggtttgttataattaaaagtttattactggcagaatgcaaatatcctgaaatgtatctgatatactcttggtttcatgcaaaataagatatgtatcaccccttagagtttgttaaaacaattttaaaccctaaaatattcattaagtttttttaatggaaaatgattcatgcaatgctagtttaaatgctgaatttgaggttaaaaaagaaaatgtatcaagtagtcagcctttactactttgaatatcaagcatacagatcctgatttatttcatcaaaatggtttcctagctataccaaaggctagatccttttccctatacaatggctcaggtgaaaaatagttactatagtgacataccacagtgaagagttgaaaatttgaagttttcaaaaattaatattatgtttgttcacatgctaattaaaatgaatccacagttgttattcctcattgttattgtttattgacacttttaccctttctctttcctaaagcctcaaactctctaaattttggcaaaacttctgtgttattctttctgtgagaaaaacttcaaataaacttccaaaattttttttctgggtacagtgaacatagctagaacagttactatgtgaagagaatgctattaaagtcaattattacaaagaagcacttagacacacaataatttatcaaagtttttattcaacgtaatattatcaacaggttcagataagaatataagtttttctcatgggagaaactccatctgagtctctaattaaataacttttgtatagttccttttcttctctgcacaaaagatcttttttctgtccattcttgccctccttctttctttgttgatactatttactcccaagcctgcctctgaactctgtctaattagctcttgatagatctgctgccctgtttccacaaacatttaattctgccgtcagtcccatttacattacagcatgttgcattgtcttttaccagcctaattttgtttgagtgaatgtaaatcccattaagcagtcacctattagactatggcatataaactccaaaagcctctttattacaagagtgaacataaggcccaattgataaaagatttctggggcatttccatttgtggtgtacttcaaatattctgtctgctttaaacttagctcatgtttttgaagtatttgacagactatttgagtatctttttgcctgtgtattccatagcatgaaatacataaccatcatttgcttgttgtctttagaagtttacttatacctaaacataagttaaatatgtatttcttcctctttagttattttatttttcctttgtaacctgaccacattatttttgagcactgcataaaggtgtttacaaataacaggatggctggcagaatcttctcggaaaagctctttatgaatactaaataattgtccagaagttcagtaagcctcagtgttttaagctgaactttctggagagaggtaagacatagcatcttgacaggcagcccttcaaatggcaagtagctatgggcatcagagacagacaggtttctcttataaccttaatgtaatttgatagctcaaaacgaataaaaacaagatgtaagatatcattagaagccttggaaagaccaggtggtctgatatttacatcaatatgatcaatatactcaatcagattagtgccaggtaccagttttaaatgaaggctcagttatagactttcgccaaaacagagataatcattcagcactatggtcacataatcacgtggttgaaggtaagggtgagaatggctctctttccatttcctcctggtaattaactcagaaagacatccatgaagtgcaaaccctcacacacaaaattatttctcacccctgcaggcttgtcaaagccaatatttcagaaaagcacaggttgctgaaggggactgtgattttttttttttttgcctgctgtgagtccctaaggacaacaaacattctaagagagactgtagccaaaattgctaataacttcacacagttcttttgccataatgacaaaattcaagggaagactgaatagagtagtgggttaggtggtaagccagttatttgagcaggaatgaaaatatatatggtcccaaatgctagttacgaagtcaacctggattaaaaatctaaaaaatgattatgacaaatatatggaatgcaaagtcaataacagatattcagtttgttaaaaatgaggacttacaatattttaagaggaggaaaaattataaaaaaattgagcatcaaaaattgatttataaagtaagaatttgcatcaatacctagccatacctacaatatacagcttggtattcgagtagaatagattttatataactctagactctctaatattcaggctcaaaaatacccagtaatagatatcaaaacaaatttcttggatgataggccccttatttctttctacatatgttttgatttgggtcaatggcttggctagatattatatgtatgatttgacatgattgtttatctttctgtcctttacatagcattaaggacatttattcgacacagatatagtcaaatgtcataatgggcaacatgagttacacgttggctcccttgagtgtctcctcataatcacttcaaatcttactgagaccgagatttcaaagcaagaggtacatattaattcagggttacttgttaacaaaacaggcagctaactactattacattggttcttacggtttactgaagcattaaacattaacattattattatgaaatacaaccaatatcagaaggaaattattttttaaaacagtacaaatattttaagtgggcctacaagaaaccttagtgattcataataagtatattgaacgaatttgaaattcagtgaacacatcaaagtttctagacccacataagtttctgtactacccataacatttataaaagcaacttcagtaactttttcaaaaaggtatctctgtgttatatctggacacaatacatataaaatataaatatagatgggttgcataacctctctgagcctcagttttctcttttacaatggagaaaatgcatattaaagttgttcagattaaatgagatgattacataagtgctgacttttttttttttttttttttttttttgacacagagtctcgctttgttacctagctggagtgcaatggggcaatctcgactcactgcagccttgacctcctgagttcacacaatcctcctgcctcagctccccaagtagctgggactataggcgggtggcaccatgagggttaatttttttttttttttttttttttgtagagacgggatttccgccatgttgcccacgctgttccccaacttctgaactcaagcgatccgccagcctctgcctcccaaagtactgggattacgggcgtgagccaccgtgcacagccagtgacttcttaatatatatcctaaagcgcaagaggcactggatatttgtggagtcttgataaccaccagggaggggcccaaggtaggagagaacaattgttctgagagacaagtaaccataaacaacgcgctgacacaacgaccttgctccacaggtagcccaaatggcacaacctcgatcagcatgtagccccctccagaagaccttataaaacttccctccagcccctgcctctttgcagacagccccttctctgtagtgctacatattgcacccttgcaatgaattttcatactttctctaataaatgtgcctttatttttctccccctacaactgtcttggtaaattcctttaccaccggcaacaccagccccagccagtcacacttgtaagagtactcagcagtgagcaacacttatttttcacagagctataggtgagaagacagacagaaacccatatgtaagtataacttttgataatttttgtcacaaacagtagtagccatagttttgcctctcaaatatgctttttgttcacctttctattaacataattttttatgttttaaaatgaatctgctccaaaagattcttgtgaactgatccctctgcctactccaaacagggggtaacctaacaggcttcatcgctagtcaatgagatgaccttatttccctatcaatagtgataggaggtatccagtaagaggcgtgctctttgcaataaaaacacaactatggatataatatgaaaaaaaataactgctttgaaccttttctgtcacaattccagaaaagactgcctaagaattaggccaataaaaaagaacgacattatgtcctttgcagggacatggatggagttggaagccattatcctgagcaaactaacatgaaatacttaacatgttttcacttataagtgggagttaaatgatgaaaacacacggacacatagagggcaacaacacgcactggggccttttggagggtggagcatggaaggagggagaggatcagtaaaaacacctaatgggcacgaggcttaatacctgggctatgaaataatctgtacaacagacctccgttacaaaagtttacctgtgtaacaaacctacacttgtaccccagaacttaaaataaatgttagaaaaagaaaaggaatgagatgagaagagagaaaatcagagttgagattttaagatagtaagagtgtcctgctgacatgagacatggtttcagccctggatctatctgtgcttaaggcctaatatgctcctggactttcattttgtgagtcaagaaaatccctttgcttgtgctagtttagactaggtttcagtgtccacaatgctaataccgcgaggcacacgggacaatggcaaaaggagaataggttagtgtttcaaggagagaaaatattacgagggctctatctaaggaaaatgttagtgtgcttgaggaaccacgaacatactattaacatcactgtcactactactgagacagccaagtaaaaagggctccctggcagaagctcccacaggcctgagcactgggaggaatgcgcactggggtggagcctcaggaagttcacgccttttgcagtggggaggagcctggcctctcctgttgcagcatagtaacctggaattcagtgtgcgaggtggaaaactggctagccggcttctcgctttgctgatagtccttctttcccttttcatccaataaaccctgtcctggtcacccttcaaagtgtctgtgagcctaatttgtcatggttgtgtgacgagaaccccgtttttagctcaactaaagacaaagttctacaacaccactataaccctttatagcttctagatcttgatctaaggccctgggaatgatactcctacctaaaaagagtttcccaccaagactacctgtttatttccaatttgtatctcatttaatctattgtgctatcaaatgcaaggacatttttctagatgcagatgttatatattaaaagaaagggaggaaagagaaaggcttggttctggaagaggatagagagtgtgaagccttgtaagccaccagactgacagaaagccgtgggcaaccctaggagactgagaaaaagaaacctcctgacaacacagccaagcagaacaccagaaagaactacctacgccccaagtttccctaaggccagccgtggctacataattcgtcatatactataaatgaaatgggtgtagtttgaaatattgctttccactaatattaatttcaagaatctacttttttaaaatgaatataataactttgaaatctgtttttgctgcttttcctgattttttaaatactcatacaatagtctggtaactggtattctttttaagcagagaactcctggattcaaatacctgataattaaaggatcttttgatattttggcagttactctcactaaaagaagttacattcagcagattagaatgattcatgagaaattcttggttagtaaatatttaatccagattttataattgcctaaatctctttataggttatttcttgcaatatttcaagatcctgagtcagccatgcttatacaagcaaacttttatttactgtgtttctttgtgcatctctggtgtctattaacatagtacctgaatgagacagtttaaattcaaaggaagtttttgcctgaaggagaacagaagaattgggctcaatgggaattctatatgagtatctgagggcagaatttaggctactggaagggcagttagtagctagggatttaaaccactacaacaaagttttaaggaagaaaagaggtggcaatattattggggcttttttgttcccttactttccccaagtagaattattttgaaaaaacaaaaaacttaattgcacagagtattctcaaattatgtcatcctgaaatctgtcttgaatgtcattcagattctctatagtacagcttttatagatttaactgataccaaatctttcagccttgcagaagtaatatgaaaatataaggaaaacaactcctctattcgtagcatatgtctaaatactttattataaaaatgtcatatttaagtttaagagccaataatttatatagtaaaattcctagtatttttcagcagaaaaaagaaatataacacacacttatttccccagcattaaattagcatgtttcagccttaatattctcatatttgtattcttttaactacagaaatcatacatgtagttttatattttttaaaggcaaagagtggggaataaaacaatgttctttttgacatctgtagattgttctgtttccttcttttcctgtccacaaagccaccactgtaagtctgaccagtatcgttccaacgacttctacgtgtacagatatatatgtatacacacagtagtacatagcattgtgtgatatatatatgaagtagtctttaccacatcaaaagacaaagtgaaagaaattacaaatttaaaatccagaatgtaaactaaaaattctagattcagacttcagtggaaggaagaaataatctctcttgtttaatagcaatagattctgtgccctagggaagggaagctccttagggcacatagctaattagtgaaagagttctagtgggacaagatctcttattttctagtgcaatgcattttccatagcaacaggccaataatcgctaagtcacgtatcacatactatactatatttcttttcgtgtgtgtgtgtgtgtgcgtgtgtgcacgtacacatgcaagtgatgtgtgagtagagaaatcacatattggattacttaagttaaaaaagaaaatatgtgacattctgttcaatgtaaaaaaacaaataacgaacatataccatgcagtaggcattatgccagccagtgtaagagcaaagaaaatcaaaggagaaaaaaaaatgtctattctcattgggcttatagtttaacggaacaagattgaaaaacacagccacaatgattgtgagtgtgtgttttagtgtgtaaaaaatattaatttagttaaaagttacacaagaccccagagacaaggcaactgtttccatacctatgtatgttttctatggctacttcttccaaatatggcctctaccaacacacattgcccaataaagtagggaacttactatgggaaaaggagctgtgcctcagcaatgtaggcagagtatgtgaacgtcaagtcataacacccatatctctccaagcatatttaacattgaaataactttaacacagcccatgacaagtttaaggcaacaacacttcctatagactcatggcaagtgttcctatagcccatggcaacaatacttcctatagactatactaaataacaaagaagaagtacaaatgattctaacgaacagttatataagttgatagtcctgaatatattttaatcagctttagcataatcctatcatgtattttaaaaagtctttttactagatatttttaatggaaagtgaacaatttgcattaaaattaagttaattttgttgttaatgctaaattagacccatttgtgcaaggatgataaaacatgctttaattgtgtagttgcatcacaggtgccatttagtttgttctttcaaacattatctctgtaaatatacatattttttctttcttttatatggaagtaaattaattagatgtcatctgtagcacaatgctggacacaaagcaggtgctcaaaaataatcatttgatgaacattagagatttttggggtttttctgagttacaaagtctgaatatttataaccatatactaatttaaattgaatacttagccagagaaatcaaatttaacagactatatagcaaattcctgatagcactgtacccataacatcttaaatgttgcaggatgtataactctatttttcaaaaatattttattaggctctttcagaacaattgtagggaagaaaagaaatttcagaaaaaggaacagtttgtagtttgtggactgttacaattaatcattacactatgaattagatcatatctgttatacagatgaaagaactgaggttgaatgactataatccttaatgcctttggttgtaattctggaaaaacatttctgaaaaaaagctagttttgctttttttaaatttttttctgaaaaactgaaacaatttttaagtcagaaaatccaactttctccattatcaaacacctcttctgacttctacttatgatttctagccgccaaaaatgcctctggcataaagatttttgtatatgtttttaaagtataattttaaatcacacttctatttgataattggaaagatgcttaaaaaaagatctttcctaaccttttcatcttatacataaaaaatgaggctcagagaagtgaaatattttgctaaacatcagaatataatactggcagatgtgtaacaagaattgaatcctcactactagttcaatgatctctgaatgctccacttctaccaatttccagaattaatattgcagttaatttctagtacctttagtgatataattatagataaaaaatagtaatgacataatcaaggatgccttaatatctctattaaaattagtttagatctaaaatcaaccaatatcaaaaattatgaaaaatacaaagtaaattgggtaacaggaaaaaaacacagttatatttaattataagtacacagcagcaaacagttcagattgttgatgcttttgatgaccattaatgcaaaaggattatggattatggcactgtattatgaatagacaaaaagattagtgaaaagttgtttagcctagtagacattttgacgctttctgcgtgaaattgaaagataaaccagagaaccattgaaagttcatgtatcaattaataggtcaagtaaaaatgtatctaaaattcaacaagaagagattgttttctatttcagttttcaaatgcaaggtagtgaactgaaatcaaatcaacaaaataaatggtcccaaggactcttattataagtatacaaatgtgtaactcccaggaaatgaaaatataaatgggtataaatgagaagaagctataaaaacaaagcaatccaaactacaaataaagcctaatctactgacagtagctccacataataacctagaacaatttttaaataaataaaactcaagcattagctgacaaaaattatgaatgaagacctaagaagtaaaaaaatctacttaaatatatttccaagcatataagtatttttttaacttatgatgtgggagctgctcattgtataagattaataaaaaggatttcagaaaaacatttacttaaaaaatcataaatattaatcatatttttaaaattccataataaaaatctcatctcacaatttaatgtagcatatattaaaaatattccataataaaaatctgatctcataatttaatatagctttcaataatagaaaaatagctccaaatcaccttctaaaaaacttcattaaactgacacagacaacaaaccttattaaaaatttatacaaaacaaccatcatcatatacaattttcttcacatctcaataaacattaactaatgcagttgagtgaaagtcatacatattggccgggcatggtggctcacgcctttaatcccagcattttgggaggttgaggcaggtagattgcttaaggccaggagatcaagaccagcctggtcaaaatggtgaaaccttgtctctactaaaattacaaaaattagctgggcatggtggtgcatgcctgtaatcccagctactcaggaggctgaggcaggggaattgcttgaacctaggagatggaggttgcagtgagtcaaaatagtgccactgcactccagcctgggtgacagaggaagactctgtctcaaaaaaaaaaacaaaaaaaaaaaaaacatacatttgtaagtgtatgatgtgtataagatgatgatgatatgtgtgtgtagagagaatatgaactctctccagagagagtcaacgaagtatttttctataccagttcccttagaaaatcagaatcagaattgacactaaatacaaaaatttatattttcttcaacagtattaaatttaccaagtaataaagaggataatctcttgcatttactgttactataccattatagaaataaaataaagctaatttccaaggataccatttctgttctacttttattttgctgttaagaatatacaaatatggaacaaatacaaggttttattacacaattcattccaatggaaaaactatgtagaagcatccaacatgcaaaccattttatggattgcctatttattttatttgaaatagtaaatattagagataaaacaaaaagtacactaaaactgagaaattcgtgtctctatttctacccaaataatcttaaatatattcaaagagggattttatttggagtcaatcatctgatttttgttgttgttgttcttgtttcatctcactttgtctaataatattttgtcttaaatattaaaatcagagtaattatactgaaattatatatacaaaactgtatttcaacctgtaaattataattcttactagctattgtcaatcactctatgaaaagttgtatcgctttaaaatttgtcagaaacagcttcttttataaatctgttctatcaaaactatacttacaatataaaaaactcttcaaaaatttactttttaaaattccaaaatgtttaatactgcctagaattttaaaattgtcttaaagttagaaaaatgattaaaatatgataattaaaaagtatactataaccaaattttaaaacaccttatatataaataatacagctctatttgcctactcgaaacagcttctaaagtcaagtcaggaaagcaaatgactgtagggggtttgatagagtgtaaaatcttggatgcataaatctcattcaggttcacttccatatgccctgagggcaaagccaggcatgaagcctttgccatattacctactgaactgggtcatacgtggtaatatttgctgtatggtcttgtgatgaggcagcatagggagaaccagctggccaaggctaatgcaccatctggactgaaaaaatattgccaattccattggcagagcagaaacagagtttgtaatcgagctataaatcacaagcaggtcttgcaagttgtcaattaaaagtctgatatattgatgtcctcaatgcatgggtgacttcttgcttttaaaatattgctatttacataatagaactcttttaaatatcaatctctacctaataaaaaattactcaaagcacccataagaaacaaattcagcacattaagaaatgtgactcacaaaaccacaaaaaatgaagagaagacatatatgttgatcacacagctatagtggaatttctgtgttcaaatgacacagatttttgaacctcaaaatttaaaacttcaactcaaagaattttcactgattatattatcttcatgtttctctctgtttcaaatgaaaagaaaacgtatgcatatgcacttactctttcatacacatacacacacacaaattattgtacactatgccgccaaattactgacatcacgacacagtggaaagaacaggggttttagagtcaagtaaacctgagctcaaattcctgttccgttgcttactagttctatggtattgtaccagttacttaatatttgtgaatcacagtgatgctgcagtgatgttagaaggattagcaataatatatgtaaagtaacaagtacatagtagctgcacagtaaatggcagctgcattactgtgacgtaggcaaatgatacatttggacaatctttgattctttgatttaaatgttgtatgcatgtttccaatcagaataaatacgtgaattttagccagaaagcagagaacataaaacttaaattgcttagtaataaagtttttgccagccattcatcaaagccatatttcatgcagttaactcttaatgttttgttgttttatttttgtttttaatttgttttttgaggttatctcaattagatgatcccaggattgatcaagctctgttgtctttctgtaagaacttcttggataatcacttgacaactcaatcaatatgtaattcattgagcattcgataggtgaagcagcactatattaggtactttataaatttaatctataatgatgtattagcaatcatagggaacaccatgatggtcagtgttcagacttgatgaagactgaagcatgagagagggccagacagatattgtagagtccgtgcagctttctactaatttctatttaccaataaatatgcctgggataatataggagaattatagaaaggaacaaggaaactaatcaaggagaaagtagagggtggtttccaatgagagaatttcatctgcttctaatctaaaaaaaaaagacattgacatattcaatttgtagtgtcatatataacagttcttcagtaatgtaaagaactatttcaaggtcatatattagcatttggaggaatatcaaaattaatatattcaagataacagaattaaatcagtataccctctccatcctcttctctctctctgcctctataacagataatttgcacactcccttccccagtccattatctgccttgcgccataactctgcaggctgaccctctggactgcatcttgtttgccaactggcttcaatctgaatgtagacaatctgaggaaatcctcaggagaagtttggagagcaagaagacagagacttttaggtgttcactaaggcttggaccagggtgaggcaagcaaggcattcagggcatgaaatttatgaacaaaatcaaccttagagactaaccacacccaccaactccatcctaagtctttgcaaccctcaaaactacagctctctccagatagactctccttcatgatttcaactctccttggactggtcagcctgaagggtggtaatgactcaccaacgctactaatccttcttcactgtcccttatttttttccctcccaggctcataactcgaggttaaactctcttttatacaagaaccctgtctgatgaagcatcatttcagaattttaagtcaacttacaaatgtggtattattcacatctgagtacaaatttaggactactatcatttattgagtatacaaatatttataaagatcactatttttgtataagaagtggccttaaaattaattggtagcaatacataatccactttagattatccaataaaacagttttggctttcaattaaaattaatgtgtgtgtatggtacatgtttgcacaaaaaccacttcattggaacaaagaacgatttgttgttggattacatttctagttcttcatccctagccaaaattgacatttttaaacattaatgtaacctttgtgataaaagcagattaaatcgatggtatatatgtgatccagttttgcctgtttcttaaagctaacaattcataattcatttggtcataaatgttataacactaaaagacacataagctttttataaagggataatatatctaaagctaatattttcattttgcaaaggataaacctgaatgaaagacacagaaagacttgaaagatcaaacaaaacattatttgatcactggctactaaaaaataaacttttacttacagtttttagataaacatgtctaatattttaataatctcaaataaagtaaatatttccagaaaacctagaaagatgatgaaaaagggtgtatataatgcatactcaaatctaattttaagttaatgtaattgtatatatcaaatgaccaatagcaatgagtccattatttattataaagatatttttgaccaaacttcctcaaaatactacatgaaaaactgataaatgcaaattcaatgtaaaaatatttgaattttgaaataaagtaagttcaatatagtcataaaaataatgaaatagcaaataagtaagaacattttcttatttgaagatggaagacagtgctgaaatctgatgctttaattatgttttgtttgaaatgtaaaatattgagtaaaatgtattattatcttactacaatttgttttcactaatagttctttttaacaagaatcttttggaaactgaacaaatcataaagaacttaaaaaacaattggactgctctaggtagaacattgtcacttttcattaatgttcttttatgctgcttgaagatcaatcatattctataccatctagtaaaaaaagatcagtttctacatggagtgaaatgctttgtatgtgctttacatcatgaataaatacaatcacagatttgtttatctttctgtatcatctaattcagaagataaaaattgcatatttgctattttctaactttgctgttaggaattaaaaaacaatattctatggctatgaaaatttttctttcagagaaagaaaaactccagagtagcttctcttattggaaaatagttttccctgaggaactgtcataactagtcctcagcccctgtcaagtctgcagagtcctttcaagaagctcactgtaggcaagacaagagtagtacttcttccctattttacactacctgaggaactcactacctctcatgtctaagatactaccatctttaatctttctcattatcctcacttagaacctttccatatgcaaaacatttactaagagcttcaccaaaggaattaaagaacatgctttttgcagagctgcctccacaagatacaatgaaatcagacgcaatagcaaaatgatttttttgttgagacagaaattaggtgagtagcattttaatggatatagtaaatatcagataaaccaaagtttaaagaagccctcaaaactgggaggaataattacctcaaatagttacatgtcattttcttcatctggaaataatagtctaatgtattatatagcaagttctctttcattgtgaaatactttacatgataataattatcataataatagctaatatttattgtgagctcagtttttaaagtgtcagtcactgagttaaaggctttatataaattatctcatttaaccctcattataatttgtgagctaagtattataattactgataccatctcacagaccaaaagagtgaggcatgtatcagatcacacacagacaataatacaagaaatgactaacaaatcagaccaacatgctacactgcttccctacattataaatgaggcaggagctcacagctcataatgacaccaattacttttgccatacattttggaatcattatggttcattaaatcctaatattggtattaatgctggccaatccctttttgaagaatgcaatgattatcttctcaattttaagaaacaatttatgggaaggtttaagttgtttacaaatatgtaatacgaaaaagtatgtaaagtactcattgttttagaaaccatataaaaaggcatacattctcattaaatgcatgtatttcttccacgaatatttgagtgtcgaccatgtaaaaggaactgtcctaggtgctgtgaaaccttcccctgagattttcctttgagtctcattactgaatatctatatataataatggcagggacacagaggtaatgatatagcattatttagaaataatagcccatataatgccagcatggtatcaccatcttaggcatcagaataagcagcaggcccctggaaacagatttcaagcactaatgagcagcgatagccaaccaaacagcagtctgttgtttgaaaaagattggtgaatctttataatagtttttcacaaactatctatctctttcaattcagtttcttttgtgcataatactgctgcatagcacggcagaaattttgtttgtttcaagtttgacattttaactaccctgtcctacattaaatcagttggagatagtcttcaaatgtgactcacagaaaacagcaaatcttttcactaaaatataaactcatagccccacattttcatttccccctcccttgttacctaaatcattgaagcaaaaatgagaaaagtcattacatcagcgaattagttcgcccaagcagtagcctcaaaccacaggttaatttgaactgttcacatataattacttaaaagaggaaaggattcattacttttgtggtgtttgctggttcactgaaccattgttggagattgtcaataaacaaattacatctaacactgtacccttctgctgaacagtcccctgagaatatcaacttgcacactatgctttctttcattttgtgtgtgtgacccatattcacatgctcttgattttaacattttaaaacactgtcaattacataaaaccaatctaagcagtcaaatataaataggactattaaataaaacatatatgttgttacacagggttcgcgtgttttttaagcaagagcttcacaaatgtgaccctaaaattttaagtagagtagtacgtctgaatttttcttgtgagactgtccttaactttgattagctttttaaaatatcccagcctacaaaaaatatcaagaaaactgttttgaataatgactaaaaactaagaaagcagtaaatcgagatgtgataagaggagtggggtgacgggaaccacttattcaccacaaacaaggggccagagttaaatatatctactatattatctcatgagatgctcaaaacataagggtgatagaactacctcgatttttagatgaaccattaacaatggactaagagaacctgcgttcgaatcttaatgtttttgactcttgcgtaaacgtatccctttaatgtgcaaatatcactaattctgtctgtttcactcagacattataaagataaattttagaaaaataccgcaatacctctacatgtgcttcactcaggtctctataaagtaaagatgctttataggtaacagttttgattcaaaaagatgtctggaaagcaaaatatttcttcattgatgtcctttattaaacaagaatatgcttccattaaaagtgtttcccataaactatgttaaaagatttgtacagttaagtagttagtacttggctggatcattattgttagatggtttgcattgatatgcttttttttttttttagcactttcaaaacattataaacctttcctttcctgattcaaggacctgccttcatcttaccatgtcttcctctataacagttatactctaatatctgaaaatccccagatattatattatcgcttctatttttccttttctttgttttttcttacaatgttaaacaaaaagaaacttaagcatcacatgtattcattaggcatatcccaattccctgtaatgtataacctgaaaattttaaatagggtaaaatgaattgaattaaagattagagaccaatatatctcactgaacaaaatacgagcactgtaatacatctcacaaatttgtcttaatctgtgttatatcatgtgactctgaaatagtttattcaatcaactgatattaattaagcatttaatttgaccagtcatcctgctaggtgttggacatatcttggtaaacatgacaaatttggaactctctccagtgtagtaacttttgtaacaggtcctaatattgtcagtactgatgcatatggattcatagattacacaccacacacttctaggcattaccgtttgcacatacaatattaatggtccccccatgcaagttccctcagaggtcctgaaatccatatgtcatcataattctctgcttcttaaaaatgaatatgtggcccaggaggcatgtaacttatagggtaaacatagttttgagctttgaaaaataacatcacatcttattttttaaaataaaaacataaagttgaaaatccacatacaacttttaagataaaagactttcaagaaatgcaacgctattgagaagggtaacattggcaggggtatcctatgtcactaaggatataagacatacttgaccaatactgtgccttgttgcttttgatacactctcattataaccattagctaatgtggggtagttggaatatcatctgatttaaatttgggctgattgattatgccatttactagacatgtgatcttgggcaagttacttaaatgttgtgaacctcagtttacccatttgtattatgaagccaacactaccttcttcaataaacttcactggggttttatatctagatcacctggtacacaggaaattgagaaaagtcatcagttctttacatctctccctggagttattagatatgtgctgataagaagacaatatatttaatacaaatgtttaataattgcttgacataagctatagagtagacataaggtatttatataaaatctccttgttgtataatatctactctagcagtgttcagtataacagaatcaatcttgtggtataacagctattcttccacaactgcatgtgtttgaatttacaagccatcaaaataaggggtgaattagagtccattttattacctcatataattgcagtacgataaaacattggcaaaatatgagtttcagaattttctaagcaatcaccttctctatttttattagggaagcagtatctcaaaagtcaaataatttctgtaattgaagaaagagatgaatggctcttgtgaacctccaaaaggataaaatgttatgatcttctgtaaaacatgaataaatattttagatttgcctaagtaattagtgggattttattttaagatagcacttattgtgattgttaagaaaacacacatgagcatgtatttcatttccatttaaatgaattatctttccttaattctgaagctatcatttctatgtatagacataaaaaattgtttatcccaacaagtaatagaggagattcactcctgaaaaggtgtttaggaagaaaagatgaaagagggggaggagaaagaagaataaaggaagcagaagagaaagaagagaggatgagggaaaaatggggaaagaagaggagtgtagggagaaagaaagacctaagtttattattttcttaggtggaggaagattcacatttgcattccaggggtaagtggaccaaaaggaggcagaaaaccaccctgaattatcccatcatcgcttaactgtcttttatagaaagggcaggaaaagcagtgcctttcagcaaaagtgagcatttctccatatttctgtctccttcagtgcttaatggattagggagcttcagacaggagggatgttcaggatttctccctatttcactttattgacaaaacactccaattatgtatatttgattataccctctgctagatcatgtcagtataggaatggatctttatccacagctataaagacatttattactttctaacagacttaagttcacaaattgggaggaactttgttctactgatatttgatccttgtaaatcctgagaacagactctatttatctagcacgtgtttaatactgcttaagccctgaaagttgtaaaaattggaagtagtcttatggaagtcttcctgaatgttaaatacatcttagaattacagtttaattttgtaatagattacttattcaagccactatatttttaatatgtgactacatttcccaaaagtatagttagttttgatgagtccaaatcaagtattattgatcaagaactcagaattgagtagttttaaaataaagacaaatatttgaaatcagagtcagcttttgctactagccatgttcttgttttcacaaagccatgttttccctgagacacttagctgatcttataaatatttaatgcagggtagaagtgcagggaagaagaaatatcttttgaaatggactctataacaaaattaaaagtaggaacaatggaaacaggggaaaaccaactaaagacaaatgatttaaaaaatagataactttcctaatttttcaactcaagaagtagaaaatatactatcttccttcttttatacttatgctttgatttctacagagacgtgataagcaatatcagatactggagatttcaaactatacgtataccagcaattttgttgtggagaatgtgacttggtcaaaatgctttcagcagaatcaaaactaagggatgtttagaaattcaagaagaatgtggaagaagaaattataaaatatttctgtacaaccggtggtggtagaggagaggtgtttggcaacgtgtattttagaaccaatcacggaaagcccgtgaaactaattctctcccaatttcccctgccattccaaactatacctgaatatggaaacattctaataaactagtaacaaaaatactttgttcaatgtcttagaaaatttattccacacactaaagtcaacatgcatgagaacacgtttggcctgtgtctgggctggcctgggcaaatggtactggcttgataaagaacacatattttttttatttgtagcatatccagagacttatttctaccaatcaatctaggtgtccaaatgtattcttagccacccccacagaaattgcccaaaatgtgccaagttattgaaaaagcatcaatgagcatttgatttctcatacaagacataaatcagaactggaccagaatctaatgatgccacaagggtggaaggttgacacaaaattcacatggccattttccaccctgtaaggtttccatatttagtcctcaagaacctgagcccttctagtaactaaaaaagctaaagttctttagagcaatttcaatagagaagaaatattgaaacctacaataaaaaaacagtgtctagaaacctaatttatatgtaatcagagaaagattagaatccataacaattctaaatattaattttagcattgtgtgtatatgttagtatatatgtgtgtatgcgtacatgtctgtgtgtgtgtgtatatatatataattagccaataacaagagagaaatataaatttaacattaaaatactaataaggcacttaaaatattttgttcatataaaaaagaaaaatatttattgaaacttatgaatgcccaacttataaatgccaaatattttattattttataatggttgatccagtctcctttcttttgaaaccagatacaataataactaagacttcttgatttttgtacatttagcagaaccaaatctattccctaagtcattactcttttcggagagccagtactcccaaaataaagaaaaactaattggtctattatcagtattaatgtatgctgtttagtgaggacgtactctaaacaagacactttgtgaaatactgtgcataaattatcttggttaatatattaatgatttttattccactaatagtgattttatgagtattcttctaaaaataaatagtatttaattggtcaagattgtacagaaaaatacactccatatttctgtaactctgtttctactacctatatgatggttgtataactcctcacattcttaatattagagtcatacattttctctatcaagggaaactaccatgagatgaatcaaagcaaaaaaaacctgactccttaacattttgaaaacatttccagtatgcctcactatggtagaaactggaatgtaaaatattatgacttcatttgatagtttttatggattaaaatatcaccacaaaataactacatggcaacacttgataaaaatacattttaaaagtaaatacaaataaaacagaaacaattacaacatttacataattatagatcatgttcctaatcatgtccctgtacattaaaagaaatgtatctgttaagtacacaaacttaatgaattttaaaaagaaacatattcaaaaatcaaagtggttattctgagaaaatatgattgtaaaaatagcctcaatgttttttagacatgctaaaataatttatttgaagccaatgatatctgtataagtaaatctgctaaacatgtgaaatatttactttggttgtttatgcacaaacagctaattaagttgtcaatattatattcgaacatgcacatatacatatatactgataaacattcccagttgaatgctttaaaaatataataagattcctttttatgtgcaacagtagataatatatagtagtattctgcttttatttgattttcatataaagaagtaaaaactctatgtctgaccactccccaaaaaatacaatatttaattgcacttgacatttctaattcagcaagactattgttttccttccattttagatgcagtatttcaagaagaaaacaaacaaactctataaacgaaagcctctctgagtatacacaaacacaaaccccatcttagcactgtgaggcacaggaaactcctgcatgatggatggttgctttgctagaacagtcagccatggacactcttttgcccctttgccccatttctttatttaattatatggcactgggaataccaagcaatgaaattgcattttcatccatagctgatttccatttagagcttgtcatgttaatagtgaaataaattgctctaattgccagaaaacttcatcaaattcacatttcttccttattttattcaatatttattaaactgcatatcctaacatgcctgcctggtaaaagcagcccagtttctgaataaatttataccctaacatttggtgctgccacttatttttttttactagtgttctaatttacttcttaaagtttggatgcatttattcatattgtttttggaaatgtttattatgaagagttacttacaaatttacttacccaaagttatttgacacttagaaaatataataatttaaataaaaaccaattaaaattacttatgtcttctgttaatataagatttaattgtaagatttctggatggcatttttaattgactaaaaaatattttggttcccataacacattattcctgaaatacttccaaaaaccatttgagagagtttaaaatgaaaggccaaattatcattaaattattgagtaagagaacagacttcaaaataaaaagtacatcaaacttgaagtcagaaggcctacattccaatcagagctcagttactcattatctgtgtatcctgggctcagtcatttagtctctcaaagcctcagtttccccctatgctaaccaaagaactggatcagatgacctttcagatccccattagctctaaaagctatcattctcataatagaggaagaagagatgaggagagcaaagagttaatctgacagcagggtagttcctctgactaaatacaaatattagttcttggatccccaggcaaaaataaatcatgctgactattggcaaaaaaaaaagaggaaattttaactaatgctttaaaaatatattgcaatagtactttgaattgcataataaaattattcaatactagttataaaaagtatgcagaaatagctaccactttgcccttttttatgtccaccaagaacacaatattagattgctgttctgaaatgcattttcgcacagtttttatgtaatacagacaaggttttcgatttctaatcatttatctacatgaaaagcatagagaattgaggagaataaacatttagtatgtttctaggacgggtcctttcaaataagaattattttgtgtcttttactatcacatacaccatatgagattgagatcacagtctagtgtttaaaatacagagatttcatgtagttgctttaaatagcaggtaacatgatgcaaattaatattttcttttgaaaattaaaatatttgattttctttgccccagaacaggccaccacactttatttcaaagagttctctaggagcagccaaaggtagactaatgtttttgaacagcagcattgcatcttctcacatgtttaacggaatactagattgaagtccccgatccatgcattataaccaagagacaacgttatctgaatttttgagaaaggagttgttgtattttctatctctaccttaattctctccaaaaaaaattcctccacaattttatagaaaaattgatacagagctgaatgagctcagatgagagttgtctaataaaaatacttggttgtttattttgacataaatgtcaatcattgaagaaacataggcacaccgtctggcatgtaataggtattaaatattaactgaatctgaattaatatggacctcatttttctgaatattaccagccaaattatagtatattcggaatcattcacaaaaataattagtttttctcattcatacattctttgcagaggacagcaagaatcctgaatgtataacacttcatattatttagatactagttataaatgaatgagtctgaggaaacaattttgtttataacatttagaactggcattttctctatgaaacgtctcattgctacctacatccattctccaagtggtatttctttaaaaggttctgaagaagctttaaaagaccagaatttatttgaagttatatagtttgacctctagacaccttctgtttaaagtattaaaggttgatcaatatattttgctaaaatatcttgccctcaacatcttttcccctcaactaaagagaaaaaagttagcaatgatcactagaaaaaaggctgtatgcctaaatcctatgagttctctatgcacgatactaggtaatgaaacccaggcatgtatttccttgagggtaaagtggattaaatgtgttgaagcaatattcaataggcttaacattctataatttggccaagctataagattatccttttggtagtcaaagtaaattaaaatttgcaagcatactggggaaactacattagaatagttaactaggggaaatatttccataggatttgggtccataacccaatattgggtaaaaataaccccagctgaagaaaaagtaatctcccttgaggaggttcttttcaatttaaagtgtataaaattgctacagtaagttaatttgaggaaggatactctggtttatcaaatttagaatgagcatcacagaacactaaattagaagcaagctcacctaacatcagtgcaaattttaaaactggaacaatgacagtttatgaagaaatatggagaaaaataactatttaaatatcttgataagttaacaccctctgatttgagaaccagactatttacgtaatccaaagaaaaatacaaccaatcaacacttttagtctgttttgattttccactcatttaaacctgcaagcacataaaggacataatccttaaggaatttataatatacactgattaacatatttatccaccaaatattcattgaatacttattataaaataaatgcttggttaggcactttagcaaagatgaatgaaacagttttagttttagtcctttttcatgtttaaaataaagacaatgagaattacctggtgagattatcatgagactaaaagactagaatgagatgtttataaaaagtatctagcagagtgactggtgaatagcaggcactcaatcagtatttgttatcattccctagcatagaaagcaaataagtactctttaaatagtaattttaagatgatgtaactaattcaataaccaaataacaatcaaagactcttcaagtcattagttacatatgtatttgcacctctctgctgcaaatctgtgtcatggttttcaatgccatggtaagctttgagggtattttttttttaagcaatcagagactttcaaagatttgtttttcagaataaaattaggacagttgtgttcttattaatgacaagtgacaaattttaaactgtattctatttaaactcaggagatgttatcatcctatataataaaaaaaaacttttaaaatactaaaattgtatatcaacatgttgggccatgttttcagtgctggagttcaacccttgaagtaaaattttaaggctctaactccccaaatgttaaggtataatgtaactgattctatagaaatagatgcatttttctaagtaagtaaacaggtttctataataaactgcccctcagttaaaagtcagtttattttcataaagtctaatatagggactattctatttttaattattttatcaaatctaaaattagaaattcaccattctccatgttataactataattattaaaattaacactattttaatatctttcaatttgcattttcatttattcaaatatcatcaccttaaacactgttaattatactctattgttcaagacatcaaatttatgtctctttatagcggcatcagtagagacactgacagatgatattcagcctccctctattggggaacaaggcgaaaacattaacctgattaacccatgttacttctctgaaattattagtgaatatttgtttttctttttcatgccaccaatattttttactccttacagcttattatacataggcatgtgtttgaaagctatgagatttcaatttactttgtctggcagctgttccctaagtaattttgcgtgaaccatctaatctctctgttttgagcttcatatatatgtatatgtgtgtgtgtgtgtgtgtgtgtgtgtgtgtgtgtatatatatatattccagaagtttatagtccaaactaaactaaaaattgggagaaaaattaactgaaaaatattttattttccaaaaaacccagaaatttaatgattgctattttaccatgaaaatcaggaaatattcatgagctatccagttcatacagcaccagtgtctggtagaagtagaatgtaaaatgttctcgcagtcaccatttaaaaagttaaaaaaaaaatgaaattcatttacataatatatttaatatatccacataaaattatcaatgagctattttacattcttttctatgtagtaatcctttaaatctggcatctattttacatgtaaagcatagcctgttttgcactagtcacatttcaagtgctcgatagtcacagtgacttctgtactagaacagatgttgacagtacaaacttccttgagactaggactttgtttacctatttctaatgactaggacattacttgatacacagtagaaatccaacatttattaaatgaatttgtcaaattagtaacttaggttagagataggggtcatcaaatttttatatccaatcagaggggctaacaatatatgccggaatactactggcagaatatgtaataaatgaataggaaaatagagaaaaataaaaataatatagaatgagataaaagtgaaaaagaaagaaacaaaggagttacacaatagaacaaaaaagaaacagatatggaagaatgagggagaatcccatcaactgttaacacacccatcctgagttttaaaataaatcctatcaccatagagttgcaatttagaaaagaacaggctgttgactgcccattaaagctatatatctgaatatgtcactatgtttagcactgatcatttttaataccagtttgtaaagataaaatgaatttgtttctttaaatgcctactttcagactattgtctggagagaatcaaaactatatgaaaaaagtagactgatcacatgcatccacctctcctcaagtcctaaattttttaaaaaccacaaatgggaccattttgcagaatatattcataacaattttggaaataaaaaagcttctatccattaaccagaagcaaaaagtttctatcagttaaccagaagcaatgacatttcccagatggaagaaattagatgacatcaaactaacaaatgcagagaaagccacatctacagcctaaaatgtgcacaagagaaatctattagagcaaacataaagacacataaactcaactcctggtgaataaatacagaaagggagaggatgcccaggggcaactgtcaaaatcgtgatttaaagattttcaatctaacactgaaaacagttcaactcttcaacccctatatgagtagattttgccttgagataaagccacccagttgtactctgaagaaagcgaagatttttcctggataggcatagggtcttgaagtctctctcataatcctatgtttcacattgtaactgcagggggagaaagcaaatgaaatgactttcccttcaaggaactactctaggatggccccggtcagaaaaagaccctgtttatttggtgaaactggggaattcctaacttgtctgccttctcaatatgaacattgtaaagtgagactactcttgtttgctgccatatatacttgaattttttttaatttagtgaaagttgttgagtggtaaaattttcaagactcattgaattagaaattatgcagtttgtccatgaaattgtgtattatccatcttccaattagattatacattctaataaaatgtctattttagcctcaaattcattaatttagtgcactaaaattttttttcttgctactgatattgttggcaagtactctttccaaattacataagaatcaattgtcaaattaaaaagcaaacattctaattaaactattttaagcatgcaagcaatatatatagttctgtaaaaattaatatagaatccaaatatattcagaaaaaaattatcttgttttctattgaagtgattgatcaagatggaaaacagcaggtatatatctgaatatattaaattgaacagctttagattagagtgaagcagtttggctttattcttatttgctttattttgcttctcctcctcctcttcttccttattttagaagcaaaagcagaactgaacaacatagtattaataaggaaaaaaaataaaatcattttgattgtaaattttcagaaaaatcagtatatttttaaaagttactatgagctaaatcagtagtaagcccttatagttttaaattcatccactaaagaaaaattaatgtctttttttaattttcaaagtacagtgaataatactggaaatattttggcaagtttcttttcatatggtaaggacagtggaacatgtagacaatttagaaattaatgaaaccgtattaaggtaaatatatccaatttggataccatatagtaatcaatgttatataccaaagtgttcttccatttacaaaccagtctataacatatttttgttatgcataaatgttattactgacacaaattagaaattgaaaagagccaataaacattccagagaataccaacacaatataactttactatcaaataaggtaaataaaagatatcaactagaggtcttacaacttttgaaaaattaataaatttattctgcctacatgggcttattttgtgacagcattttcatttacataatttgattttcatatattttatatatctcagaacatgccaagtgtacaactaattctggtatatatatataactaactccagtatataactaactctactgtagctcttcttttttactgtcaatgattctagtttattaatatcatataatatgtatactttgatattaaaatgtctcaacttaaaataatagatgtaattcaatgctatgctcgtctatcccatctgtgtagaagcacaattaacatgccattttatgaatatcatgaaatctcttagaatggcattttaacactattcccacaagtcacaatttagttttgttttccagaattattcattgagtgaatttttaaactatctttgtttcttcatttaaaaatttgtctttattcttaatatccttgggtaacatctattaatttggacccacttgcaactttcattaactactgttcaatctcctgaatcatcaaggtgttaaatgggatagaatctcaaagttcttgaggcatttttcagcatgaataaattttcatttgtgattatctccccttcatcccacaatttaaacaatctacaaactttcaaatacacttccagatactagccaaacagtgaaaaatatagttaaatcagttataagaccagaggtcttctcgctaaaataaagtaagatcctactttaagttggctaaatttatctttccctaaaatgctgaattcactaagacactgagttatgaaagcatgttattaaattattttcaaagttaactgagatcagttttgccaaaaatatttttaaaagcattgaattgaaaatcttgtttttaagtttgtatgagtacatagtttctcagactttgtctaccccttcctcaacttggttgacatttttacgttaatttttttcaagcactttttttctgaacacattcccaagaactgatgattcaaactatcacctctggtgagttaacagcatcccaaagtggatggcaagaagtttagatcaaagtctgtggtattacattaaaaaaaaaaagaaaagaaaaatgaaacagttaaattaattcattagaaaaaaattagttatttggttatcttgaaagttcttatcaagcctcaaaaattttcaattctactaagcagtatagaattttaaaaaaaatccaaaataaccatattttggtgattttttttaaaaagaatcaaattttgaagcttcaaaagatatttagaattaaaaactaattagcacgtgaatttacttattgcttaagttactaagagagaaattaaaggaaaatatcaattaataatgaaaagtattagtcaactgcttaattgtgatctccatccaggtcctttaatccagaaagagcctttctctttcatttactattctactcttggcaagtcatgataaatcatcatcaacattatttctttcattactttccattgctaacagatgtagggaccaagagcttaaattataattgtataatggactgaggctgaattaattaacaatcccaagcttgtgggagaatttaagctaatttatttggttttttaaaaggctagtcacagcttgaggtatctttctgtactttgagattactgaagtcatgagggaacaggagctttgagcattattacacaccaaaacagataagttttaagtactgtaggcaaggatttcagaaaatgggtatcagctacaagccttttaattttttttaatatttgattctactttactgctgttacacataacacttcaaaaatataaaagtataatattattttgctcctctgattttataataactcaagaaatgacaatgagcaagtaacacatcattttgagtatccgggctagaggttcactttctcttaattaaattagtctcagaaagactgcagcaattcaaaatgagaatccaacacgtggcttgtgaggaaattctaaataagatacacatagacacacatacacaagtatacacaaatgtttacacatatatcacacacataattattatttttctcttctaaatttccttaaaattatttttaaaacaggtatatagcaacaaataactttgattagatactgattctatgctggcaaaatagtaataatattgtacaagaactctaaagaatttgatgtgtcctattacagttatagtttcttgtttgcaacttttccggagctatacaaatatcctgccttatctgggtagaaagcacagttgctttggttttttacatggtctgtgtcacttccagttcacacaaagtggtacttagctttcctcgtcaccaaatacaatgtcagattccgggcattttgttaatacatggattttcaactttgaattctgatgccaaaggagagatgcatattatacaaaaaactttctgacacaacagagagccaattattttctaaaagtaacaattgaactcacagaagacatatgtacattacaatatgaagctaaatataaattcacagtcagctgcattattaaattcatcttaatctattaatagatatatctcaccaaatatatgaggaagtaaaaagctaaatattgattcctaacagacaaatgaaaaaaaagaaagttccaaataactatgtgagtgaccagaagcataaatagcatgctcatggctttaaataaaacaattatccctgagaaaactatcgatgattcacagaccacctttttttcctatgtatcttttactacttttctcctaatactatcctcaaaaacaataactactttttggatgattttttttctgttacttggagtagtatggtgcactgtaagagtcacacacgcccacatgcatgtacacacacacactgcaagggtgcccttttggatgccgtagaaatgtgtatttccttttacagaggtgggaatcacttgacaattgagcattaaagagcatctgaccccaaagtagtctttaatcaaatctgatggctatgcttttgcagaaagtgaatctgaagttcccccttttttccatcatcaatcttcttcagcctggcattcatcaagctgcatggaaattcgcattcacgctaagtaagctttcaggtgaatttactttggaaccccaaatgatccagtgtaaaggtccaaatcattctttcacagtattgcacccagatagtccctggcattctgataaaagtggtttgtcaataaaatgctgagcgaaattgcttgtttagatgtatggtgtcagttgagagactagtagctgagcaagcatcttcctaaaaaaaatggagagatttttgagtggttaaaaaacacttgcttgtgatggttgcaaaactatgtgtatacactaaaaaccactgacatgtacactctaaacaggtacatgtatgatatgagaattatgtctgtttcaataaaactgttttaaaaactacttgcttatagttctgtgaataaatgttagtttatcattaatctattttatgtactcagctgcaagtcgcaggagctattctgaggtgattatattaaagataactagattaaaatccagatgtttttcttcccttgctcatttgtgatatgttctttatttgatattttcaaaatcccatagttaatgaattttccaactaaaaatgtaaaattgttgagtgtctgagaaaaactcacaatgtcccaataaagtatttcagccatctctttacttttgtttccagtaagttcagatttttttttccaactaatagaaaatcagcatttgcaatcaaaaacataggctaaaaggaacccctggaaattccttgatcttttcagaatcttcattcaggtaggagagtaaaagagctttgtgatagtttaaaaacttttaccccaagatattacatcgattaaagaatcatattatatccttaattccaaagcaacagttcctaaattccagtcatcacctaaactaggaatcacttgaacagctggttaaaaacaagattccagaccacatggctaagactctgatgctttgaagttgaagtgagtacccacaatcagcattctaactaccacctcaggtgatttttaattcaagagatccttaaactatattttgcgaaattaatcatttttgtattatactatatagccaaaatatgtatttcaccctaaacatttaatttcacagaattcttagaattacagaagtttctaaataaagagaacttcaggaaggtatccagtccagtcccatgctttacagatgaaggacttaagatcaaaaaggataaatgtcatgcctcaaagcatacagatataaagtggtaaggctaggactagaacttactcactgggtttcaaatttttctgtttagtttcttcctgtgcctgtctacaatgaaaaaaaattctttaaataaattaacctatggaaaaagaagtttaacaaatagaaactacagaatcactttaaaacaatgctcaaaacttatcttttcaaaatccacacaaaagaagttaaaaaagagacagcaaaactatatgctttatccttccttaagttaattaaaataaaggcaaactttcattgaatacttatgcttgatccagatagccataggctaagtgttttattcttataatcctatgaagtaggtaaatttattatccctagtttacaaattcagtaaactgagtctcagaagtattatataaattgccaagagtcacacagccggtaagagggaaaggcagccctcaaatgaaggtctaaatgaaaaagcctttgtgcttaagggttcagtatgtattgtctataaatacacctgcttagtttgggttatattgttaaattggaggtatttaaagttatctgatataattactgttgtaatcagcatttctttcatttgcttgttttgcaaaattaggaacacaaaatagcacaatgaggaaagaactttttcccagtctattgttttatgtctttgatttctttcctcctcaaagggattgttttcaattagttatttcttttgctcaaaataaaagttgttacaaataaattgggttagtctctatagaaagagagagaaaaagacaaaaaaaaatcagaaaaaaaagaagtgtaataatatatcctccttgttgcaaattttattttatctagaacattttaccagctttaatagttgttttatgttttgtgggtaaactgaagctgactcagtggattggagttgagagagttgcctaaaacccaagtagattgttactaagttatattaataacaggtaaatctactgaacagaattatgtttcctgtggttttgcttaaaaggcttcttattttttatcatgtaagtcttgcccgaagctgaaacttccggtcttcttacctacaacagcacataatgaaggagacagagaaggtgaaagattttcacagcattactggccaatggcattttgctacatgccatggctacagagagccagtggggaccaatcctcaccatttttcagtgttctctttgcttcaggttcttgggataatagatataccacactttcaatccaaattcagtgatcccagctatgacatcactgaagtctatgtcacctccaatacctcaggactgtgaacttactaccactccaggcagctcattttgtggcacaagtcaaattgctcaaaatttattcctcttttagggtcaaaaatgggtcaacatataataacttctacctattgtttttacttttatgtagacaaacaaaatatgtctaacagttttcatacatcacagccttcaaatgtttgatagtaaggaacaaatacacccacctccttcccgcaggagtctaagttttaaacgtcctcagacattccaattcacttttcctgggtttagtttaactgttctggtttgtttgttgttttttatgattgctgttgttatttttgtgtttgtttatcttcttgctttgaggttaaatttgtttgttttacacaagtacttggcccaggtttctcaaaacattcaagtcagtttaatatgtaacctttctaaatgacatttctgtagcaagcataagcatttaaatccatgtaagattgaatctagctgtcacttaatatattatggccaaatggcaaagcaactttgcataagtgaaacattatttgttacaggaaactttgaattgcatataagtatatttttatctaacgtctcagtttttgattgagaagacagaagctccagtggctacaggttatagctcaagtcatatgcctcctgttttcttctaaaggctgatttccaagttagtaagcaattagaatgtatctctttatgtaaacaatgccagcccctttctcaaggcacatcatttaacacatatttgttctgtaagggtattaatggactacattatcaagataacttcatgtcgttccaaagctaggggccaagaacacaatatactctcatcttttcaagatctgaataggaatccaagcatcctccattccttccccaaaaatcccactccagataagtgggtggaattttcctccatacagccccaaagcagttgtttctgaatcttaaagcaaccagtggacaaatctaagcaagtaaaagtgatggcattgtactgaggtgagggaaaattacggattagggttccaggtttgcgggatggaaaaagtctgatatgttctgactgggtaaatctaccaggccgattactgggtacatctaccaggcagatttacgcagtcatacttttatttttttcctgtggctgccagcatatagcctaccaaatcccttacctactttcttaggggaatgaaatgcagtttcaagtacagtcttttttttttacttcttcttcttcttggtaatagtgaacaaataagaaataaagcatttagagaaaatgtactctgatcctccagttcctgatcacgttccttcttaacactccataggcaagagaaaagtgaaataaacattaactatagattttctcactaacaggactaaaggaaaatgtatttacatgacagaaaaaaaaaaacaacacaagattctggctattatattctgagttctcagaactggaaagaaggaaaggttgaaagtctctgagggcaggagtgaagctaggggaaaggcttgagggtgctaccaaaaagacaagcattgggacacagaaagccagggctaaaaaaaaacaaagaagctatcattcttatactttactctttttctctctggccctagggccaggtttgttgttttgttttgttttagtaacaggaggatcatgattacttgccctatataacctccccgtgttgttgtgagaatcaaatgaaacaattacagtaaagtgccttgaaaattgtaaagcatgacatcaatatattattattattacttgactccaaagtcttgtttggtaagaaaacgaaacaaaagaaaacctgaaaaaactgtttctttttgttgtttttatatttttatttttaaaacacagatatgaaaagcagaaatataccctattaccagaagttaaatgaaaaactctcactgtagagttttaatatgagataatcacagtggaaaaggaaaccgatggtaatcatctacattaaataaaatttgtgggctactacaaaaaggtgctcttttactaatactgtaacatgcactatgttattacaatgttttaagttttatattttgccatcgtgtaattatgatatattaatgccttataaagtgtaaagtgattaaagaacaactacgtttattaacaaattaattgagggactacagattcactaaggtaataaaggtaagcaaattcctaccaaatacatgtttttgtagaagttgacaagagcttaacttaattagaatctaatataatttaagacactgaactgtttatatggcagaattaaaaataaaacaacagactgggcatagtgcgtcatgcctataatactggcattttgggatcccaagagttcaagaccatcctgggcaacatagcaagacttcatctgtattaaaaatacaacaaaacattttgattagctgggcattgtggcacatgcctatacttccaactactggaagctgagatcacttgcaccaaggtgttcaaggctgcaataaactaggattgtaccattgcactccagcctgggcaagagagcaagattctttctcaaaaagataaaacaagaaaataaataaaaccacaacaaaacctgtatctttgctaatagctagacttaaatttgagaatctttgaagtacaattaggcattaaaaacacccctggaattatgcacagtgacttagatgtctcggtatcattcatggaatacccaccaagacatacattcttcataatttcttcaaaatgctaataagttgactttgtgttattaaaatggctacagagatggaatgttgccttcctgtggttgacagtttaagaagaataatataattaatagagaataatacgattttgttggtacaatgcaagtttatagatttcacagagtggatacaatatttatggtccttctttcatcttaggagtcattatcttatataactctgaactttgaaaattgagcctctatgcatgtatgtaaaatgctgaaatataaccctaaaaatataaaaatagttaggcttttctgttgaggctggaactgaagagtgaactggcttaggagaagacagaattggcctgggttctagacatgtgacttcgggcaaataacttcaccaacttgatctctcttttccttatgtgcataatagggatagtaagagctcttaaacaatgctgctgtgaagattgcctatgacaacaggaaaggtgcccaatttctgtcacctggtaaacactcaaaaaattgcctttctcttaaaatccaaacctctttaaaagctataaaaaaaaatccactattttaaaaactattttatgtgattactaaatgtcttctagaatatctaatctttatttaaaagatatttgaatgcgtatacattttagaactcctatcacattcactgcatgccaagtaactgttggggaagaggttattagatgaaaataagtctgttgtaaaagatttccttgcaattacttcactaccattaccctggccacatgctcatgcagcttttcaaattaatatgcctagattactgagccagtaatcagagaagtggaattctacgaggaactcaattactaaagaaaatgatcactcaagcatttgagaaattggggctacaaataattttgaatagtggatcattattgatattatggaagcattcggtacaaacatttggacatgtagcaccagaatagtgtttcattttatatacatatggtaaacagaactaattccttgctaatatttctgctaaatgttattctccctagccggaaaaaaaaatcattcttgaaatcagtacttaaaaaaaaatagggagctgattgcttgattgaataaaaattggattgttaactcacatttaaaataaactatttaatttttctacttcagatagagtaatcctttatacactagaaatacctatccaatgaaagcaaatttaagaatttttgtcactgtatttccataacacaaaattgcttaaatcctttcgtcagtgcattttaattatttcatcaccaaaagaacctcttttgactaaattattatgagattcatgtaccacgtttttactcatttaataatttttaatcaggcctttattttctccaaattagccatcatcctatctaagctcagttgcttttgatgaaaattatttttctaattctgatttttatctaagattgaaagcaaagactattttaagaatgctgctatatcttttttaaaaagcatgggagttaggaaaggtagtgtggggaagggtatgagcttgctatacttattgctctttgctctctaccaaggcaaacagtaaagaaaaatcatcaatatcatgatactttctaagaaatccagcagtcatcagctgtgtggccttcaggaagtgacttcacctctcaaagtttaataatataacataataatgacaatgattaatggtggtggtaataatgtagatactgccagcattccaaaaatgttataaacacaaagtaaacaaagtataaaagtgcttcaagagattattatgattattgtcagttatactttttagaatatcggttatttatcttttggagccatgtaccacactgaaaatatgctgaaagatttggtccctttccccagaaaaatgaatatatatgcagattgaaaacattaataaaatctcagaaatccatggcttttctggcacctctttattgactgacgtgttgaagaactacatcatggtagaagtcactggttgcccagtccggagccatgcccaccacacctcacgccttagtttgctctgccttcatcactaaatcctgaagtgttccagtatccaccaactcatacgaatttccagaatatcgtaagtcaacatgtgtacgacactcctcagtgaactggtaaactgtgacttctttccctctcctgctggatgtgaaaaaggcagcatgctatcacagttgctttcggcagccgtcttatgaccacacgaataaccagcaaggcctaaggtaaagccaaaagtgttaatggcaggtaacatagttaagcctctagaaaagtaacccgtattactctaaacttcctgttatattaaataagaaattactttacacatccttgaagtctcagttcagacattcacttggtgatgatgtcatggactgaaccaagaggaaatagtctgtcggcctctcactttgaaaacatctaatgtatatagagctttattatttaacccaatcattgtgtttaacattgagagtataacgaaaccatgaacagcttaggagcagcgggttttttgtttttgtttttttttcctttagttgattatattattgcattaacagaacaatgcctgctacataataggaattctacatctgtttagtggatcggtgaataatagaatgtgattgattttgaaagacataaatgaaaaaaataggtggatcttgcctacatcttactaaatctgataattagatttttggttctaattctttcttcttatgagaagattagacagaattcttcataaaagcacaataacaaataatgttcatatcaggttttctaaagtgatatcagttacttgcatgggaagagggggaaatactacattcagttttacagaatttatggaagatgaactttaataatttagggagatatccaattcctaatattcagtatgctcaaaaattttttcctcctaagttctggtataacattcataaagaaaagtacacaagtcacgattatacagtttaatgagtaaacactgatcacacccatataaaccactgcccaggccaataagtaaaatattacaagcaacccaaaaaaaaactctaggcctctacctttagaatgcgtttgcagtatttaagactattgtagttccaaaattactaaaagtaatgaatcattaatgtatgtgtattacatgttagaaattttatttattttttgaagcatgcatgtttatcattcttaatatactttctcctgtttaatctcttataaaccttaaactgtagtgactcttaggagagtgaaattcatgaatataaaggtagtccataaaacgtaatttgtagattttaaatctgaaaaacattctcatatgcactataaattttgtcactgttctatttgatttgcttatctctacagtgaatgaattgtttctctgaagaggatggggaagctttcccatttaacaggataaaactgagggaaatgagaaatataataagaaagagagattaaaatcttctgaaattggttaattgattgcctgacagttataacagaaatgctttaaatctgaaactcatcagttctaggctatgtttttcttttctacttaattagaaaaaaataaaacataaatgcattcttgtttagttcgaactgtggggaaatgcataggaagttgtaggcaataaagtaccagctgcttgtttggtgctaagtttaccagagagtttagaatttatcattcctgtgtattaaagttttatgagctgcttaggagaggatgtaagcaaaagccatgttatcaaaactgggttaaaatgcagcacaaaggtaaaggtgtgaaatggagtatcattactaaccaaaggtgcacttttgggttgggggagaggtgtatactgacaaacaaatataggaaacattttttccatattattttccaaatgaaattgtttgctcataattttatcggtctaagtatttggcaaaaaactacacctattaccaagacatgcccaattcagagttctgcctgtatacattatagaagatgacaaagctccaataagcccttaagtacagagctggaggcccaaacagccagccaaatcttgctgtattttatccaccatagtataatccagagactgtggaccccaaattgggatgcttttaaaatccaaagtagttctgtatacacatttgaagaaaaatgctgttgaagaaatgtatccataaaacacttcaggtcaaaaagcaaaagaatatcaagaaaaagtttaaataacatgattcctactggttttagatcataattatcatcctatattatttatattcgtatcactgttatctttctctgacaaataattctgaaatacaatacattttaaagttatgcaggattttaaagacctcgtcttcaagcaaatacaagaagtttaataacaaactttaaataaatgctcatttaaataaaagtttatttttctcctggccaaatatttggtgaattacttacaaagatactttcaatgattagattccttagcttaaaaaaaaattcatttgaatacgctttagcccaaaagctccttacatattttcgcatcacatggagacagagcatctcatatcacagtgatgggtatgttttttaatttctatagaaatgctattttatataaacatagacgccctcagtccctaatgcataaccctttttaccaaccagggctttgattttcatgctgtcccaaagttgcagacatgttcacgacacagctgcgtttgttccttcatcttgttcagcaacctttggtaagaaactaccatatttaagattggtattctagatccaaaagaaaaatgcatgtgtttgctgtgtgtgcatgtgcacatgtatgtgtatgtctgtctgtaaggatagagaatggctgaaaattcacaggtttttaaattcttaaaaacaggaacgaaggaattctaacagctatgactcaaaacaagattctaataagttccatgacaagtaaaacaactattcattgagatgttaatagccttggtaccttataatggaaaaagagagattaagcaattagctcatgggtacacagtttctcatttgtaaatactgatgataccaccacctgcttcatgaagtttttgagacgattaaatgagttcatacgtgtgaagtatacttctggttacatgataaacactcattaaattatggctattattattgttactattaataacactgagcactgttctaagtacttcaagtatattatttaacttgatcttcatgatagccttatgtggtaggtaatattattctaattttatagatgagtaaattatgaattacaaagttaggtaacttgtccaatgacacatagtgtgtatgtgctggaaatagaacttcaacagacgcaatccaaggcctgttctcacaaataatgagttatggactctgagactaaggatactcttggagaccaaagcagaagctaagtattaacaagaaaagaacccagactcagttagtgctcaaggcagctccagatctacatgttttgcttgatctcctggtcttgaattccctatgattctaaaaccaaaccaaagttacgtcattgtttatataaaggatataataaagttaaacattaagtgggtctggggaagaggaagtaactgcaagtgggcacaagggatctgttttgggaaaatagtctaaaacccctttaacgattcttttttttttctttttttctttttttttttttgtaggggagagaaacgttctaaaattagattctgatgttaattgcacaattaagtcataaaaattattggattgtacacttaaaaagcatagattttatatgtaaagtattcctccaaaaagttattttttaatttttgaaaaaaaaataaggcatagatactctttctgctttaatcacccctttaattctcagattgggcctaatgatttagtatttgtcatctaaatccaaaacagttttccagttaacaaatgaccctaaaatctagtgtcttaaaacaactttaaaaaaaaaaaaagtcacaattcacaatttgtacagggctacactgggcatttcttccatttctcaagtcatttaggaaactcagtggtactcatctggcagatgggttggtttgatggattcaagatggcttcaatcatgtttggaacctgggctctgagggttcaaagactaggactactagcaaggagcatgtacctgaggcctttctgtgcagcttagcattgccagaaggctatggcctcatagtagtcaaactactaatgcagtggctcagagctccaagtgtaaatgttttagtgaacaaagtggaagttgcatcatcttttattacccagacttgtatacgacttagcaccgcttctgctataatccattactcagagaaatcacagccctcctagattctataattaaggaattttgacttcatcttgttggggaataacaaggtcacactacagagtagcatatgaagctggagatattatggtcatcatttgaaaatatgtgtcataatagtttattataataatcaccattaacagaggattcagaaaggtctataattctttaaaactcaaatatctgaaacactgaggatttcttataccatatagtatgtaggctaggaggaatttgtggggaattcatactgatattctgatacacttcaagaaatttatgcaagaaatctcctttagagacaaatctaaatttttagggtataagaataattatacactaatttcccttgtgctattttatatggaaacatttagtttacataaaaatttagtttcatttccttttggtttttgattctaatgtggcagctgaatacagctgtgaattctctccttataaaacatttagtgctgactagggccaattttggacatgcattttctgaactgaacatgatatttgataacttttgccccaaataagaaaaatttaaattacaattgtaaatgccttatgtttatcccattttagtgaacattttggagcatgtgagagaaacacattgtactaagaacttgtttaatttaaaaccacttcagtttactgagagcttgttatttcattttttcactttaaaggtaccagacaacttaataatgaaggagtaactcagtgtcatgtgagtttagatcttattttgccatctgcaatgaataacaaagtattaaaaagaagagaggaagaaaaaaaaaactaggcctcttgcctgaaggacaggataattcacacttacttaaagaatgtcatttataggattttctcacagcaacttgagactatagaattgcttttttagcttttacacacagtcattagcaatttatagtgccagagaacactgtaatggaaaaacagtatgataaagtatgaaagttcattgattacatggtcatagcctactgaggtttgatttagtttttaaagaaagatttctgttctgttcccacctgttgaaaataccttgaatttttactcatgtaacccaggagttctccaccctggctatatgagaatcaaactgggcttgtaagaaatagcaacgtcaggctccagccctagagattagattcatcaggtgtaggatatgtcttaaagtttaaaaacctccttacatgataaaagtgggcagccaggtttgtaaaacagtgatttaacctgttactgcttctgctggcctagtgtcacttacttctgagaaaagcatgttgtctaaatatttatcaagataatttataaaatcttgaatctaacccaatcagaaaaaggttcctgaagtgcctccaatccctttagaaagagaaaaatctatcagtcagtatgctcagatgacaactaactttaagttactttaaaattcaccaacttttccagtgttactgaggatgttctaaaagagtccactgaaatcaaaaaccatctggctgtagatcaatctctgaagttccaccccagtaaccttttccaaaaagcgagttagatgaaggaagttaacagtcatggtggagaaaacaaactgaaagacaaacatttcaacaagggagaaaagagggagtttaagctttgatttggccactaacaaccattgtgtgaccattcatgggccacttagggcttgctggatactatactcctctgaaaaatgaggggttgtgctgtatctgtgttttttgtttgtttgtttgttttgttttctgttggtaatggtgaaagtgttatgagttaagcagtagaaaacactttccaaacaaaatacattaaaacaacctgcaagattagggggctagccgtggtggctcacgcctgtaatcaacagcactttagaagcccgaggcttgccaattgcttgagcctggaagctggaaaccagcctgggcaacaaagtgagacactgtctctataaaaaaataaaacaaagcaggcatggtggcgggtgcttgtagtaccagttactcaggagcctgtggtgggaggattgcttgagcccaagaggtagagcagtgagatgagatcacaccactgcactccagcctgggtgacagagtaagactctgtctcaaaaacaaatcaaaacaaaatacaagattagagttgttctggttgatcagtaggtgggggcatatggagacccacctatcaaccctccccattcaccagctgctctgcctctgtattcctacactaaatgcatttttagagataactactgtgtaatcttattttcaaaccttatgttttagacatggttcctaatgacctcttaaagtgcaaatattcctaggaactaggatttcctactgggtagattttaccacaagtgcgattaccctaatgggtagaatcatatatatatggctcagtgaggtttattaatttgcctggggtcaacaagcagcaagtggtatatgcaatatttgcaaccagaaggatctgaagccaaagtatgtgctttttcctgcaatattaaaatattgtatcagtaagtttcccatatttgtaatttgtatatatatatatacacatatatatatatgcccataacacttaatcagtatatgagtttatgcattttattttgcatgggcatatataactttacgtgtaacacttattgacagaccacataatgatgtatatgccgcatctcttgaaccaaacagaacagttaaatcttgaaataacctatttctataactaatagaaataagtcattataatataactagtatgaataatacttttgttgacttaagcataatcatacaaataattagtatataaaaccgagaatgtctcaatgctgacattgaggggaatctcgcaatgttctgtgttgggggaatctcgcaaaccaaaactgtacacactcaaaatattaacaaacagtaataaaaatttttaaataagaaagcaacgtagagaaatctattccctctccttcagtttttatatcataaaactagaacccagggagatagaaaaaagcatttttaaaggaaataacagatcccaatctaaagcatctattgtatactgtagctagagataatattaccaaactcaatcaaattattaccaaactcaaattattatcaaatcaaatattaccaaactcaatcaaattagtgtgtgtgactgataagaaccttactctctcagagaagtacagattttaaatacaaatcttcttttgttaactataaactctttgagggcaaagattcatgttacatagtttttttggtcatttttatacagtaatttacctgctgtattaaataggaatttatttgactaataacagaatcttaaaccaaagtacaggctgtaattcaatatttaagcagaattaattctatattctgctggagaactttccagaagactcccccaatcatacctcctattgctgtctcaggtcacccatatataaattaggatacctatggctttttcgagaaaaattaactaataagataagtatagtttgtctcctcagtagtgatacggtttggctgtgtccctacccaaatctcatcttgaattcccatgtgttgtgagaatttaacatgaggtactgggaaggacccagtgggaggtaattgaaatatgggggcaagtctttcgcatactgttctcatggtagtgagtaagcctcacaagatctgatggttttataagggggaaacccattttgcttggctctcattctctctcctgacgccgccatggaagaagtgccttttgccttctgccatggttgtgaggcctccctagccatgtggaactgtaagtccattaaacttctttcttttgtaacttgtccagtcttgggtatgtctttagcagcagcatgaaaacagaccaatacagtagtagctacttaaattcttctgaaaaatgcctctataagcctgagggcagtaatcatgccactactctgccttcactcttgcaaatcaaatatagattattctaaatttattttatttgtcctacttttaaaatctataattaattaatataagtaatgctgtcattattattttattattctgagactctttccaagcgttctggcattattcttatgatccacacagatagggatgaaaagagttcatttctttcctgggttgtaactcaatcagcctcttcagttccaaagattggtggtctttttaatctcgaaacttagagtaataatttaaagtttacaagaattgggttaataaaaagaatggctatttggatttctttatggtaccgtccaaaagaaaatctgagggttatttttctgccaaaaatcactagaagctgtgatgtaaatcattgaaaaggtgagtagtgattttttccccttcttaggaattctgcaaagaggagaacatgggtataaaagaaatgggtatagaatttaatagtaatgatcagaaatggaactaagatcatcactctagcttctttggatagagaaattctaacaatccctagagaggatttgtgtgaggtggttaaaatgaaaagcacacacatgtatacttgcacacatatgcttaaattcagtagatgggtataaaatatcagaatttagtcactcattcaaaaaataattttgaagtgcctacctctaccagattgagccctgggaaaaacttcctggttaagaaccctcactctagttgccaatgtttggagtcccagttgatcatcctcttcatttcttatttgatctgaaattcctgaatccgggtggccataactaatcctccagaagtagatctaaaacctgtccacacaaaagcataatctgggtagctttaaatatatatatatatttcaggctggacatggtggctaatgtatataatttcaacactttgggaggccaaggcaggagaactgctcgagcccaggagtttgagaccagcctgagcaatatggtgaaacccagtctctacagaaaaaatacgaaaaaaaaaaaaaaattaaccagacatggtgtcatgcacctaagtagtcccagctactggagaatctgaggtgggaggattgcttgagcccaggatattgaggctccagcgagccatgatcttgtcattgcactccagcctgggtgatggagtgagattctgtaccaaaaaaaaaaaatccttccttggtccacctgtatatctactaaatcagaaccctagtttgcagggatggaggaaaaagccttctggtcattatgatgagcttgtttgtgaaccagaattttggaactactgatcttgggttcacaataataattcctaagaaaaaaaccttcttgactaattcagccaagtcacctaatacagaaacctattagtttctgctccacatggactcagatagtgtcactgctatgtaccttaacattacaagcacactggactggaggctcaatgcaaaaattaaaatttcttaatattccactcacttaaaattataccatctttcaatttataattctaaaaaatcttcaaatattggtacatgcagatatagcatatataggaaaaagacatatggatgattcagctttttgaggttctctaagtgaattgatgataatgttagctagagtcaaattctattaattatttatcactcttaattcctctctcttttgctctcttcatctctctcttcctccactattttcctttaactactgaattcctacttatcctacaatactcaatttacttacagggaatattttctttataccactaaactgtaatctctatagcacaagacatatttgaaattttgttcattgatatattcccagagcaagaacagtgtcttgctctgtacaaagaaggtactgaataattaattgttgaataagtgaatgagtgaatgcatgtatatatgcatggataaattaatcctataatttctgttcctatagtatcaaggaattgttagttaaaatgtatttgtttgttatttggtagcagctaattgcagctaatatagaatttattttagcactcatcatattgcattataattatttgtttccttgactggatcaagccaggccttatttttataagtattatatcagtctcattcagtgtactgcatatggcagacattcaataatgttacatgaatgaatgaacataaaaagctacctctcaagattcatatttattaaaaatctgatgccaatgaatttagataatttagatatgatccagatacagtaatttaaatgctcatttcatttcatgacaacattttctactggttgagaaaacataaattccaaagggacattataaatacgtctggggaccatcattcatttcagtgctcatatttcataagtaagcaggtaaacagttcctaagtagatcactatatcagggtttatatttggataaattcttgaaaaaaatatattttaaagaaaatgctgtcttttaatttaacttactccttaccagtttttaccattacatttttgaatcctgaatgagagctattctgtaaaacataaaatccaaatattctctatagtgatatatatgcctctgtaacctttttaatgtttcaattagtactggtagagtcagaggttatatttaaacgataaaggttctaaaattgtataaagaggagctacatatttggagggtctcaaaataaggcacagagtaattgaaaatccatattatataatacataagattcatcttaacaatacaaaattgatatgttttaacaaataatacattttggaacagatttctgattttactcatgaaagtagtagtgggttacaatatgatatggaatacagaaactaatgatttgtaatttaaaaaagaaaattagggtaatttttttaattcaaaaatttagaaaattgcatctatgtcaagtcattcaggaagagtgaaataaaaattatgtatgaaaaaccttgttaagttacccataagaagatgcattttcgtttgattcaattaataactgttataaggaatgccattttatgaattaatatggaataaacaagaaaaattttacttaacatttcgtaggagacaaagtaaccacagcaatcagatttttctttgggttcggattagtcatggcactgtgagccaataatttaaaacgtaaagaacgagatactatgaaattcacgagtggaaggaagaacaaaggctatagtgagagagcaagcgtatggtgctcccttttgttacctagttctcctttcctaatgtgttcaggaactagttttaataggcatttcatgaaaaagaagttccactgttaatttttttgaaaactccaaattgagcaaaattaaaaaggtatccctaattcaagtctactcacagtctttattgtacaatgcctaatatacaattagttctaagttactaaataaacatttattcaatgaaaggggaataaagtatgtagcatttctcacactgctccagtttttaagcaagcactgggggaactgggggatacatggcggagggtcgtattaatgttccacaggaaaaaaaattaaattagcattaaattcgtgttttaccatacttcaatttgttttcattgtgtttttggcttatctgtgacagcttttcaatcagcttcctttaattgaggacttgacttggtttctaacttttagcatttaaataatctttctgccatcttttcattaagaagtcattattatagactgaaaacagtcttataaatacaccatctcccttcagatttaaggaaatttgtctccttgatttttctttactttgcctttacttttagcatttacatgagttctatatttttcttccagaaacaaaactctgccaattatatattgaaagctcataagcacaaaatgcactgtcaaccaatactggtttgtaggtatttgatgccaatgatacaatattgtttactacactaaaaagtcatttatgacatagaagtacatttcttgtttattttgatagcccgaaatcacagacaaaattttagtctactctgaggacaccacactgcactgaactccctgaactgccagtgaaatgttctttgcttttctaaaagatgtgcttgtaagtacttcagaatcatagcagggctgaaatttgaataacaacattttagtggactcactctaactcttcactttgcactgagattaggcttcccaaacggaaaccaagttttcctcaggtcagacacttctacttgtaaagcaatgtctccaagctctaatgcacctgtgagtgacttgaaggttctaataaaatatagattttgattaagtagttctgaggtaggtcctgcaatactgcacttcttataggtcagtactgttggtctatggatctcattttgagtagcaagatagaagtgcataaaatattactgttgacttagaagctaattccatcagtttcttaagaagtttattgcctaatatccagcataccataacttaacaattgtgaatacatttattatcttttttttccaatagatttgcttagatttctattttaagagtcagatctggtccagtgatttcacaggaactgcaaatagtttggagttattcttttggaatgctgtttttccctaaggcattcttccttttgtatcatttggtaagggaaactttcatacaataggatttagcaaacgaattagctgtgttcttgatctataataacctttctcttgtactcaggacataatgaacaaatttatatatttcaatgcaaagatgattaaaatcactcgggactaatgaggatagctttcaagtcctttaaatttgtgtatttatttgtactttctatgcaacaaatccgctttcacaaaattgtagatggcacctgtttctttcaaactgctagctcagaccctctcccatctctattacaatgtcgattacactttaatgtgaataagaatcaccagggggcttattaaaattgctcattccatgctcaccccagaggagtcacattctgtatgtctggagtaaagtctgagaatgtgcattttggcaaatacctctcgcatatctaatgcaatctgagttggggaaacactgtcttaagatcagtccagaccttaagcaagaagtttcaacatcaatccactcttgctacttaaagcctgatattattccatctttgtaactgagtttttgcactgtttcaaaggttttgttttcaaatatgctcctaatctacaattgctccctttgtttgggtcttgtcttgataatctgcctggtttttgccattgctccttggatgaaggaacttaactcataaatcttctccggggactacagcttatctttcaaagcagacacttttgagagtaatattgaatgccattagtaactgtgccaggataattgacatcagctgaaactgtccagggcagactttatgtcatactgatcttgaatcccaatccaggaaaaaatgttaaccatacttcagactggtggcagatggttatccacttctgaattctccatcccagtactattctgagatagaaaactcctacaggagtttcaaggcagatctctagctgtcactgctgtgctttactaccttcattccacactcttccttcattctattttctagcagacatgatactcttagtgtctggcggtgaaaatgagtctgtcttctaagacccagcactactgtggcagtaagttttttcccaaagcatcccaaagtggttcctcaagctacagataattgggatatgaaagaccatatgcatatacaaggcaacattaaattgaggtggctgttttaattatccatatttgaaagatccatatatttaatgtctcattgtgatgaaaaataatagttcaaagtataaaaacacttcaccagataaatgttttacctattttgtcatctttctcttaatgtcatcacatgtgaaataactgatgcaattcagagaaaagagatacgcactaaaatatacaatatttttctagatatacctacacaactcattgacaagtgaaatcaagcaactggacatttatttaggcattgcatcaacattgagtcatgtccctctcctccaagtattgaattatctaattattcataaaagaaaattcagagaaataactcttcccaattttaatagaattaaagtacatttaaatggatgcttcaaacattcatatggagaaattcaggacaacgcatacacggtaacacgaaattaattatacaaagcatgaaggaaaatagactcatccattctcaaaaccacctcattctcctacctactatattcaactgggttttttaaagataattaagatgaaaatatcactttcaaaaaatgttcctagtgcattattatcattattttcttaatttttaagttccggggtacatgtgcaggatgtgcaggtttgttacataggtaaacgtgtgccatggtggtttgctgcacctgtcaaaccatcacttacatattaagtccagcatgcattagctatctttcctaattctctccctccccaaccccacacctcatcaggcccagtgtgtgttgttccccttcctgtgtccatgtgttctcattgttcagctcccacttataagtgagaacatgcagtgtttggctttctgttcctgcattagtttgctgaggataatggcttccagctccatccatgtccctgcaaaggacataatcttgctcattatttaaaagagtacaataaactaagaatgttttaaaatgtagtatagtattagtaaatcatatactcttggctaaccttacaggtatgtgttgtttttataaattaactagaactggtttaaccctagggtcaggttcaagtggtgtacaccagcaatcagattacaacttgatgcaaattttgtctcattaaaaaagtcacgcatcccaccacttcatttgcaaaataattgtgtacctgaccaaggtcagagaattttccctctgtttctttcactgagtgagctcaacttattaaaatgcagctaaactgtgagaaagattaattttttttttcatttggggaaataacaggggagagcaaatttctaaaaacttggggttttatagtaatttctgattttcatgtttagaaaaagaaatcacattaaaaatatgcttttttaaaattttgagataggatacactataatattattgtagtccagaaaatctgtatactataattcctagggaaaaagagaaaattattagtgtcaaaatacctataattcccacagttacgatatacatttttaaaaattgtttaaatacacaaacaatgatgatgctgtcctactagaaatgacagagcagagcttttactctcttcaaaatgcattaacactttcatattcctagttcaaattaatattctttttttttttttaagacaaggtctcactctgggctgaagtgcagtggagtgaccaagactcactgaatcttcaacctcacaggctcaagtgatcctcccacctcagcctcccaaagtgctggtattatagttgagagccaccacacccagtccaaattcatattccaaatactccatgatctcaaattattttcaggcccttctttcttctatagcaatggtccccaacctttcgggcatcaggaactggtttcgtggaagacaatttttccacagacagaatagggaagatggtttcaggatgagttaagcgcattacagacactgtgtactttatttctattattactattatatcatacaatagaatgaaatcattatacaactcaccataatgtagaatcagtgggagccctgaacttgttttcctgcaactgcatggtcccatctgggggtgatgatagacaatgacagatcatcaggcattagattctcgtaaggagcatgccacccagattccttgcatgcgcagttcacaaaagggtttgcactcctatgagaatctaatactactgctgatctgacaggtaggcagtctcactatgttgtccaggctggtcccaggtaatgcgagctatgggaagcagctggctgtaaatacagatgaagctttgctcacccactgctcacctacctgcggtgcagcctggttcctaacagaccatagactggtccatggcctgggggttgaggacccctgttctatagctaaaatccaatgatttaaatataaatacatatttgtctattcgatgctactagtattttcctaggtgaccatttatttttatcatctatctcagttaagatttttagataatcacaattgatttaactcacaggatttatcaagatcttaaaaggtatatgtagggctctttgctttatttgagaaataaataatcactgcctcacaactatggctccatgtgtgttatttaataaaatatttaatcttattggaaatccttttatatttttttctccacaaaggacaaagagctgaaaataaatacgaaacagaattctttgtgggaattataaataaaataaaggctaatatttgctaaaagaatttgaaatgtatatgccaaaatatttgctattatataaaaatataagtattattatatatttcttttttgtcccaaaagatggtactaagtattatcttagaagtgaagttgactttaaacatgattttcatagaaatctagtaactaacaattttgaaaatatccagaaatgtcttaaatttttttttgtaagttatattatttgcataggtatagcccctacagtgttgttcaaattctgaactttttagcttccttttatttttcttactatttaacaatattagattggttatgttccaggaacaaatttcagtccatgggtaagtattcaatgtgaacttattcactgattataatagttgttgattgttcaataatatgagggatagacgagagctccatccatcatattataagagtatagactgtctttgactaaatgacatattaaaagcctaatatatgtcccataaaaatattaatataaggcattttgcaatttctttatttagttatttcaaattatattgtagaacatgaataaacagagaaatcaaactggtaagaatctatcttcattcttatcagcttgatctctgagtttaccttgggcttcaaaggaccaacatagagctaattgcaagggaaccagtaggtatagataatctagaagatgctgtgaatcctcttagaagagcaacaatagcactgttattaaataatcaagattttattttttagaaataatatgttgaccaaatatataatagaaaactaaagtggcttgagggctggacatggtggttcagacctgtaatcccaacacgttgggaggtcaaggcaggaggatcacttgagcccagaagttggagaccaacctgggcaacatagggagatctcatctctacaaaaagtaaaaacaacaaaacatccaggcatgttgacatgcatttgtggtcccagctatttgggaggctgaggtgttgcttatattaaagaattaagaacctcacaaatttaatacaagcaacataaatgatatgatttggctgtgtcccaactcaaatctcatcttgaattgtagctcccataatccccacgtgtcatgggagggacctggtgggagataactgaatcatgggggtgggtttttcccgtgctgttctcatgaaagtgaataagtctcatgagatctgatggttccataaagggcagttcccctgcatacactctcttgcctgccaccatgtaagatgtgccttccgtcataattgtgaggcctctctagccatgtggaactgtgagtccattaaacctctttttctttataaatttcccagtcttgggtattccttcatagcagtatgaaaatggactaatacaacaatgatgctggaagtgtgaatttttagcctcacattcatgaaaacaaagccatatatctgggttttcaattataaaggggaaagtaatgcaccaacagtaattactcatacctgattatcccaaatattatcataacaagcattatactccattttttacaactttactagacttctcatctctttaataaatcatgaatcaactatattgtagtttctaaacaattactttgcattatacaatattagaactttgtaaacacattttaaaagtagtattcttcttattcatatctaacttctgatctatgagtaaataggcccaaacttttacatcttccatttatgtgttctcttttaatctaaaccagttgaatttttccattaatgtttaactcaagaatttctatatttttctccttgtcaagtaactctcaattcaaatgatcaacaataaacctcactaaacctcacagtgctcacctagaattatggtctgaataatttgatagagtctattttttatttcatcagcctggtcatcaatgaacatatttaacaactgtatatgcctttggaacatcattcaacatttccttgacccgctgcttaggcccaagctaacattaaaccactaataatactcttgaaactttttattctatgtggatctaagtctcaaataatttcaaccacacacacctccatatcatgtgaaaatgaagtcaatgctgagagagagaaacaaagtgtctattgctttaatctatgcttgtcattgtgtcacagtccagagtattcaggtgaaattaaattgctaattttgttcagtcattttgatgctaaaatgataggaataacacatgatttccctgttagagtcaaaaggatgctataaatcactacattctacaacatacaactctaaatgcattgaatagaacataaatttataacgggatttactgaacaggaaagagggccaagaaagcacagattctgacttgaataagtaaaacacctagagaaagaaatcccagtcatcttattctaaacacatcacttcagcagaattcctcacaaaaacaaatcataacattagtattattcatagttatttgcaaagttttaacagattaatgtcttttcccataaatactgaaatagtacctaacctgattcaataaacagctgcaaacatttcactggttgactaggttaaatttaattttatgtgttaatttttcatgtttatctcatattttatttttctagttatatttacttttaccaaagcctcatactgtttttcatatcacataggaactcatttcttacaataaataatatataaggactaagatgattccaatgcaattttttttccatttgtatataattgctttatcttaaaagcaaaccctgcatattctgtcttccagagaataaagaataagaaatcattttaaatttattttgcataatttgctgttaatgggaaaaatttaggggaaaaatatggttatatagatggggccaccaaacaaagcattatatacaggtagttattaacgaaatacaaaggaattaatgtctctaagcttagtgctcaaaaatagagagttaaagcaagtttattggcctctgaactaatgacatcatggggctggataattctttgttgtggggactatcctgtgcattgtggaatgtttagcagactcctggctggcataccagtagatcccagtagcatgcctcctctacccagttgcgacaaccaaaaatgtctccagaccttgctaaatgtcccctaaggcacataattgctccagattgagaaccacaggataaaagagctgttaaacacaaagatagctaccatatatatgtgtgtgtatatatgtgtgtgtgtgtgtgtgtgtatatgtgtgtgcatatatatgtatgtgtgtatatatatacacacacatagcgaagtataagcaagtggaagaaatcctaaaccagaaaagtcttggtaatttcgtaatacaaagaaaaatgttttttcttttctatcaatgcatcaggtaatagaaaccacaccttatttcaactctaaaagtcctactttcatggtatataacaatgcagttaaaatgtattgcatcatttaatttattgtctcatgatcaagtacagacagaacagtagagtgtctaagagtctaagagccctggctttcaaatcagaaagacctagaacaaatctaattttggcaattaccagttgtcaaatttcagtgggcagataattaaactctaagactcttttgttatcttcaaaataagataatggtagtacatctctcatagggttgttgcaaaagtcaaataaaataatgtttataaaagtactaaacacaggtcgggcgtggtgggtcacgcctgtaatcccagcactttgggaggccgagatgggcggatcacgaggtcagaagatcgatcgagaccatccaggctaacacggtgaaaccccgtctctactaaaaatacaaaaaaattagctgggcgtgatggcgggcgcctgtaatcccagctactcgggaggctgaggcaggagaatggcgtgaacccgggaggtggagcttgcagtgagcccagattgtgccactgccctccagcctgggggacagagcaagactccgtctcaaaaaaaaaaaagcactaaacacattgcctagcatgtagtgagtcatcaaatttagctattttgttattattgctattcctaacagagttttatactttattctatggttttcaaagtggagcaactgtgctcccacaggagacatttagcaatgtctggagacatacttggctgtcacaacagatggagaggtactagctcagatacatagctctctgatacggtggcttaatttgggcaaagctttaaaaaatggagaaactacctagactttagctaacatgccgtaaatgtcacttctctcggacaataagtttttatagttttgaaagtggcatgaaatttaaaaatatatttctgggtaaataacaggtatatagttattctctattaacagctaaatttgaaatgatatactaaaatcacataaggggagttaagaaattaggtaaaatgaaaactttatcaaagttgattttaactggctaatttaaatcattatatgtaaatttaaaatgtaaatcctaaaataattactttctcagctagaatttccccaatcaatctatgaatttgggttcaagataagtaattgtccagttctgagaccaatatatctggaaaatgaaggtcagaaaatatatttgaattctccgaaaaagatagagagataaatacaatgtatattttatattatctattaagaaatttaagtttgcaactacattttaaaatgcatattctatcagaagtccatgtactagaaagcttatttaaggtgataatcagtaagctttttgctaatattaattgtctagacagtttaacttccattttagaaacacactctcagaagtagagataaccagttctttgtcacagcagataaaaagctcacagccaagaataccagagcactatttttgtcaggtgcatatcaacatttatgttgtcaccctgggccagcaaaacatttaacagatgtgctgtatctatgttttctaagtatttgatacctatttttatatttcctcaatgatggccccccccaagaaaagccacaaattggcaaagaacgtgaagtaaaaacatattctcttaaagccaaatacataatgtccggattttgtgtttatgtgtatgtgtttaatctagtttaaggtgactcaattttcaaaatcaattcacactaaactttgctatcttccttcataccaagcactaaaacattaaaatgttttaaaatatatttaaaacatgaaatgttttaaatgttttaatgttttaaaatatatttaaatgaaagtttgcataaacttttcctgaaacaatgattcaaaacaccaacaaccatcatgcgaaaaaatattgtcaagttatatttgatggaggtttactggttatgggacatagtatgtatttctgttacagcactattgcaatgtttcataacttttctagatctatcacacaatatgtgttgaaactttaatgcacaggaaggagcctaccatttgtaattctgagggccaaggtacttaggaaagaatggaaataattagggacggaaggaaataaataattaatagacctcaaaatgactattacttttatgaatactaagccgcatttacattaaaataaatatttttctaggcacttttgcaacaacattctttttattgtacttattgaaaataaaaccatgtggtttctgatatatgaattagcttgtctttggagttggcagaacatgaacttgtgtggcactgccttatctaaaagagtcatatcagataggcctaagtgctaacattgtaagatacagtgttgggaaaaatgctttggcaatctttccaaaacacttgactctctcctcatggaaataataacacatttcatttttgtagagatttgatatgcagataaatgccaaaggaagaaaaatgcagttatattttgcctttaatttaccaaatcttcaacgtataaattatgacctatataattgattatagttatttcagaagtgtccatgttttctaagacttccgttattctctgctgcttttagtaaataattacaactttgataagtgatttcaaaatattcctaactttgtaatttcaaaaaaaagggcattgggaatcactaatatacccaaaatgaactctgaggaaatgacagatattggagtgttggatggaatagaaatagtgtgactttatttaattgttacacttccttatacaactctttcctttcagatctgaagaactaatccaggttgagcatcccttattcaaaatgcttgagaccagaactgttgcagatatttgattgtctaaaattttggaatatttgcagtatgcagtatatttttaccagttgaggatcccaaatccaaaaatcaaacgatcatttcctttgagtgtcatattggtgctcaataagttttgggtttgggagcattttagattttggattttgcattctcaacctgaatatgagagaaataactgtccatttattaatttcaacatttaattaattcagtatataaaatatgaataagttttagtggtctggtcttttaaggggggaaagttcaagaatcactaacattttataatatagatattttaaagtagagcttaaaggcacctccagtccatacagctatttttaggtgaaatagcattcaattcctatttttatatatgttggatggatggaggggtattttgtcattttatgtataaaccaatgaactataatgcttagtgtcaagaaacagtttagaactcaaaaagaaaataaaatttttattttataatcaagtaactttcctccaaaaatgtcacaggaaaaggaagatcgtgatagtctgtcattgaaactgagctcataccctcaagtgaaacacctgggtgcttcattaccaaattcatgtctttcctattctgagaaacatcctccaagaggatcacctattttggtaaggcacctacttatagagtcagatattatcacatatagctgctggaaagtgtggccacaatacctcaaatattatcacttgccatgagttaaagtttcctcaaaatcagcacaggaagatgagagtgaagttaaacacatattcattaaagaagactgaaaagaaaagaaagggattagtgttattacttacagctaataatgagaaacagttaatcgtgtatcaaaaaagaaaataaactattgttttaaaactcaaattcgtaacacatcgtcacattctgagaagcaaggaacatctgttatagaatgtgaaaaaattatttctaaaaataaaaatgtaaaaatagaagaaagtaaacatctaaattcagtggacagacttggtcagaaatagtttcaatgcctagggccaccgtgtactgcaggaactggtggcattactgacagtctatgttttccttcagtgtgcacagtctgccatttcaatcacacaatattcagttctgtcctaagcaaaacctgcttttaaaaaacgattcaaaacctgctcataataaaattaatgacaggcaatgaaacttctgtaatgataatccaagacttaggcaaagaagtaggaactataactggagtatttagtgaagtttttaaccaaaactccactaaattcacataaagaaagagagcggaatctatgaagaaagccagtctgtgtgtggtggtcctataggtggacctctgctttcacaaacatgatatgattgtcaatattttatttcgaaaaggatataatgatttgtgtctcaaaagtggtgacacgaatataggtatcatgaggtgatatgtcacaaaatgtcttctgaagatggagacattaatttacattttttagaatagaagagttgtaattgttcaccaggttttatacctgggctgttaatcactagtcacatgtggtatctaaattcaaatttaagttaaataaacaatataaaactaagagttcaacttcttaatcacacacacacacacacacacacacacacacacacccttcaagtgtttgacagccctgctgtgactagcgactaccatattggacagtgtacatattggacatttccacacactggaaaggtttattgaacaacagttgttctaaaatgtatacaattgttaccaattaggaatacatttggctaaaagtaacagaaaacctgactaacagattaaaataagagttaagttttctgtcatagtaagtgcaggggttagcacttattgatattgacctagatgggaactgatgtccccaagaaagcagattcttttagtatttccttagtgctgtgaagtctgcccttatgctttttatttcctggatgcaagaaggctgctgcagatacagatattcttgcacattcaaaaccagaggaaaagtagaaaagggagtagaagttgcagttatcccgtagtaaagcaattgctttcctaaaaatatcccataaacttccacttatatcttggccaaaactatatcttatagttgctctaggaaatgttcccaagaagactgggaaagcaatcccagcaaaatcaaggttctgttaataaggaagaaggggaaaatagatttggaaaggcaactcaccatgctcatcacaggcttcctgaagatttgtccttgaaaaaaacaacttgatgaaaaaatgaacaaaggtaaatatagttccttccacagaaaaaacttttaaagaggaattttaaaatcaatgcttaaaaattaacctcttttttttctgccatgtgaagaagtacagtttctaaatgcaaagaacttccaagttattagttagtgtaaggcattccaacaaaaagtgctataatcaaagtagattaatacttccaatatgctctcatgttttgattaattatgtgtgatatattctttatgtggtataatatagaaatgaattttcctagctgacaacataactatttagttaaagaatttgggctaagaccttagagtgtaaagctatccatttacacaagaatagtttccttaagaggaaaaatacgaggttttccctctttcccttagtatgtttactatggaataaatattgcatgagatgaattccaagaacataagcaaatgttttgctgtctttaatactaacatggaaagatatagcaactattctagaaagttctgcgtaaaaaatatttaaaacatgtgccaactaaaagagatattgaatggctcaaaagtaataagacaaagacattaagattatattcccttcatatcagacattttccctattaatattagaaaattgtaaagcgatattaagtcgttcaaatctttcatgagttctatgatcagtaaaacacaaatatttatgtcatgagtttataaaattgcctactattcttagaatgacacaagttttcaagaaatacacatcataaagaagcatattaagtaaactataaataaggtgacaaattcaaaataaagactgtaaaataataaaaaaaatgcacattgtcaagacttgcaataaggctgactttagataatctgcattgacactgtgttctaatgagtaaaaatatgatcccactttgaaataaaaagcaagcaaggtgcaaatggaaaatgacctgcacacatatctccatggagcagggaagggctattattatcagctagtgggtattactggctgaatcatatccccctccaaattcatgtattgaagccctaatccccagtacctcagaatgtgattgtacttggagattctacttggagtatgtacttggagcctttaaagaggtgattaggttaaaatgaggccattagggtgggtcctaatcaaacctgacaggtgtccttataaggagaagaaattagggcagagaccctaggaatgtgcaggcaccaaggaaagaccacaggaagacacagaaagaaggtagctacccacaagacacaagaggggcctgagcagaaatcaaaactgccaatgccttgatcttggacttgtagcctccagaactatggtaaaataaatttatgttgtttaagctacccagtccatggttaagctacccagctgttgttatggcagctttagcaaactaaaacagtgagaatgacagagaacagaatgaatttctgagttgcttcaaacagtgtgtctttcagagctgatgacattaatttgatttgatttataatataaaatttgagttgatcattccccacaagtttttaagcagtgctgtgcaatattttgccattggctatgtgtagctgggtaaattcaggttaattaaaattaaataaaataaaaaaatcagttctgtcatcatgctaaccacgtttcaagtgtttaataaccacaatagctattggcaagaaggtagtcatttttttgtctttctacactttttccactaatggagcatataatcaaagcatgtataaacatcttcgttgctatgtattatactgagataatcatgttgctaaggtcatacattgcaaatgaccctcacataaatgaattagcacagtgtcatcttttcaaacacagaaagactttataaaacaatggtaataaatcaacctaaatgtctatcagtggtagactggataaagaaaatgtgatacatatacactgtggaatactatgcaaccataaaaaagaaggagatcttatcctttgtggcaagatgaatggagctggaggtcattatcttaagcaaactaatgctggaaaagtaaaccaaatagcacatgtcctcatttataattgggaactaaacaatgagaacatatagacaaaaagaggaagacaacaaacactggggcctccttgaaaatggagggtaggaggagggagaggatcagaaaagtacctatcaggtactatcctttgtacctgggtgatgaaataatctgtacatcaacatcccaggatgtgagtataccaatgtaacaaacctgcacatgcacccctgaacctaaaataaaagttaaaaaaaaaaaaacactttattttagattgaaaaaaacaaagaaaagaaaaagaaataatcaagacaaaaatcttgaccaacagaccagaagttcttctttggggaaataaaactaataatttattacaaaatgtttatcaagctagttgaaatttcaagtttaaaaaatcttaatgtttgatatattcttagattcattaaatgaagtatgcaaatgtatatgtgtaaaaccatagaaataaaatgaatttaatgaactggccaggtgtggtggctcatgcctgtaatcccagcactttgggaggctgagacgggaggatcacaggaggtcaggagctcgacaccaacctgaccaacatggtgaaaccccatctctactaaaaatacaaaaattagctgggtgtggttgtgggcacctgtaatcccagctacttgggaggctgaggcaggagaatcatttgaacctgggaggcaggggttgcagtgagctgagatcatggcactgcactccagcctgggtgacaagagcaaaactctgtctcaaaaaaataaaataaaacaaaataaagaaataaattgaattataatttactttaacagtagcacaattttttttcatgggcaaattaaatcactctaaaccaacgaaaatgaaaatgaaaatatccttccttagtaaaataactgttaaaaatccttttactgtggtgagttgcctggaatactggaaactttccctacccccacctcacaattctaatttcatgtttttctgtgtcaaatgcagccgtcaggaccagttctaggggataattgtttttgttaggctttgaattctctggcaataaatgcatgtccttaaactttaatgatttggggcccactaaaaatcatgaagtgttatacaaattatcagagattttgtatcattatacaatacaaaatacaaaataatttgtatcattatacaaattattataaaagatatacaaatgtatataatatatgcaaatatgtatataatatgtacaaatgtacgtattatacatatatgtgctgtatataatacatacaaataaaatttgtataaaatattatataaataaaagtatacaatataaacaaatattttataatatatacatatataaaatacaaattatttcctagacagatataatctacactagctttttcctattagtttcctctgtaccttctgaaaatttgtactctaaattttctttctaaaaatttgtactttaaaaatctatgtgatgtgtctgaaagtgctcactagaacacaaagctgataaatgttgaaaaaagaggaaagaaatctacactcaaatacatttagtagtacagtgtgtaaaagtgtgtgtatggggaaataaattatgaaacatcaggctgtagagttaagtgggcaccagatcataagactcatgggacagactaaataaatgtcccctgttacacttgaaaccatgtaactaaatctggccactcaactacaagcagaaataactgttgtaacttctggaccagtgcagttaagaagcagtgcacctccttaattcctttcttcttcttatacagggacttgggagtccacatgtgctagatggtgtagccacaggatggagaagagtagctgacctatactgaacatttcaatgagtgaaaaataaacctgtgctgtgttaagcttctgttccatttcagaatatttccatcgctacaggattgatctcttacctggctcatccttaccaatgaaggctcttcatattttttattctactgagatatttgtaattagtcttttttcacatgcacttgattaatcaaaattatacataattattgtataagtgaggtttaaagcaactgtccctaagcagcttcatacaggtaaatgtctacagtcaggagctggcagcaagtttgaatctaggtcatgtgatatttttgaatgattgaagagctgtgagactcctgaggtgctttgcaattattaataggtcataaggaaaggcggccaaagcctgagcatgaggggtgccacatgagagaagggtagcaaatgtaaatttctagatctcatgaggtggcctaccaactggtactacataatctcagcaatatatttacatgcaatacaaaggtgtacacataaagtccatgttgacatatttacacatacacactaggaaataacttggatcttcctgggtatctcattcttacaccagcaatttcaaaagaagcaatgctttttatctttagacctgacttccaaatctgtttacagacagagagtgaggtgagctattgttcttgaaaaccaacactgccattatgaagtatttctgagaccaacagaccctttcatggtagctttcatttacagaaagagaagcaaaaaaggtaattgaagagaaagtaggtaaaaatctgttgaagtttccaagtggcttttaccaacttaagttgggtttggaaatacttatatatctgctggttctttttttcttttcctttgttttattttcaggaggcccctattagctatatattaaatacagatactcgtgttaggcttatgagtgctacaatgttaaataaggcccaagtccctgtcctgagggaacaatgtaagagggcacatgtgaccttgatatttaatttaaattgcatattttaagattattgtctattatatctattagagttgtcttgaatagttttacaataaaatgtgaccagtcagtatttaaataatacaagttatattttcaacttcaactatttatgctatctatacttcatagtacataaactccattgcacttagcactttgtgtataattttaccttgtattttataactaagactactacatctttggtaaaattatcaagaataataacagtttattattatctagaccctagggttttgtactacagtattgggctataagcaaactatcagctccataataaactttagaatgagcttctgcatggtgaggggaaacatggtttgaagtaaactatgaagtttgctccctttggaaataaaagggtcttgatctacaaacctactgaagtctttaaatagtcattgtatgttgagtggcacttggcccagctttggcttaacagctatggaaaaatccaggggagataagaaatcaccgtgctaaaactttaaggcatagcaaggctgctcgttattgtaatagttatgagcctatttttcccagcttctccataaaagacattttaaaaccttgcatatcattgcaatatgctcataaataaacaggtagtcatcttgtcagtatggagtttattataggttgtaactaaaacgtatcctttaaagggtatatgttatattaactgtgatagatatatatgcatgtgtgtatttatgtatatatgtatatgcatgtatgtatatatgtgtgtatgtgtgagtgtgtatatatatgtgtatatatataaaatcatctaatatattccaacctatggcatcacctatctgttcccacctcacttccaacctttgctaaggaagttagtcatgtcatttgtaagggtaaatttgaaatgtgcagctcagtcccactgacgctaaggaaaaaagcactaaacaaaattaaattaattcctctttatatatagtaatgcatttcaaataaactcccagagggtataaaacagttattgtttatccttacaattattatatattcaagtctgaacataaaagcaattgatcttttctgtaaaatgctgattctattaacaaacccacctttaaatattactcgctgttccaaactgctttttgtagactgcttcagccagtactttggagggggcagtcaaccatgttgctgtactgatcctcacacaactacagaaattacaaatatgttttcacaggagcagcaagacctcattaatcaagttgtacacacttccatcagccacaggcagagccaatgggtctgtctcagatgtcccaccctaaattctgtatttgttcactttagtttatagagaataaagccttgtaaaaaataaatctgatggctctactaatggcataatttgtttttctcagctactcctcctcctcccaatggcaaattacttttaaaagtaagtatcaaaaatacatttcacaaagcatgatcttcataatttatcacataacacttgtctcctaaagtaggttttttttgttattttacctgcttatctaaaaataagtcaatacatttaagcatcctccttttgcaactgtctatacatgccctctatttttaaatcataatcactactgagtcacagatggacagatgaacccatgtaaaaaaaaaacattccttgataaatcgatctttccaacttttatcctaatagtatgaatgctcatattcagtcaaattgcttgaacatcacctatgatgctatttttatgtgaaataaagtaaaaataaatttcttggttttgctaccttagaaacttatacatagaaacaccatactgactaaaatgcattattaaactctagatcatatcaatcaaacataagtatattttcctctcattatcattttaaaggatttttgtggcctaagaaaaaattattttaaacatgatcatttgaattttaacatatgtaaataaaatcataagatacataatagtgtcttatacataagtgtcttatccttcaaaaattatgtgagcaaatttgctattcctggatatcatatgtctctcagcttttgcttttttccccattttctttttgtttacaatacaggtctgtagtatttcattcagaacaatgagctttaaaataaaaaaaggattcattttcttttaaatattgtatggttacctccttattatgataaattataaagttcctttagatggtgtcctcatattattaagataaattagtccaatttatcaaagaaaagtgctcaagtggatccatctgtccatctgtgaagcatgaatgctgtgagaatacgactttaaaaatagattcgaagtataagcggtgtacaaagttatttaaatatattaaattattataggtaaattatggtaaataggcaaaaggtaattcagcagaaatatacaataaaaataagcttgttttatcaagctcaatatttaaaaacatgtcacctttctttttcccatattcattttatgaaaatgtacgtttgcccacagagaagcccagacactgaaaatggtctcatcaacacaaccaacattttcctttgactaacctccttcgatctgttttaacactgtagagtgcagaaacgtagctttctatcaaagacatagtgtgctgccctccactgtgtgggagacttgaaattgttcagccccacggtcacttggttactacattacactgcaagaatatagtaggtaaacacagtgtggtgtggggggacaaagtatcctttctgagcagggaggtttagataatggtcaaacaataatggatttcatggtgtcggattcatttgatttccactggcctcacccagaatcatctttagattacttttgaacatcgtgtattcattgctctcctatttgtcaaagtacattttctaggccaaattttgcttttcagagcatttctaaatgacttcccatagatgtcttcaggtttctgagacaaatttgcttgacagggaaaatattcaaactattatttataacctcatttctaaaagaacggataccaattttctcatacatgaatacatttttttaaaaagaactatttaaatctttcctgaaggagaattcataaaatacttacgtgacctgtgctgataatatcagattaatatttttaacaacttcatatgcttaaatattttaagatcatgtcttttcctacaattttacatttggtaaacagcaagcagcattttgtaccaaataacacactcagttcttagcactttttttaaaaaaaaaacagtattatgtttacctaataaaacacagacaaggaaggtacacttgtacagtagacaaataatttgtacaaaaagtgtgccattcaaatagctgaagattataaatgttcatatgggagtaaattcttattccttgattaaatcatcttaaatgacatcttagctaatttataattggagttttcaattaaaatttcttgattaatgaggttatatatgttttccattcctggaaattttggtgtatatatttaccctgtttaaattatgaatcaatgatttaagtaacatgaaaaatgatagaataacgaatacttaactatctaacatcacaaaggctaaatgttgtcattttcaccaattcattcagagtgaattaaagaaaagaggtatagaaattctcatgctttaataatttcttagcaataactcaccagccttaaatattggattcaaaatctaaccttcattatgaaaccttgtatgtcaaaagatatatacaatatatgaaaaaagatgaatacattcactgaatatatattaagtttagaaaagtatattatcctaatttactgcatgagtaactggtataaattattctatttcagctacatctctgcacaattcatttaaaactgattatgagaactcttcttctagaaatgcagaggatgagggaaaataaaccaatgcaacatcatattttgccacataatttcacaacagatattgttcttaaaaatcatgaaatcttcaacagcaagccccctttaaaatgtcttgactcagaatactgtgcaatatcttattaaatactattgtatatatctaaacttgttctaaatgtgatatataaaagtcagaaatatttacatattttaaaaacttgtatatatatacatatatatatccatatatatctccatcaatctatatcgctttgatagaaaatttgatgatctgtattgagaaggcagttttctattctgcctgaaggttcagataggtttctatcagaaataaagtggaaggtttagaagaaaatcaaccaataaaatctatttcaaattgctgaacatgaatttgcaggttttgttttgggctaatgtatctgttttttcctagtttccaacctcaccaagaagagcagagggctggcaaacactggcttaattatccccatcagtctcagagacaaggcgcttaagagttctagctgctgtaaacactcccctgatagcagataaggaatctgctgaaaggcagttttgtctgggaaacctcaggggcacaccagttaatcattagtgcaatattgtatatgcattactacatcaaaggaaacagaacccaatattctattgtgaagattgtctgtgttttcttaaaggtaagaaaacaaatgctaaaccagaaaataaaagataataattacattcgcacatttaccacagaaacaaagaatgttctactttacattttttttttcaagaaagaataagtcattattgctttttattttttaaatgtgcccactgggaaaaaagctttccactgaagtcaaacgtgtaacttttgtctaaagagaaatttgcatctttgtatctaaaaacattgatcagaatcagagaatatcacataaccttattttatcacaacactagaagtaaaacaatgttattcttctatatcagcactgtgtttgtaaagggatctatttgtggaaaactgacacctcactgtccctaacaaagaacctttctatcacttcaaaatgaaggcatccacaatgacctactattctttacatctaatagacttctcatagtcccattatcagagaatcttagaggtttccaaagccttcctagcatgagtccagagttaacttccactctctctcagcccttctgtcactgtgtgcaagccaaagaaaagttttcagcatcaaatactccttgccctttcccacatccttgccttaattagcactatttcttctgattggatgtctatttgctagccccatctctacaggtttacctttcctggaagctccaagtctcatatctgaattcaaaacaatctctgttgcttcccttatgtaactggaagtaatttcttttttcctcgggactcttgtagcaacttttttattagaataatgcctaatctaatgtttggcatatcatgggctctcagtaaatgctgctaaatgaccaaacttagtagcaactgctgatttttattaatgattatgtatggatatttaccaagattttaaggaaaataaaatgaccctttctaccacagaaagcatggtgactttcagtgaccatactgaaaaatctttaaaatctacataagattactaactcatgctactctttcagtgtgtctaaaatcatctaaattcttcactttttttccttgatgaaaaattcagtgatttagactgagacttacttaactatttgtgagttaatcaggatgaaacagagatgtctcaatcaggtattaataagcccagattttgcttctgtcagatatgatacagtcccatcttcttaacagatttttctcagaggaaatttttagtttaaatttttagtttacagccaactcaacatggattctaaacaagtgagttcaacatccaaacaaaagtgaccaaaagtttttttttattctatgttttacaaatgtgtagtctcagtattatcccaagtctatccccaaggtccataaagaatttgaacccatactttaattaaagtttcaggataagggaaattttgtgtaataacatttccatttggttcatacaatgtaattgataaagccttccttaattattctgatctgaggctttcaggaagactctacattatttgaatcaaaccatatgtgcctccatgctttctttgtctagacaccaccagtcaaatagcctaggtaaatatttcatactgatgaagcagtgacatctttgaaagctgacaccaagacagagtggctctttctggagttagtatatcaaagagggaaggttttgcatataggctgtctgtaaagtaaataacatcataactgcaattttgaccttccaaagcattttactctgtaaaagtaatgttatggcagattaattcttttactggcactcttactactcagacatatgtgccagactttctatagtagaagacaaaattcacaatgtgtgagagtgcatggttagaagaaagcttttccttaacaaagtagaacaatagttagggcaaggggcttgtagctgaactactgtcattttgaaatccatttttggtgaatgttatctatacggccttaggcaaattatttaacctccacaatcctcaactgattcatctacaataaaataataacttctattcgacaatgtctggcatgtggttgtcacattagcatttgattaatatgaaaaacagcagaagtgtgagtttcactctgcgttttaaaagtagaacagggtaacaaggtttctaactcatatgacattttaatagacaatataataacaaaatttgatgaatatgtaaaataggttatatccatttaaagcatataattttgtatatacataacattttaaaagtttcacatagaaagttttttttactgaggttaggttataaaaatgagacaaattgtataattgaaactttcaaagagttataataaatatttagttttaatctataaagattttctactttgttattataatgttttaaattcagtggctatcattttttattttctgtactggcagatctggtaaaagtatgactttcaaatctgtagccagatacttccatcggtatactaaaataaagactttgtaactcaatggaatggagaaataaatttaaaaaggaatggccaaattagcggctaattttaaagaaaacacaaatagggcttacaatacatgcttttaggttatctaccacctgttttagcttttaaacatatactcacacattatattttcttagcaactgcaagcccattttgatgtcctaagaatttaatatagctctttaaaaattaacgtactctctaattggtaaaaagaaaaatgtcatgtaagctatctagtgtgacttgttttcttcctgacattcatgccaaatgtgcttagatgctgatgggttatgagatccaaagaatgctatttctcagttcttcaattaaaaaatggtttataaattgccatatttcagaatataaaacttcattttaccaatgccaacacagccaatgccagcactatctttataaaaaataaataatacaatagaaatattgaataaaatttagtaattttggtctcagagtagcaaaaacataatttaaaacacatatacaattgtatacctaaatacttctttcataaaaaaatatactttttaaaagagctattaagttttaattataaaacaattgaaatttaaaggtgataggcagttgtcaaatattacttacagcctaatttttaaaatttgtgccatgaagataaaaatatgggcattttactgcctataaaaacataaatttgaaacacgaaaaaatatatttactgattgtatacaatatacattaatttaaataacagcagagattaaatttagcagtttggtatatatcccactataatatcagacttaagtatcagattcctatttacatgatgtaatattacatttaaatttttaaatttaaatgtttttggatagtatagcttttaaaggtatcctatggttgtaattgtgtgatcagactaagtagcccatgcagacttgtatttgcaaaatatacaatataaaatcaatttcttttcatcatatcttgttaagatattattaaggaaatgatcacttttgtataactaaaagatagaacatgaaaataagtaggcttttaactgatatttattttacctcgttatcactgacaacagaatcatagctacagataatacctagatagatttattcattgaaaaaatacatggatgcttaaaaattaaagaacatgctattataatcatcattacactgaattcttaatatttcaaaatgtaatattcacatttaatctgaacttcacgtccaacttagacacttagataagaataaactgcagccagatatctatgaaaaagacaaatgaaaataatttacatttgacagcaaatacacctaaggcacctgtttgttgctttcattaaaaaaaaaatacttatatatttggaaatgagttacataaatttttgttagataattcattttaaatatggatttacactggaaaattaattggatttacaaacggatttacactacttcacaattggtagtgtgacaactaaaccagcctctatacatgattatatatacatttacaaaacttttaagaactaccaatttattattgtccatgaattccactatagatttgaacttatgactcatagataccaaacagctaatggaaagaggatcaaggatcagagaaattgtgcttccagatgccaatatgttgaatataataagaactgtgaaacacatctagtgtacactgtggaatgacacaattctacacatctctggtaaactggttagttaactgaagaatgtttaaaatttacttcaaatatagaatatttcatatctcaattctgggctgcaactttcctttcttaagtagttctagttccttatgcaattagccattcttttgaatcaacctagcatacagctagttgattgtttagggaaatgggaggaaagggagatgggagaatacccgggaagtgattcagagcatgtattgccaaaatttttacactgtgcatgctttgcttttccaagttgtcctgtgcccaattagaacctgaatttttttctttcaaaaaaatgaatttctgtctaaagccccttgactcctactaccgctaataaagaattctcagtcagcaatttgcagagtagggaagccagggataatgcaactgggcagcctttacaagcaaaacaaaacaccaaagaaagggaataaaaagactgacaacaatgtaagctctcccagaaggctcatacttatttttccccctctaaaatgtaacattaaagaagctgaatcagctgtgaccataatgatgcaaagttttgattattatggcaaattatacctttgctattcaggagagggcaaaaaagttttgtggctcatcaaaagaagcaaggaatgagagccaaggccactgacatttgtggtggcagattaagctgtgagcagactctaaataaattccattctcccccatccccaaaatacactattctggctattaagactgacttgcattttatgcatgccagtacactatccattcaggatcacttatttcagtgggagacagggagggtagtcttctgagttaggaagctgtaacagattatttgtgtgtgcgtctgtgtgtgtgtgtgagtgtgtgtgtgtgtgtgtgtgtgtttatcagactgctaactgaatgaattatagtctctgcttcaagtttaaataagtattttataaaatagacaaaatatttaaatcttatttaaagtcaaatattttataaaatatttataaaaatttctggtcatttaatttttgaaaaaaaatgcttaaaacagaaattagcctttctgtcattcacaatacatgactaaaatcctttcttttaggaacacaaaataaggtttgcaaagacatgtaaataattcaaactaaagttctcaaagatatataatctatataagaataaaatgctcaaattatcttgtgaactctttggttttcttgattaaatgatgttttctttttacattgactaacgttctttacagttgttttggaataatatatccccatttagaagaaaaataagaatatatctgtcataagactgatgggaaaatatgaagcaagtaaagaaaattataacaatcctaaaatgaaattatagaaagtgaaacaatattaaggaccataaaccaagtgtcattaaaaatagtggcaatctattgcaaattcagcattaccagtcaaactaaattgactgtaagtactgagaaaaactttacaacttcatttcaagcctaattttaataaaaatatttccttagctacaaatagctttatgaggtataaaaaaagaagaagtatatgtaggaaatattatctttgataagtcagtaaatctgactcttccataatcaatgatatataacctgatatccttgtttcggtttatacatatgctttatatttgttcatctacaaatcatgataatgtttttaagctaactagcacacaaagaactacaaaagttcaaatttacaaggactcacaaataactgtaagtacatactgaggagaacaggtttctattgaggaaaactgtctttagtattcagaaagtgtaccttgaagggaaaaccctccacgatcagaccagctaaaacaacaatgacaattaagcatatagtagaaaaatatcaaatatcaacaatgacaattaggaatatagcagataaataccttcaaatctaagaaaatgccctaaaaattttgatatgtcattcagtggcagtgaggcaaagaagacagggatcaccatctcaaggtgctagcctccgaaaaaatataaatttgattggcaaaatctgctcagagaccatttacatgctattcatggaataagaatgaagttgaaacaagtattagagtatgttctgtgatgcttactactgcatatctgatataaattatgattatattaaaaagcttggcagttttcactgtgtggcctggtttgtgcaagataggattccaaatattgttttctccaaaaactacagtgaattaaaatgacaattttaatatcattggactgcttacacatcacagaggatataaaaattatggggaaaaaagaacagtgactttaatcagctccatgttacaaattacacctttcagtgttaaggatacaaaaattccttaaagggaaaccagatcataaaacacatgaattcagggagatctatggctaccacaaaccacactgtccagctattggaaagtattgtcataaaaaagtttgattgttaatagatttctgaaatatttccaggtgattttctcattaataatatattttatcccataagacaatcaccaataaaacataagatacataacttagagcacttgatactacattttgaataatattatcaagaatagcttttaaaaatgtctctgcttttaactctatggattaaatgaatttataaagcacagatttatttatatggattttaaccattcttttaataaaacgttatcaaaattataaaaatattattacatttttaaataaacaatgattactatagttgtataaatgaatccaaaattgataaatgatctctctatggactgaattgtgtctcttccaaatttatatgttgaagccctaacccccaatgtgactgtatttgaatacagggcttttcaggaaggttaaacaaggtaataaggtcagaagagtgaggccttaatctgataggactggtgtccttataaaaagtagagacactagataactacacccccaaaaccctgtcccagcatgcagagaagagatcatgtgtggacacagtgtaaagacagccatctacaagtcaaaggagagtcctcagaacaaaacctatcttgccagcatcttgatctttgactctggcctccagaactctgagaaaatacatttctgttgtttaatccacccatccgtggtgttttaatgtggcaggcctagaaaactcttaatggtgtccaagcaaacaaaaacataaagtggggaaaggacacccttttcaacaaatggcgctgggataattggctagccacacgtaggagaatgatactggatcctcatctctcaccttatatgaaaatcaactcaagatggatgaaggacttaaacttaagacctgaaactattcaaattctagaagataacattggaaaaacccttctagacattggcttagtcaaggatttcatgaccaagaacccaaagcaaatgcaatgaaaacaaagataaatagctgggacttaattaaacaaaagagcttttgtacagcaaaaggaacagtcagcagagaaaacagacaacccatagagtgggagaaaatcttcataatctgtatatctgaaaaaggactaatacccagaatctacaacgaattcaaatcagtaagaaaaaagtaaacattcccatcaaaaagtgagctaagggcatgaatagacaattttcaaaaggagatacaaatggccaacaaacatatgaaaaaatgctcaacatcactaatgatcaaggaaatgcaaatcaaaaccacaatgtgataccaactttctcctgcaagaatggccataatcaaaaaatcaaaaaacagtagatgttggtgtggatgcggtgaatagggaacacttctacactgctgctggaaatgtaaactagtacagccactataaaaacaacgtggggattccttaaagaactaaaagtagaactaccatttgatccagcaatcccactattggatatctacccagaggaaaagaagtcatttgaaaaagatacttgcacacacgtttacagtggcacaattcacaatagcaaaatcgtggaagcaacccaaatgcccatcaatcaatgaatggacaatgaaattgtggtctatacatacaatggaatactacagagccataaaaaggaatgaattagcagcatttgcagtgacctggatgagattggagactattattctaagtgaagtaactcaggaatggaaaatcaaacattgtatgttctcacggatatgtggaagctaagctatgaggacacaaaggcctaagaatgacacagtggactttggggatttgaggggaagagtgagacaggggcgagggatgaaagactacaaatatggtgcagtgtatactgcttgggtgatgggtgcaacgaaatctcacaaatcactattaaagaacttactcatgtaaccaaatcccacctttaccccaataacttatggaaaaaaaaagactcttaatggtgtccatcaatattagcttttcttctgtaactgcatagctgtttgaggctgaggaagtcatttaatttctctgaatctgtttcttcctttgtaaaatgatcaagctaggctagctaaatataagacacatataccaccactcttttttcccatgcccagagaaaccatactattcttggtaatcataaccaatcagtgggaattatcttgggagatatggcctattctccacacctgagttggaagacatatgagctcggttttagtactattaatagcaccgtaggtccctactactacaagtgcggcccgtggaccagcagcattgacatcccctggaactcacaaggaatgcagaatctcaggcaggctgtaggccaaccttctgaattagaatctaccttgtaacactatccccagtgcacatttgacaagcactgatctaggactcattaagtttctaaaacaaaggttgcaaaaagtggcaagccacaaactaaatgtggtctattacattttttgtttggtctctacactgtttaaaattcttgaattatttgccaaaattaaaaggaggaaaagttcataaaaagagattaatttattgataaattgcatgattatataaaaataggctaacatttctgtatgacaacagtggagctgagtgacactgcttcctttacaacagaatgctacatgttccctgtgacagggttcattgcagtcctcttcatttacttatgttatctacctgaccctggtacgcatttgactttctaatctctgctgtcaaatttccttttcttacatgtagcattgaattaaaaaaatgtaacaataaaagatgtttaaatatataagtatctgtccaaaattaataattcccgttatcatttttagttttctatttttcttcactcatctctacttattctttcttttttaattttaaattttcttttatctgaatcttaccattgcttgttttaatgcctgtatattatggcatttgtttactttaatccatcagagattttgtcatttaaccttgctctctagcagtctagtaataaatgattttgtaaagtaatacactacctttttttattttgtgggaacagggtctcactctgatgcctggctggactgcagtgtaagatcatagctcaaagcagcctggaaattgtgggctcaagaaatcctcctgcctcagcctcacaatagctaggattacaggcatgagccactgcatctggctggaatatactaatttcgtttaaagcaagttatctcttttgcttcacgtcttgtaaaatcattgtgaaaaacatttcatgtcttcaaatgtttttaggatccagggaaaatttagaaaaaaaatgagaaattaaagggagatatagagagaaatagtaaattaatgaattggtgattagctgattgacatggtttggctctgtccccacccaaatctcaccttgaattgcaataatccccccacctgtcaagggcaggtccaggtagagataattgaatcatgggggtggtttcctccatgctgttctcagaatggtgaattctcacaagatctcatggctatataaggggcttcccccttcactcagaattcattctctctcctgctgccctctgaagaggtgacttctgccatgattgaaagtttcctgaggcctccccagccatgtggaactgtgagtcaattaaacttattttcttcataaattacccagtctcagatatttcctcatagcatcatgataatggattaataaactgaccaaacactaaattcagaaacgtgcaaggcaccagccaaaaatctaattacaataactgcctctggtagctagttggatatataagggaacacactgccccaaacatatttttatagaagttatgaaaactgatacattcttagctactttgggccttgaatttaaaaatttccagggtgataattttcattaaaattaatggaaattaggaaaatatgtaacatagtattattttcattttaattccaattaccttaggaattttatcttcttattctcaaatcccaagtcttactactattttattgttcagaatcttaaaagccatttaccttctgtttttatataacccttaaacactgattcccttaaacaatgaaggtatccacatagttttaaccataatgtcaatagcaataaatgataactctttacctttagttatatttatcccacttctcagtctttacctcttttcaaatacctaaaattttatctgaataaattaaagtcacctcatactcaatatatctagtacctaatttctcccacataaccattattttcccttaactcactgttgatgtaaaaagctattatttgaagaatctcaagatgactaactggatatgaactagagatatgagtaaaacatgtccacaaatctcagcagtttctcagtgaaagcctgtttcttgtgtgtaccatcctccagatttttactgcccaatcacgttgggcaaggtgttcttggtttttccccagcctatgggtttcattgggacctgcctcttccagtcctctcatctgccatttttagactaatcattaaatatcactagcatagtactttcatatttaagcatcaaaactccattgttacattataacaaatggaatctaaattcttgttcactttaaaaactttcaaaatctgacaatactctatctaaacatatcctctgctctacgcaattcagtttctttacaatgtcaaatacatgccatgctcaaaagagaggtttttaaaatgtgcatgcttgtttccatctcctacatgctggtttctttctttctcattttgaattaaacaaatatgcatttattacccactacgtactgtcttttaaaatccaatgcaagttctattgtatttaggaagactttcctatgtcagcactcatttatttgtggccatcactactgataatttcaataactaccctttgtggagtgcttaccactgccagatggtcagttaagcaatttatatacatcatctcttttgttcctattgatatctctgtgaagtacatattacaattcccatactatagatgaggaacctgaggatcagcgcacttttggcacttactccaaaccatgaaaagtcttactttgagctgagaggctcattctctcctctccacttaaagagaaagaaaaaaaagcatgaaagtgatgaagagttacataggcgagaacttggtttgtgtgacccaaaggatatttgcaatttagtagcaagctcattttactataaatatttttctactttgtaaagatggcaatagtatataaaatattttaaatttgtgtaaaaatatgttacttttaaaacttttaaaatctgatattagcataaacaagaagacctgggccttatttacaatgttgaagaggctggatggcaataggccaagtttgaactaagtcctccaccaaccagtcctgaatctcgtagcccccttttccttacttaatcgataatacactaggttcaaagcaaggacatcagacacaaagtatagctatgttctctcttttttgtcaacagttacttaaggccttcccaggctcatggatgcaaattgaatttaaattcataagcagattccctctattgcttgtcttcatcacaacgcaaaatatggaactatagcacatttgatttgattcaaaattaggacctctattggcctaagacaattaaccccttgttgaccttaaatcctataagatccaagcttcctttgcctagctctgaaagcctgtcttaaaaagatgcctggccaggcgcggtggctcacacctgtaatcccagcactttgggaggttgaggcgggcggatcacaaattcaagagatcaagaccatcctggccaacatgataaaaccccgtatctagtaaaaatacgaaaaattagctgggtgtggtggtgtgcacctgtagtcccaggtactcgggaggctgaggcaggagaatcgcttgaacttgggaggcagaggttgcggtgagccgagattgcaccactgcactccagcctgggcgacagagcgagactccgtctcaaaacaaaaacaaaaacaaaacaaaacaaaagcctgaccacatcttttgagctatgtccagctgtctgtagttctttatacactacattttactttcttctcccatgccattgttcatgctcatcccatgcctggaacagccttattcacccaatcatcatctctcaagacaagattaaaactatacataacagggaaaatttaagactgtactgaagagcaaaaacaaaaagcagtaaattggtatagaaaatagaagaaacttccaaagttaatctattaaaacaatagtttttgtacttaactattacaataatagaaatgataatgatggggttaatgacaacactaaatacatttattaagtggttagtatatctcagattctctgtaaatcattatatactttatctaacaccaaaaataaaattaaaataagcccaagaaagtagcattatattatccacattttagagattaggtagagagtacaaagttttagtaacttgtccaacattgtacagctaactaagttgacagagcctaatttgaattcagttgcaactgatttgtgaggaaagcataataaactcctataacacctcttgttaaattattaatcagattatagcaatgactatttttaggagccatttttgcagtcaatgaaactggagataaaatcataataatgatagtaatagttacagttttcattattattgtgtggttttccatttactcaaggattatttcagaatttttacagcatttactatagtttgttaagcaaagtaattaataatgaaagtactaagaataatgtagcagtttaaataactttaaaagtgaaaaggatacaaaatgggaggtattaaggtatcaagttatagttctattttatatgatatggttgaaaggtaataaaaccaatggagatacatatatatccatatatatatccacatatatatccatatatatatatccatatatatatccatgtatatatccacgtatatatccatgtatatatccacgtatatatatccatatatatatccatgtatatatccatatatatatatatccatgtatatatccatgtatatatccatatatatatatccatgtatatatccatatatatatatccatgtatatatccatatatatatatccatatatatccatatatatatcatatatatatccatatatatccatatatatatatccatatatatccatatatatatatccatatatatccatatatatatatccatatatatccatatatatatatccatatatatccatatatatatccatatatatccatatatatatatacacacacatatatagctactgtgatttgacataaaacatgtaattactgcaaacacgtgtttatacataaaaataggcagatagacattattcagtggctaatttttaaaataccaataataatgctgtatattatattacatccatggctaaaacatttcaaagaccttaacagtgactattttgactttgaaggaagttggtgatgaattaaaaatccataaaataaatataggaataataaataacaaaaagattaagggaacagcacattatagtatagcaacaataacaacaaaacctccaaaaatctaaaaagtgaatgtgcatctcttcccataatttctctgtgaccaagtgtgaacttgcataaaagcaaacgatgtgtgtgtgtgtacaccacacatatgccttcatttctttcaaagtcatcattttccacatatcattcatgtttttagaaggcttcaagttttaatgagtcagtctaactgaaaatattacaaatataaacacacacacacacacatatttgtaaagaggaagaactagagtgccataagacaagtgagataaatgacaagaatggcgtcagttccattcttggcctccagaaaggttcctattagtttgtcctcggctttggaaactaacaaataaagaaaattgcatatgatttggggcaagaaaattttctttagtcactgatttactctgtggcacaatcatagcagatagtgcccaaattgaaaggggaaagtaagaggtctgttaatttttatattactgagaagatttttagaaataaatatggggaaaaaagagtgaagaagaagtgatattctctttccagattaataaatacatgattaaagatatttgtcaatgattatgtaataagtctgggttagaggaatatattgacctgcaacataaacctaactataggtcagatagcctcatatgaatcaattattaacttactctaaataaaacacatactctaatataacacattactctaataaagcttactctaatagaacacataaccaagccagataaatatcatggatatgacaagtcttacagaagtctcagattatggagagaaatcccccaaagtttaggtatggtactaccacagtaatataattctgctgaatattttaatggcaataaatactattaggctgttttgttgtaaacaattggcttagattcaaagagttacatgtataactaaatcaatgtgaaattcatctaatgaagaacagttacttgatacctaatcttgcctgatcttttaacaacaaataaaattgtaatgcaacaattctaccattaatacaacttttctcactaacgccacttatgtgtgtggttcgtgtttagaagttacatcaatagcaagttgctgggcaactacatatctgagagtgtaaatgtggattattacctgattctggatgttacagttcttagaagaatgcagcctatattttttcttataagggggacttcaaaaacttcatggaaaatgaatattatgaaaaagctatggatgtatttccatttttgtaccaaaataaactcatactaacttgatatatcatgtctgaacaggaaatagtttgaggcattaagaaggattagacatcagtttgaaaagagcccctatcagagcaacatgaattctgctaaagttgaagcaagaacaaacataaaatttagggtgaagcattggtgaaagaatgatgaaatcattgatgctttatgaaaagtttgcacaatgtcccaaggaaatcagcagtttacaaatggataacttgtttcgagaagggagaagaccatgttgaagatgaagcctgcagtggcagacccatccacatcaatttgtgagaaaaataaaattcctcttgttcatgccctaattgatgaagaccaatgattgacagtagaaacaacagccaacatcacagtcatctcaactggttgagcttacgcaattctgaccaaaaaattaaagtggagcaactttccactcgatgggtgccaaaaccattgtgcccagatcagctgcagaaaagagcagagcattaatggaaattttaaacacttacaacaggaaatgaaacatgtattttccagtatgacccagaagacaaagcacattcaatgcaatggctaccaagaggtggaagtgctccagtcaaagcaaaagtggaccagtcaagagcaaaggttgtggcaacagttttttgggatgctcaaggcattttgcttcttgactttccggaaggcattttgcttcttgaccttctacttattatgagaatgtcttgagaaggttagccaaagcttgagcagaaaaacatctaggaaagctttgccacggagtccttctccaccacagctatgcttctgctcattcctctcaccaaacaaaggcaattttgtgagcatttcaatgggaaatcattaggcatccaacttacagtcctgatctggctcctttggacttctttttgtttactaatttaaaatatctttaaaggacactcattttcttcagttaatgatgtaagaaagactgcattgacattcttaaattcctaggaccctcagttttttaggaatggactaaatgtctggtatcatcatttacaaaagtgtcttgaccttgacggagattatcaagaagcaaagcttatatttttatcttctaatttcatttttccatgaaagttttgaagtcccttcccatatgttcaaagaatgaataagaagcaggcaaactattgagaaaacacaattttatttcatctgtctttatttcattgtctttatttcatctgtctgtacctaacttctgggctgtagacacagaattgttgggagagagatgaaagaaccttcactatatcttctcccctgcttaacttattgtacatggatattgttttgttgacattgcctttggtgccactgcttaaggcaccttgtaatatatagctcttacgtgatactgtaaaatcatagaggtagtactaaaatgactgaagtttggaaagcacttaaatgttcctggcaaatatatatatatatatgaatatatataaaataaaataaagttatataaaatatatatacaaaaatatataataaatatacatatgtatatacacacacacatactcatgcacagctcttctatagagatatgttctgataaatgtgtcattaggcaattttgccattgtgcaaatattagagagtttacttacacaaatttaggtggtatagccttctacacacctaggctgtatggtatagtctattgctcccaagctacaaacctgcactgcatattattgtactgaatactgtagccaattttagcataatggtaaatgtttgtgtatttaaacatagaaaaagtacaataaaaatgcagcaaggatgataaaaaatggtacacctgtctaggggacctaccttgaacagagcttccaggactaggagttgctctaggtgagtcaatggatgggtggtgagtaaatgtgaaggcctagggcactacagctactactgcagactttgtaaatgctttacacttagactacactaaatttataagaaatattttcctttcttcaataatataaccttagcttaccttaaggttaagttttaaaaatcctttgtttcttacttcataagttttttaattttttaaaactatttgtctctcttgtaatactacctactttaaaacacaagcacattgtacagctgtacaaaaatattttctttctttatatccttcttctataagctttttcctatttttatcttttaatttttttttgttaaaaactgacacacaaacacacattagcctaggcctacacaggatcaggatcatcaatatcactgttttctaccaccacatcttgtcccattggaaggtcttcacgggtaatagcacgcatggtgttgccacaacattataatggttacaatgacactaggcaatagaaattgtttggctccattataatattatgggactaccgtcattaatgcagtattgttggctgaaatgtcattatgcacctctctctctctctgaggaagacagaagagctgctttgaacagaatactgttctatatgccatctgcatatagaacttcaaaagtctcaatagaaccaatgttctttgtccaagttgataaggtaaagagccctgcattgagcattaaaataactgactatcctgttttagagatggaggtactcacactatcaggaaacactgagatgtttagcaattattaacagtgagaaatactttcttatgtatgatatagtcttccattggccttttgtctccagcaaagatactggggtaccatcttctgggaaatcagccttgagagagttattttcacctaaaatttgaaggccatcattcaaagcgctcatttttttttccccttccctggtcaaattcactcgcaactaaatatttttattcaatcttctttatctttttattatctttgtggctacatgattaatatttctctgaagtttggtcactattaactcagtatagtgctgtacatttatactaacacatggtctacaccagatcaaaattatatcatatgcattaccaatgttcgagttaacaatttataaacttctgcacagacatgcagtagtaggcattgccatttatgctaaatttctgatactaataaactatttaaaactgatgattttagttccattaaaatgcagaatttaggtgaggttctaaaatattttaatattcatcgtatggcacccagttgttttttcttttgtaattttgaaaaattttaaatgtcattacatttatagtagaaataatcaaagtccactttcatttaccacttagtttcatgagtaaaaagttcaagtgaaatgttcaatttttgtgaattcacaattaaaaccttcaaacattagctgaaattttccagcaatatattttatttgattatctaaagagggggaacaaattctaattgtagcaaagcattagtaaagataagtgaagctcatgtaactgttatcctcaaagtcattattaagttatcttgtgctcatttgctcatgtttaaacaagattttccatttgcacacagcaacaaagtagtcgtcaatatgccagtaaccacacagtgataagaaagagcacagctatgtgaagtttagaacagctcctttattcaaatatctacgaaataagaaaaaatttgtaatgtaccatatataaatgcagtatgacgaaaagttatcaataaaaaatatggaaatagagtcaacatttgtgtagactacctttactaatgtctaatcaggaatgatcactgaatattatcttgagccagaaagatctttttaaaaattctttgtcaatctattgccaagaagtccatttccacagctctttaactttaataaactatttttggcaatgggaaaaaagaaaatggaaaaagaaatcaagtggaaattatcataacaaaataaaagtgacacaatgagaaagaatcttaaaaattaatcccccaccctgatattttgggggaaaaacactcaatttttctatcatatatatttttcttttctctctctcctctgtgtgtgtgtgtgtgtatgtgtgtgtgtgtctgtgtgtgtgtgcattttccatactaccaatgggaggctgaaagcaatgaaagacaaaacattgtaagcatttttaaatattcaaaataaaatacaaaataaatgtaccgcaaagtcacacctaccaggcacctgtatcagttctactttgaagatacagaaaatgctaaagagttgttcaagtagtagggctaaggacagtaagtctctttatagctgccatctaataaggttttttaaattttatatttttctgctactctgctgcatgattatacacacacacaaacagacacacatctacatacacacagttggtcttctatatccatgggttccacatctgtagactcaatgattagtaaatagaaaatattcaggggaaaaaatgtgtctgtactgaatatgtacagtcttctatttcttgacactattctacatctaataaagttaaaaaaactatttaaatagcaattacattgtattaggtattactagtaatttagagatgatttaaagtatatgggaagatgtgcataggttatatgcaaatactaccattttataccagggacttgagtatccatggatttaccaatacctcagatactgaggaatgactctgtgtgtgtgtgtgtgtgtgtgtgtgtgtgtgtatgatgttatgctaagtgataaaaacagatttacaactgatgtatttgtttaggaaattgacatcaggaatgcagctcatttattttaagatagtgtacttgataaaaaatacacttaagttatacttaaatatatttcatttatattaaatatattttattttaatgtattaagagtatttatgtatatattttctcacgagaatttaggctctttgaaaatgtatcatacatctttatcatttataattactaccttgcaccctttttcaataattgttaaaatcacatctggaatcccatagcaattgatgacatttggttataattagagattaaatcaagtatattgtatttacttaaagtttattcaaataatattttcaaagttaaagaaaggcccattatttatttcacaacacaaaatcatatattgggtagtcggaattaaagcaatctaaatttcctaaagcaaaggagataggtttcttttttcgttttcattgtttcaagtaaaatgattgtttttccataatttagaaaacaatagtatcttcaccgaaaaaagtcatagttaaatgtcttcccacatcacacaaaagatttaaattaattattgcttattttttcctgtttaaaatgctaacaagcttaaaacattatttatatttcacaggaaaaatgattcaaattatcctaattaatgcaaaattaccaaaccaaaatcttacaaaaattagatgagtcagttcaaaaagttagataaaaagtcaaaggttggctcaaaagaagcagttgtacctaaatgattaagtaaccacttctacagaggtatttttcactctgcgttggaaaggtgcactgaggttaatctaaatgtagcctttttcatctgtataccagtttccagactgtcttgtgtggtataatttacttgttgcttggaaaaccataaacaaaaataagtgacactattacatgtatatgtgtagtgagacattactttttccatgttttctcctctaacctaaaactttcttaactctccaagcaattgcagcctgtcttcaaataccaccaaatcaaccattttgagttaaaattgggctctctgccaagtaattagtcatgtctccaattgccttattagatttattcatgacggaatcatattatgaccagaaaaaaatcagagccccaataaaaatccagttgagctgtctaggcatcacttaaaattaatgtaacaaaaataaatttattcataaatgcattatataccctcacagataaccaagtcttgaaaaagtcaaagctcagaattgtaattattttttgatatttcaactacccagaactaacctacattaaatctgtttttatatattataactttatatgacatcattctttttttccccttaacattaaaaacagtttcccatataactccagtgcctgtgtgatattctgtagatcctcactactcaaagtgttgtttatggagcagaagcaacagcatcacttaggagtctgttagaaatacagaattttagacacctccccaggcctactaaatcagattctgcatttcactataaatatatattattatacacatacacacacatacatatacacacataaatgtatattatacacatacaatatatattatacacatgcacacatacatataaacacatataaatatatattatacaaatatacacacatacatatatatacacattatatatttactatatatttatactatacacatatattcatacacatgtatacatattcatattatacacacatgtatatacactatataaaacacatatgtgcatatacacttattaaagtttgagaaatatttttgtgaactctatgtaaaaatgtgtgtattttttcctgcaataaaacaactttataatatgacaatatgtagtatacaactgcatatatatttatatagttcacattgtcctactataagttcaggttgtttgtaaatgtatctagtattaggaactgttcaatgaatattttaatttatatgtatattttccctgaatttctgaatctttcctcaggaatgattcatgaaaatgaaaatacttgaataaagaactctacattgtaacagttgagacagacacttccaaagtgttttctagattacaagaataacagcggtattttttctgcactaacacctacattattacttgtttaatatagatgtttaatagcaggaaaaatagtatctcacattaattataatttgtaattattttattgctagagaagttaaacaatttatcatgttttttctttttgtactcttcttttgtgaatttttctgtacattttatttcccaatacattcaggacttggtatcttacttacaatattataacccttttaaatattgagggtgttatgtctctttctgtgaacaagtggcatttttttttctaccttactgttttttatattgcgatatggtgcttttgacttttatgtagttaataaaaactaacaactttttcaattgtttttaagcttagagagtctttacccattcagatactcgaaataataaatcaagtgtgtttacctttttctatagtttgatattttcaatagccatgattttgcattgaatttatattattatatgcaatgtaataaagacctaacgtatttctttttcccagatgacttaccagttaaccatcaactggtctacctacctacaccctacaattggtttatgaagaaaatcttgtatttattaaaaatatactgattaattctaagaatataggcacatatttacttctttcctatttcttagaagtttctacttattcatatttcttagaagtttccacttatccgaaagaaagaaggaaagaaacaagagtatcaaacttttccctaatttgtgaaaaatatgactgcatgttttagtacagtctattgactagtaaatcttttaaacaattattttatgcttgacactttagtggatattgtggtggatacaaatataactttaacatgcaatgtttaacctcaggaagctaaaattcacctcaagagacaaagcataccaaacatttagatgttaaatctgctagctttcaggaattcaaggaaggggaaaaagaatgatgagaacaaaactgaagaaagctttgtgaaaggttagagcttttctagtagttgggaagcacaattcaggttgaagtcacagcaagtacaaagtacctttagttatctgtgttatcgaagacaattattcctacatttattatgattaattaggcacatgtcaggcttcctagttcatcacagattaattttaaggaccacagttttacatttccaatgtcctacagaactctgaacacagtgcattacccattgtcattgcttgcttgacatttgttcaattaaattgcttttgatcttgtgcacgaatttttataaatattactcctgatgggctagtatatattttaccagtatctctgtgttgtattttagaataaaggtgtcctaaaggttatgagagtactgttaatacattccagacccagtggctacaaactcttaataagcacagaagctgcttttccttcctccaagcgaaacatcataaaaagtaagtgacagcaattgtgaccctatctgtagaagtttatgagaacaatttaaggacagattgagttacagtattattgtaacacctcatcaaaattcttgtccagatttttagcagtgacttaagacaagtagactggcctgttactgctgggatcacttccagcatcttacccagagcaccaaattacccttttcagttaaccccagttatttttctctctccttcttgtgacggagagagtatataagaaaaggggctctttggctgtctagggcaagaggcaaattcttttctaccattctgcttccaaagagacaaattcctgaaactactgtgacattacattagcagagaaacttatgaaaaggtcatgtctaaagacttcatttgatttcctcttatcagcctgaagccatttaatagctacattttagttttataactatttcaaagagcaatatatgtacaaaaaattaaccatgtttagcacaaaatggcaataatttatgctagtgtaatgacataattacagcattcattttcaccattcatttccacctaaagttagttttctaaaggtaatgggaaccaatatggattttcctaagaaaacatctggcagttaaatttcaggagtgaatttctacatgagggaatgttgtaaatgcaaaggaagaatagaattgttgttcttaaattccatgtttgtggaatatatatatatatatatatatatatatatacacacacacacacactcacacacacaaacacacacacattataactactaccctacaaggtgttccacaatatattatttttaaaagagagataaaaaagaatcgtttgtgtagctgcaatcttcatgtttatgacagaaaaattcaacagtgtttgcaaactaactggaagattacactttattgcaaataaacggcttaagaaacctaattcagctgtgatggatctcaggctgacaaattaaaagactgcaggcaatggctgtaaaaatgctttttctgcaagatttacttcagcatgttgaataaatatattatacctgttaggcttaattctatatttaaaataaatcctggatggtgtggggttttgataaaggtattcaaatatatggaatatagtgcttttaacaaaggattcccaggaggaaatcagtggacaacaatgttgaatgtactcctcactcatcgacaaaccacattttcctttctaaataagctgtgaaaatcctatctgtctatgtgagtcaacatcccattcaaagattaaaacaagcccatacacgatcacctttatctgtacaaattaagcaactctcttcttgatataaaccaaaaggaaacctagtttattttcaaaatcaagtttatgctcctgaaataattttgagaactgaaattttgattattcttatttacacctttctgcttgctgttaatagtatagatgccaatccctcaatcacaagagaaaaagtagttatgtgggtcttttttgttttgttttgcttttttcaaaaaacctataatattcatataaacttcaagtggaaagaatggggaaagcagtaatcctatacttgaggtaaaagcaaataacaacagataaaacccaaacagaatttatatattgaacatttttattttaaattattccatatccaaaatttcacagtcttacatataggcagactattgttttatccacattaagaaacaacctctgagttactagtatttctttttataaaagtagctttgtttaatatccccattttccatatttgccaaaagggtaagacaatcagtctctatcttaccagcgaagaccagtcactctctctgtgtcttcctctccctaggtcttccaaacctgatccttaagtttatttatgtgtctgtcatcctttaccacttgatagcttttaaaatacaaaaaaaaaaaatacacttttttgtatttttagaactgagtgttttttatcgactcccaaggattcaccttccaggtaaacacttattgccaaacttctatatttggcccacacctctttcctaaattcagttgccataagatatttgtattatctctccatgatgtctcataggcacatcaaatactaacttatcacatacatcctagaatctctcattctttctccaggtttgggtggggaatggcacaatcatctacttatgtccttaagacaaacaccaggagtcaagatactctggtaatcaaagctgccaaatagatctaaacttatttccctctctacatatgaacaattagaaagctacctattcattctccacactaccaagagagttctattttgtaaaagcaaatatactacttcctttctttcttaaaaaaaaaaaaaaaaacccattaactttcattaccttctcctctgggacaaattacctagcataaaatgaacagaactaggccccaactacactttatcttgtaccattcatcctaacttgccttgttattgcatgcaacactacttcctctacctggaataagctcactaccctccttgttcttttagaattaagttaccaccctttattcaaatgtgtttccttgtttccataatactaaccatatattttaatatagaggtcattaaattgtcttgaaattatggatctctctgattatcttcttactgttccaatgattttgtcttattcatctgtacatttcttacatagtggcatggctataataggttcttaataaattttgaatgaacccttaagtaaatagtaaatgactgaatgaatgaagctgatccctcattttggaagaaagtggggtattttaaccatacataatcaccttttcttttccttctagtattaaaaatcaagcaaataaaataacctgaattcatccagtttagaaatacttctgaaggtagatattatatgtatctgtctacaaaggagtacggttatttgtatctttttggtttggtgtatggaacatgataatatcttattttctggatacaaagcgaactataaataaacccttagccttttgctgaattttagctaatatcaagcatagttttaaagtgccaaaagccacaagaagcaaaaagcaagaatgcatacagcagcgttgaagaatttgggcctcatgtctggaattcaccataataaggctttggtactttctatctcaactgaagtcttactttgatacaatctgcctcttgcagttagaacacattttttttttttctttttttgagacaaagtctcagctcactgaaacctctgcctcctgggctcaagcaattctcctacctcagcctcccgagtagctgggattacgggcacacaccaccacgcccagctaatttttgtatttttagtagagacggggttttgtcattttggtcaggcttggttcaaactcctgacctcaggtgatccacccaccttggcctcccaaagtgctgggattacaggtgtgggccaccatgccctgcaaattagaacacatttgaatcttgaacattttgaattcagtttattctgaaatttctgtgagagaattaagtgttatatccctttgtatatgctttgatttttcaagagtacacttttggttaatgtgaacaactcagcaacaaagatgattaacggcaaagatggctgcatacatactatattcagagcattgtataattaactaggtgtgtatagaaaccatgctcaagacaaggttttctgatctcttgaggctcaccacctagaagtaatatcagtattagaattttctgaaatattataacatattgcaagcaaataccttcttgaatatgccgttagagagaatataatgcttctatatagatcccttgatatctgaaatgggtgttaaattctcagttgaggagtaatcagtaagctcatgactaatctgactgtactaactagagttttataaaaagatacagagaatttattaaaataggaagaagtaaatgattttctagttcagttggaagtagctgttaactcagaagtactaataggttgctgcatgatttgaaatagataaaatggatatcagaaaagattttcttcctaaagcattttatttgaagtggtcagaataggacaaagcatatgctttcaaataattagatttgaaagggaagaattgctaaataggaggatcttgaagccagcattaaacacatacaggctgaatgcctcaagaatggttctattcttctcagagttcttcgtgctgttatacctggaactgggcagagaggaaatctgagcagccagagcacaaagggtaaacactagggttaaagaagtcacgaacattttcctccagagggttgtcacggatggactggaatggacaaagtcaggcatcaaaaaaatggactgaacctagaagcagaagaaatgccatatttcatgggatatttttctcccttcctatcttgagaaatgtcgtcattgtgggcatacatgtacatatactcttaggtattatgaaacattaaaacacaatgcctaagaattaacagaccgttcttagggccaatcttgagagccttgacttactttgtaccacaaatttgttgatgaaaagaatttattttctaatttcaaaatattagatggctgctggatttctctaacaaagaagaatctgaaccagaaatggaccaacctaaataactgaacaaggcatctctaaatataattcaacttatatatgctgcaatttgtacctgctttacaagtcaataagcagcttttatgtgatctgagaaactggtgaaaaagtgtatagactacaggttaggcagtttggtcagaaccgcctttatggggcaaaatctcaaaatttcaggtggcagtttcacaagcaagtgcctaaatctgatgttccagcataacattagcaaacccctcttacattttggtaaatgtgatgtagttacataatgattatccaataagctaaaagaggagacaaaaagtatgatttaaaaatagatacatatattgaaaatgagtattcaccaaaatataatcctacctctaaaacaagtatagaccatatacacatataggcatgttgtgtcagaagtagagatcagtgttcaaaagttgctgattttacttagagttcaaagtatacattagtaaagcctgaaaatatgatatcaaaagcaaaactacatctaatattttccttattttcttgttgtgcttacagttaccataagaaagcctgaaaaattcaactctggtcaatcagcactctatgggataaaagaattcactcactcactcatttctttatacaatactttagcaaatatggaacactgtgtatttgctaagcactctcccaggcactggaaatataacagtgagtaaaacttacaagtctccacggaatttgtgttctagtgcacagtacattaatattactaaaattattttagtaaccatttgttgagcatatattgtgtacttggcattatattaaaatttagctctcttttgtgtgtataattctaaattatattcagagcttcatgtgattgctaactttcaaaaacatacaacaaataattttacataagacaggtgaaattcagctgatgttattaaaatggtataataactcatgtgcagttataactcaaacccaggtctgtcttattaaaaaaaaaaactctgctctagactctgctgtgctctctagaataaaagaaatagccctcattcaccaatgaaaaatgaatggttcagagagagtaaatgattttcctccttagtaatataatggccaagttgaagaggctggaaagagaaatgtgttactttaaatgaggaaaagctgaaatgcaaaatcttaaatgacttatgtaactgtaaattaaaatgtaacatctcaggaattttcatttaaaacatatctaaaatgtagtcataccacaaaagaaattttcactgttaattgagtttattaaggatttgtacattgtaccacttcagggcagggacttcatttattagtattttaagtattattaaagagtatgtaaatcaatttaagtagactaagaaacattctaaatatcaagttttatttaattttgtttttcttgttattgttttaaataatgaaatcatttttcacctgttatctctgagggaatttacacacattaaaaaaatcatatataaagtctttctcagctaacaattctgccaaaacaatatgttcagaacatctattcttttttcttttgcttcatttatattgctcaaataccactagtgacctagatgctagaaaggaaagctatgctatgtccttcaatatataatgagggattacaaaatgtaattcactgaaacagaagattataatatctaatacatatgcatttttcttcaaatggatttatgaacactttctccaggacactcctcaaaagacatcatatttccttaatttctttattggtgccggatatcttccacaagtctttttattttttcttctttaagcttaatactttcagacacaaggaaggttaaagttcaaaaaagggacattaattgttttcatggtccacaggtcttactttatatatagcacagttttattgtgaatattctatgcagaattggttaaataaaaatagttattttcatggttttaaaacaaatctaaaaatgcacaattcctttcatgtagacacatttagctctctgatgaaattcctaaaatatgtgaaagtgagatagcatataacctcatcagttcactttcactgctgtgtttacgtcttaataaatgaccaccatccatgaactaatatttccattactttaacacagacaacttcaaattcatcaagatcttatgccttatcaatagaaaacagatgtcctaaaatacaccaataaaattgtttcttttaggcgttctacttaaaactccaactaaatttaatgtgcaataattagaacaataataagttttatgaaattctctgattgtctatatgattaacagaagtataaatcattatcaatagtaaactatatctttaaaggtaagatttattttggtcacctttctgtcagcagtgcctagtacaatgcttcattcacagctgatgtttaatatatttgcttaatgagcagactttaattaaaataaattatgttctctcatcaaagtaaaaccttatcagttcccaaattgaattttaacccctaaactaaaatatttagaccttctgcattgtatggcctcatagatatatcaccaacagcactgtctataaaattatggattcttcaaagtctctcctgtacagcaatgtgaatattatatgtcaatatattatattgacatataatattatatattatattatgtattatattttatatatattatatatattatattatatattatatatattgacatatatattatatatatgacatatatattatatataatattgacatatattatatatatgtcaatatattatattgacatataatattatgtgggattatatataaaagaagttatatatggtacatgtaaatttaaagtatctacatatgattgtctttgttctatttcacagtcagaaacaagactccccaaaattgacaaaataaataaaataagcaatgcgaaatttttaatttaaaaggattataggtaaatgacctactttttagctatttaggatgactgaatagaacttgaaatattcaccatctttacagtttttattggcacattttattggttactatagacacgtaaccatcaaaatgaatataaaaagaaggcttttaagagggtctgtaaaacatacatcaatgataaaaaaggaaaggcatctctgtttctcctaatccataagactactcagagtgactgtgaatcactcagaccaatgtccttagtcccttcagagaaatctaaggcatttaaattattgagtcatgcctcaattacatggtcagtgactcaaaaacatgtttcttattacataaaataaatctttaaaaaaatgagtcaggaaaatggcaagagggaaatgtaacatggaaaagaaaagaagccaagattcctaaaattaaaatttaagaaaaggcatacaagaaagcaagagataaattttcgaaattacttaggaattgtatgtcttaactcattcaataaacattattaaaatctacctctctgctgagacctgtttggtaataaattctgctaggtaacaaagatatacagaactcaatacagcaaacatgcattatctgggcaaagagatatttaatgcaagcaagtaaattaaaatgtcattcgatattaagctaatctaaaatagcacagagaatgagttcccgatcatcctttaagacccagctcaaatgctttctttatgaatccctcctttttctgtgcacatcttttttgtgcaataatcacatattgcttgcattataagtgttttatatcatattacattactggtcaacaaactatgagctgtgagcagagattatattctctgctaagatgatattctctaactaagacagattgatttaggatggcatcagagatttattaggtggctgctcccctatcattttctgcttgtgccacttttgttccccggcaatcaccctaccttttattttcatgctttaaggtcttctaggactgacagagaaagcagtaagataaccaggggaactacaatagccaccaaagcaagccctgggcaaattggcatggctcaaatcccttgcattttcttttttctaccattaaatatgcctctctgctctctccaaacctgaacctacttgggcctgttcaaattattctgtcccatgtggcagaccttgcttatctacaaactaaagtgtctttgggtcccattttctcaagaatctgttttataaaagttccaatctttaaaccaaaaattatagtgcctatttcaatagggaagaataaattacccttatgagctatcacacattcatttttaagggagctttttataaaagctttctatccataaagcaaactctacatatatgaatcaaaaccactgaacagggagcattctttgctggcaaataggtgagaggattaatttacttatgatataataataacatatgaaataataatatatcattacttaacaataataaaacgtaccacctttggctacacacaatcagacactctaggcaccttatttacattacttcattctattcacacaataatctttgtgagaatagggtatgtggatgttcttgtctctatgatacatatgtatatattatgacaaagagaaggtaaatactttttccaggattactcagctggtacaagaaagatcaagatttgatcttggatccaccagaccccgaaataaaatctctttttcaaaaatttccctaaaaatgttgctgtggcagattctgttggtcatatattaaaaatagttctttttgtctacatttcctagcttcctttgcagtaaggtgtgaacatgtgcctgagtactaggccaatgaaatagtaaaagaagtcatttgttccacttctaggccagatgcaaaaatgcctcccatttcccctctgccagttggagactgttaagtaaggcaaccttgaaagtcaaatgctaaatatggcaaaatttctattagtctgagttgttgaatgactatgtggtatagaatccacttgcataccctttacctctaatgccactggatctgccttaaactagtgaatgattaaaatattattttctattgtgcttgagtccttatacatttttaaattctatttgttacagcatctagcccaccctaactaaaatggtctcatgtacaaatgtagtctgaaaggacttccctgaggaaataaactctaggctaaattatactcatgactatgttttccaaagtttggataatttaaaataataaaagaaattcatttaatattttaaatgtggcatcaaaaatattaaatttacaatgagaaaattattttgagttaatattataatggtactgtcgctaatataatgttaatctattgcctaggaattattaaccattttgtcaacatgaaaattcaagtaaataaggcctcagatataataataaaactggaccaccatcttgaccatttatattttcctgttatcattctatcaatattcatttttaaaatgtgcattttagaaacataatttaatttatagaccattaatattcattttgaattagagatcagaaaagatgtttactaccccttcactacttatgttaaatattttcttccacgtgcttccatgtgcttatttcatgtgtttccataattttctctatacttaccttgtttagtgtctcattcaagcactagaaaatttataaaatgaagtattttgattgtgaaagccctgtaacatgaatgaagacatagagaaaactgaattgaaaaaatattcaaagcaactttaggaaatgacgctgcatttggaaatacagtttagtaacgtaataatcattgtcatagtcatattttgactttgggatacactgacctgaaggagaagaattggatcaaatctaagttaagatcaagtggccttaaacgtcaacttccagatccaagtagtgattatcaataagcataatatgaatacattagtaaaacataaaactttcacaggtttgctgccaaattttaaacaatatctaaaagtcactattcttaacaactgagtatccatactgaaatggcagtgtctgctatatatatgtgtatatacatattcttgagttatctaatgcagtatagagtaggattctttggtctcctccttaattgatatgttatctactaaaaagtcaaggtagaatcctcgcattattcttaattttttatcagattttgaataatacttcaaatggtgattatctttgtggaggagaggagagaaaggcaggtgaaagaatagggaggaacataaagctttatatattataataatattttacaattggctgtgagcttataagcattgattatattatcaaataaataaataaatataaaagaaaatagaggtgtgtcacgtaaaggatactgatactgaatcatgatgatgaattcacctgttgacctaatgtcctaaaataaaaaagaattaagcctatgctaaggaaagagcatacctttatgcttaccgctatgtgttagcatctttggcttgggagtattaatgacaggacagaatagcaaacagttacactcttttttttttttttttttttttttgagatggagtctcgctctgtcaccaatctggagtgcagtggcacaatctcacctcactgcaacctctgcctcccaggttcaagcaattctcctgcctcagcatcctgagtagctgggactacagacatgtgccaccacatccagctaatttttgtattttattagagacggggtttcaccatgttggccaggatggtctcgatctcttgacctcgtgatctgcctgcctcggcctcccaaagtgatgggattacaggtgtgagcgaccacgcccagccagctatacttttttacacagcatgaagatcaacccagtggataactactgaatcttttagagatactacgagagtcttatataggagtggtgattgtgtgttaattataactgatggttttatgtgctttaggatgtttttaatacttttaagatattctgccaaaaattctgatttttaagcgtgtgctcaaatagaaacagttgggaaactacttgtctggaaaacattgaaaagaatgaaatattttagcaatattctcctttaaaatgctttaatgaactccagaggagtccttataagatctgggacaaaggtatattttgctggagtctattagcacattccagcccaaaattcagaatgaatccagagatgatcctctacagttacttaagcttctcaaagctttttaaaagcctaacttaagaagccatatagttcagtgattctaatgctagattgtctgaattcaaacccaagtttagccactcactaactctctggccagagcaagataccaacattctctctggtttggtttcctcctctgaaaaagggggataatcaagatacctatgatatagaattactgtgagatttaagttaatataaagttcttagaatttaatgccccagatatagtaagaaccccgagatattagctattattacccttacagaaatttcatggcctacagagatctccaaaaaaggggtttcaattattttaatgtggcagatatttagatgggactggttcacaatacctacttaagccatagcagacccaaaccaattattctaatatgtattatattttttacttaatgacatgagtagtttttttgaattatttcttaaaagaagttctttaaacatctctaattgtgatttttactcctcaatccacagaggaagataaagtttaagaatttcttcaaagttttcatcataataacctcctacattttaaacaaataagaatgtgtctgtacataaaaacaaaaaataaaatcattctgatgtataatctgattgttttcaaagaacaataaatgtatattattccattttaatgactgtatattaatcaattggtattgtatatttatgtaaccatttaatcccatattttagatattttaaataatctttaccatacttcttctattgttaaaaaacatataaatgtcttatttttccagatgtcagaatattgtcctgtaatatagttataaaatatcagaatggccttttaaaatacatattgctaggcaggccatggtggttcatgcctgtaatctcagcactttgagagactgaggcgggaggatcacttgagcccaggagtttgagaccagcctgggcaacatggtgaaacccactctctacaaaaaatacaaaacagccaggcatggtggcacgctcctgcagtcccagctactcaagaggctgaggcgagagtatcagttgagccttagaggtcaaggctacagtgagccatgatcttgacactgcactcagcctgggtgacagagcaagcccctgtcaaaagacagaaaagaaagaaaaaaaggaaggaaggaaggaaggggggaaggggggaagggagggagggaggttgcaactttgtcttccaaatcaatgggattttacaaggttgcattcataccttgttattacactcctctctttcctatatcttaacaacatgatttttaaattctgccaagcttatggtcaaagattatagaaaagtgttaattctatgtggatatatttgactaaatatgaacatttctcacattttcaattgtttgttgtttttatattgtgttcatttttctatcagggcatctatttatcttagttcctggaaaggttgtaatctattaaggatattgatcaattgtcaaatgtatcaactaatgtttccagacttattttaatattgtttataatatctatagtgttgttttaaaatgggagaaactgataactctttacttgccaaaattaggaatatgaaacatcatacggccatttcaaaagtgtcatttttgagaaatgttacatgaaaaggaaaaatgtgaatagtgataatatctgaaaagaataatcaggaaataaactcatatatatataaattaatgatcactgaaatataacctgatacatatatatgtgtgtgtgtgtgtgtgtgtatatatatacacatatatatatacacacatatatatgtattataacctcaaagttggaaaagagaatgtatatttaaggcagtaaagctatatagtaaaatattcattatctctgggtaatggggttatgggtgtttgttttgttgtcttctctttattcttttctctggagcacatatatgtggtttttaaaatcaggaaaatgtattagtaaaaccaaactttattcagtgacagcttgaaccaaatatccaacataagaaaagctgatgtcacttaaagatttccacacttctctgaaaacataataaaattttatggctatacaagatcaatagttcatcctaacaaacacgctcatccaaaatgccaacatgatcattgtaatgttaattaaattttattgtcacaataagttaagaatggcaagactgcaggctgagatgttgacttaaagatggagctaaatgttttattgctagatttgcttatagacagagctaattacttaaattacatttacatgtttttgttactaaaacaattgtatttgtaaaagacagtgcatttaaaagaaggataattttacatgcctctacaatttgatcaagttatgacaataattcatgaaagcatttaatgaggaatctcatcttaaaaaaaaagtgattacaccaactcattgattcttattcaagatttttcaaggcttaaaagaccaaagcagatagcatattaatttattagtgtaaaaatatgttttctgaaaacaacttctatttcaagatatgtctgaaaatatattgttcattctatttattttattattattatttttgatacggagtctcgctctgttgcccaggttggagtgcagtggcgtgatcttggctgactgcaacctctgcctcctgggttcaagcgattctcttacctcagcctcccaattagctggactaaagatgcccaccaccacgcctgactaatttttgtatttttagtagagacagggtttcaccatgttggccagactgatctcaaacttctgacctcaaatgatctgcccaccttggcctcagaaagtgctgggattataggtgcgagccactgcacctggcccatattgttcattctaaacattctatattaagatctatattatttaccaatcctacctatagaaagaaatgatatgaggcaaatattttcagacatatcttgaaattaaaatggtttaattattattgttctacagtccaactgatacaaaagtattaaggggttatttactttaacatttgtttatgatgaaatgtgattctgcacaatggtgatcactcagattttgtcaatctattcaccttcaatctaagggctgctattaataagtcatgcctcccctgatatatattttatatatacatatatatatatatatatatatatatatatatatatatattgggcgtggtgtcttatgcctgtaatcccagcactttgggaggtcgaggtgggtggatcacctgaggtcaggagttcgagtccaccctggccaacattgtgaaaccccgtctctactaaaaatacaaaaaaaaaaaaaaaattagcctgctggcatggtggcatgtgcctgtagtcccagctgctcaggaggctgaggcaggagaattacttcaatccaggaggtggaggttgcagtgagccgagatcgtgccactgcactccagcctggtgacagagcaagattctgtctcaaaaacaaaaacaaaaacaaacaaacaaaaaacgagcacagtatagtatatgaacatcatgacaaaagttcagagtgctttgagagtctatgggggcggagaaaaactttaatgaaatcaaatgatatgttaggcaggctgaaaggactgtgaaccaggaaggggaagtgccatgagaaaacctggaaaaagcgaagctagaagttatagtgaaggaaaagtggcaagatgtgtggttagaaagatgacaaaaccctcagtctgtgccagagtttggactttataccaaggacaataggaaacctttgaaagattgtaagtagagaagggacatgattacttttgcatttcaaaacactcttgctggagtggggaagaggatttggaagggaacaggccaagaggctactgcagttatgctgtggcctaatggggaggtggtgaagcacctagggcctagctgacctggggagacatttagtaagaatcaataggacttagtgaataactgaccatgacagtgaaagacaggaggtgtcaagattgacagactgccaggcttggagccccatatctttatttttatagaatacaaataacttcaaatcagtgatcactaaaatttaacctgatacctaaaagagttctcttgataaaatcttatatagttcccttttagtcagcaaagacaaatagtttagatagatcatcaaaattttacattgaatagatttttcttattatgtattttagtatacattaacaaaactatgggatttggtctctgaaactgaagctattgaggagagcaatattgagcaaagagaaatgaaattttataaatccactttttctgattatctgtgtaagaacaagatattttcaactgaccattatttgaacaataatttacccactctgtctctgaactttaataaaaagatataactcttgaaagataaactggctacttgggtctggggcaacaattttttgttaaaactcttagcaaactcttctcaaaattaattaatatttgcatgtatatagtacaacctaaaagagcacctctcatattagtagctcaataaatgctagctgaatctgaagtaaattgctagagaatgctatgttttggttcataacgatacagcacttaatgccaattttaagttaggtataaaagagtgttcatacggtaagcattagccttaaaaattaatcatggactttattatttacccaatgtctgtgtattcatttctgctttcactagtcagaacacatggatccagcattagacatggatcccagtcacagttttaccattaggccattattagctctgcagtcttgaacgagacttaactagcaatgtagtcagaatttcttcatttgtaaaataccatgacttccttacagagttattgtgaagatcaagtaagataatatatatgaaaagataaaacccaatataaatagaagattagcttacttcatgactggcctctaaataaatgttttgattagatatgccttctctacaaaagctggtttgaaagctcatattgatttgaaatacaagtgctttgaaaaagtttttatatttgttaatatatttacactactaaaacagatctgcacaatatgtggtataacagtttttgcaagtgtaccaagaaatgactgaacatacaccaaaataaataaatgaaataagcttagcttatgaagtatttataataataaatgttctcatttcagagaagaaattaaccattatgtttattaaacatgatgataaaattataatcttatttttgtacatggattgcgttattatataattttttttattctccttggcaatctattactgtggtttagagtatagagtaaggctctcagtaaaactaaaaggccacaaacataattattgaaaactcgggatgccattacatacctatcagaatgggtaaaataaaacaacagtgacaccaaatactgacagggatgtagagtgactggaacaaacatatattactactgggaatataaaatagcatggctactctggaaaatagtttgaggtttctcatatttttatatacaatctattaattgtattctcggccatttattcctcagttatgaaaacttacatttacacaaaaccctttgtactaaagttcacagcaactttatttgtaatagtcagaaactgaaatcagccccaatattctttaacaggtgaatggtttaataaacagtggtgcatacacacttcagaaaactcagcataaaaaaggaatgtgttgttacacatataacctggaatgaaactccagaggctttatgctgagtgaaaaaaagtcaatctcaaagattccatactttattatctatttatataaaatgttttatatgataaaatttcagaaatggaggacagattagtgattgccacaggttagggattgggcgggctttggaggaatgtggatgtggttataaaaggtgaataaatcgatcctttcagtatcctgacggtggtggtgaacacaagagcctacccaggtgataaaaccatgtagaacttatacacacacgagttcaaagaaaacttgagaaacctgaataagaccagtagatggtgtcaatgtcaactttttgattataatattatactatagttttgtaaaatgtgactactgtgttaactgagcaaaatgtacaagggcttctgtgtattatttattacaactgcatgtgaatctgcaattatctcttaaaatgttcaattaaaagtcagtaatttgcataagtggtattaaaaaaacaactgcatgtgtataaatacaggggtttgtaaattaataaactctaaagccttatttttgttttattttgtacaaaaagaaataaaaacatttttatatagttttatcaataaatatcataccaaaaataattaatgaaacacagctcattagtttttcttcatgatatattttgtttcattcaacttttacgtgataccagcatatgtactttgttataattgtttcccatatgcaaataaatgtcagggttggaagacctgttgtttattcagttcagaaataagactaattatatctactaattagtcatttattggctttgtaaaacaattattttataaacagttataattaaattatctcaagaaattcaaatttcaaaacagaacattggtgaacttggtttttattactgtagttagtaaaacagatcaaatagattttgcgaaggccttagaaagttcaaaaaaaattgttaaatgtacttcttttctcctaggtttcatttctctggctgcaaaaagtaaatattttaatgaaagtgtcctgcttggatcctcggaaattttgggagatttctcgatttaaaagcaaatgcagctactacgaaaagcagtataaggttcttcaaacaattaaaaatagaactacataccagcagtctcactgctgcatatcaatccaaaagaattataatcagaatctcagagagatatttgtactcccatattcattgtagcactatttacaatatccaagatatgaaaacaacctaaatatacgttgccaagtaaaatgtgtcatatacataaactggaatattattcaaccttaaaaaagaagtaaatcctgcaatatgtgacaagaatgaacattgaggacattataccaagttaaataagccagtcatagaaaaacaaatactgcgtgggacaatttatatgagatactaaagtaatgaaattcatagaagcacagagtagaatggtgactgccagggactaggggcttggggaaatgggaagttgctaatcgacaggtacaaagtttcatttatggaagatgaataaattctaaagttaataataatgtattatgcacttaaaaacctcttgaggatacatctcatgttgtgttcttactacaataaaataaaataaaccaaattttaacttgagttctctctcacatcttctttaggcaggcctgctagccataacttctctgatacttgctcctgacatcttcctgaagtttaagaaggcaggtaaaggcattgtagactgaacgtttcagatggcttcaaactacttaataagagccatcatttttaagtaaccccctaaataacaggttttagagtctgattagttgagatgcaaagtttattcacacgagccatgagggaagagagaaaagcagaatcctaaagtggaagtgaaaactataatacaccctcagttccagcagaagctcaaagatagtaaatcttgccacaagtcaatggccaagtcaagactagaattactttctcaagtcatcctttttcctcctctttcttcaatactcaataaactacttatttttcaaaacttagatcaaattctgttaatcccacctggaccccaggcagaagtaatcactcttcccgttgttcccacagtgtccctcattattgattcactcatttatccatctgttctttgattcaacaaatatttttgagcaatgactatgtgcccaacacctagtgccaagaaaaaaacctctgtccttatgacactggtagtagtaaaagggaaaacagataataagtttttaaaaagtaaaatacagaacatgtgagttatggcatgttagaggatgacaagtaaaagaaaatcagcagggcaaacagctggaaagtgtgcatttgttgtagggggatttttttaacttttattttaggttcaggggtacatgtgaaggtttgttacataagtcaactcgtgtcacagaggtttgcagtacagattatttcagcacccaggtgttaagcccagtacctaatagttatcttttctactcctctccctcctcccactctccactctcaagtagtccccagtatctcttgttccccttctttgtgctcacgagttctcatcatttagctcccacttataagtgaaaacatgtggtatttggctttctgttcctacattagtttgctaagtataatagcctccagctccatccatgtccccacaaaatacatgatctcattcttttttatggctgcataatattccttggtatatatgtaccacattttctttatccagtctatcattaattggcatttaggttgattccatgtctttgcaaagtatgcatctgacaaaggttaaatatccagcatccgtaaggaacttaaatttacaagggaaaaacaaatccattaaaaattgggcaaaggacatgaacagacacttttcaaaagaagacatacatgcggccaacaagcatatgaaaaaaaatttgatatcacttattatcagagaaatgcaaatcaaaccacaatgagataccatctcacaccagtcagaatggctgttattaaaaagtaaaaataacagaggccggtgaggttgcagagaaaagggaacacttatataccgttagcaggtgtgtaaactagttcaactatgtggaaagcagtacagtgattcctcagagaactaaaggcagaactaccattggactcagcaatcccattactgggtatatactcagaggaatttaaatcattctaccataaagacacatgcacacgaatgttcatggcagctttgtgcatttggagatgaatacagttctaaataggacagcctggaaaggcctcagtagaaagaataacacttcataaaagatctgaaagaggtgaggatatattttcacaattaatcatgcacatctgtttcccttagatcttcaaagttacgaacatacttcaattatttttgtatgctggctcctagggagcagccacacttagtaagtacataatgttggatgaaatatctcaggtttctgaacttaaatttcagttgtctttcaactacacaaggctttgtacttcagaaaattgatgaatttgaatacaacactgatgtaaatcaacagcacaactagaacttctacactctcgctgctcaacaacttaatttaataggggtatgattttctaaatgttgtagcccaacacatgcaggaaacatgaagaaaactgaatcctaagaatatcgagggacaagcccaaaaccatacacagtgtgaactaataaacctcctaaacctacatttcacaacatgaaaaataatgaagtgctaagtaatacatttgatcaatttttgtctctatttctgattttattcccatagtatggccaattttatattcagcactactaccatcaccaataggagcctgagaagtttcatgcacgttgtacctgtgtacctgtgactataggctaagtttaagacatgtgtgcctccaaatacctgccagcagtgataccttatgtcctagtacatcgaaatacaaagaagaactccttgagagtctaaaggagactacaaaaatcggttcactttggacagataatatgaccacagatctagaactagtatgaccactcagtctgggatgatgaaatggccaatttcttggtataaaatgagaacagcacacatggctgaaagccatattagaggcaaaattactactacttatgtgctgttacaaattgcagataaaagatgattacacatattatagttatctagttttcattataaggactaaatgatttaagattacagaaaagccagactgaatgaagagtaaaggacgggtacattaatgaaacattcgcctttgttgctcactgttaaaaacctctcagagactcatcgttgactgggaactgactctggttgtcatttgggataatgtatttgtgagtcaatagattaatggttcaaaaataccaatacttgcattatgagtccttcagtgattctccattaccatcaagaaaaagcccaaaccccttagtacaagatacaaatgtcttcatgaggtgactctcctcttcctctccacacattccacacccttccattcttaggtctctgaacatgccatgctttcaacacctacttcagtctctttgcacatactcttctctctgcacaaatcctttctccctcacctcccaacagggtgaattcccttaaaatagcttaagtgttatcttcatttggaagcctttcccgaaccccactgcccatattccctatgttaggtatctcttccccttctaaatatgactgttaagcttatcacacaatattaaaagattatatacataacatatattatatataaatatacattatctatatgatataacacatataaatacatatatgtatgtatgttgccttcactggatcaaaacttctgagcaagttttattcatgctttaataagcaatactatagaattgaatacctgaaagtaaaaataaaatagtggtaactaatatttattgagtgcttaataactgtcagacacccttctgaggctttaattcatttattgtcataacaatctaatcaatacataactaacattattcctattttacagataaagaaactgaggcggggtacgtttagtaaaccgtctaaggttacaaagctagtaaatgacaaagccagggtttgatcccaagcactctgacttcaaaatgcatgttcttcaccactgtactacagctacttcatatgtatatatatgtatttaagtgtttttaagtaaataagtaggcatatatataaaattcaagagtatgtgtaatatatatatgtatatatgcatttacttgggtatatacatgaaaaacattggcttttaagaatgaactctaaacagcagtacaaagttacttcaatgaattagaagttttgacaaaagaccatctgctgtcctagaaattgtcttcttttccactgacatattatactattctagttaataatttataaaacataatatcaatgcacatagactttaaatgcattaagtagatatgctttgtattgagaatatgcacttattatgtactactaggtagcttagtaaaaatttgaaaatttaggtataaggtaatcattacaagattagttctgcaaagtactttcgcatgtatagacaattactgaataagtgttttattcaggagaataaaaatctatatttataaatatattaaaatatttgtttctcagtaacattttatttttatttatttttatttatttatttttaagttctgaggtacatgtgcaagatgtgcaggtttgttacataggtaaatgtgtgccatggtggtttgctgcacctatcaaaccatcacctaggtattaagcccagcatgcattagctcttttctctaatgctctcccctatccccaccctcccccaataggtcccagtgtgtgttgttcccctccctgtgtccatgtgttctcattgttcagctcccacttataagcgagaacatgcggtgtttggttttctgttcctacgttaagtttcctgaggataatggctattattttatactccaaaattttaaattcaacatttgtaatacaatgggttcccaaacattgccatatactggaatcacctgaggatcttttaaaaatcctgattcctgaggccaggcatggggccacatgcctgtagtcgcagctacttgggaggctgagtcaggagtatcccttgagcccaggagttcaaagctgtagtgaactatgatcgcacctgtgaatagccactgcactctagcctggacgatacagtgagacttcatctcttacaaaaaagaaaatactgatgctgacaccaccaccgccctcttaaccagacattctgatttaattaatgatgggctgagtcatgaatattaggattttttcaaagcttcccagatgattccagtatgcagcacagattgggaaccagaattttactaaactttccctaaattcactctgaagtttacaggaatttcttctattatgacatttaaaagcaatcctgacaaaaacattatttcaagtgatcagcagcagcaatgccagaaatccacatgtagtttctcatatcagctatatcacctggctactacattcttcaaatagaattcctttcctcttggctaattctctttacagataatacaaatcatttctttactaaatcatttattcaagaacacagacaaattcacaacctaatcaccaaacttaattaggcagaattttacttcattttaattaagtatccattttcatgtgcttgaaacagaaatgaatatagcttggacagggaacaggttatttataaaaagggagatttaaatgagggtaaaaatacatggaaagacacaccttgcacacccttctctacctacttgtccattttaatccctgtttataatcttaggtatcggctcaatttaaaagcagtaaataagtaatactaatgtttatgctgatgtggagatatggagatgtggagattttatatgagaagtcttcaatgttttaaagtccttgagatttgtgggttattttttattgcagtgtaatctacccaatctttaaattctatatgtaagtatgattgtatatgtaaatataatatctatttcagaaaaaatacatcacatgtgtaagtgaattttttagattaagaattggcatgtcctactttattcaaagtgcatgttctttacaatgtttgtaaaactatatgcaaggtaaaacagtgatgtctggtctatctataatgcatgatgatcaaagagttttgtttatcacatactcatgctgagaattcattaagcactttcactattaaatttgcagaatgagttgttgtctccactttactgacaccatgagtcacattcatcagtctccaacaggatgataaaagactgaatgattcaatgaaaatgttgatcattatggttcagttataacaaatgtgtgactaaatctgtactctcataatacatcacatcaaacagaaattttagggtggaatggttcttcaggctaaatagtgaagcactttgaaatctaaattcgtgtattctagttattaacataaactctgaaataaatccaggcttcatcttcagaaaacaataaatctaaaaaataaactcaaagattgttagatattaaagaaactgcctggattaaaaaaaatagaaataacagtgtttctctttaatcatctgtattttgaagtattttaaagatagaagtgacacattttatacagctatacaatgtaatcaccaaaagactatattgggatgactttttattaagaaatgtatgatacctgttactgtcatttatggtgacaactctgtaatgtatttattgctatgtttatttgtgttagtgtgagttagagagtaaagaacaatagtaaacatattctagtgcacaaaataatataagtgaaatttcattacgtacaaatcatcacaaataagttgttttatttttgtaaagaaactatcattctgaagacaaatttaagctaaaatatatggaacatatgtatgtataaatatggatttcttttcaggaaatcatacgttttagtgtctcatttaagttttctgtgtagtttggaaaatcctgaacggcattaaatatttgtttttaaattatgcataaggtttatctacagcatgaaatgcatgtgtgttctcactgaataatattctcctctcattttctcatctaagtctaagactaacttaaggcaacaattttgtgaatgtttttcaaataataaaacagtggtatatattcgcttaaaaacaaaaacatgaaatataaatatgtattataaatagttatattacttcccccttcatacttgtttcatttaagattatttaaaatgctggtgaattaaactgcttttgtattgactattcaccatgtaagactctaacatgtacacaaacacacacatctatttttatgtacacatattcagatagtttctcaaagattatttactgttaatttgtagcctcaaaataatgaactacagctacactttttgatatatgactttttaaaaactaggtaagcaaaaggtttacaattctatttacacaatttatatttagataaattaaaacatttcagtcttaaaggtataatgttaaaaaattaattttaagtaaaatggcttaaactatttcattgtagtaaaataaacacagctcaagttgaagtaatacaatgtctaaataactagaaaacaaacaaaaatatcattatttatattttaaaaataaattaattgatcagatatggagaattctgcacttatacctactctgttggtttcaaagttacatttttcagtgccataaccacgaaacaggctacaagcagtccttaaatgcctcttatcaacttcagctacatcatcttaataacttttttctacccagagacctcctataagttttagaaattcccattatatttgtaaaacctaacctaaagttagaaaaaatattttaacatataaggagactacatcaaaataatcaatacacgtagataaatatttatggtgatatctattctgatgaacaaacactgctaccaggaaggggatgtgacagcttttctccctccctagaatatgcgtctacctcttctccctcagcttgccaatgccaatttttaaaatcctctgattttggatcatagaggaatagaaaagttacttgattggtgaggatctcgtgttggagctctcagaactaaacacttgtttaaagtgattcttctcccctaggtagttttgtgatctctgtggggaagtcaacagtctctctctcccttgcacctttggttgagatatttcttcctgaagttcccctgacaagggtgaatgcagcagtcttacttagtccctaattatagtatctgctatactatactatactatgctatactatattataaagtcacttagaccctccagaccatcctcttagacaggacccaagataacaccatgccagttccttcctgtagcccacatctggtctatgggaaagacttcttcttcttcttagatcaactctgggagttcaacacagtttttctccaaaataaaggcaattagttagcttctttctcacatatcagtccaccatatcctgcaaaccctctctttaattttcttaaagacatactcatggaaagaatcatgcccacacccattcccttcttgagggtgtgagaatagaaatcaaagcttacaagaatctcacttcataaatcttaaatctccccctccattttggtaaagtatttaccaactttggtaaactattttgttctctctgtgatatggtttggatctgtgtccccaccaaatctcatgttgaaaggtaatttcctgtgttggaggtggggcctgatggcaggtgtttggataaggacggtgtttccctcatgaatggcttaatgccctccctttggtaatgagtgagttctctcaagatcctaaagtatgtggtacctccccacgactccttctcttttgctcctgctctggccatatgacgtgcctattcctgcttcaccctccgccatgagtaaaagctccctgaggcctctccagaagctgagcagatgccagtgctatgcttatacagcctgcagaactgtgaaccaattaaacctcttttctttataaatttcccagtctcaggtattccttcacagtaactcaagaacagcctaacaccaacatatcttggtttgttatttcaagtcaagcatgatagccttgtaccttggaatgaatttcctgttgtctttagatctcagctgagacttccattctaaattactcaattatatataaaatttgaagtgaggacactcttgtctcacaaagtagattaaatgcatttgtgtacaatgttagcatatttaaaaacaaattataacatattcattcactaattacccaagtttgctaatctacatcagcctgatgaacagaataattccctctgtattggtttgtgatatgtagagtattttttttctttttgttttttttgtttgtttgtttttttgagacagagtctcgttctgtcacccagactggagtgcagtggtgcgatctcggctcactgcaacctctgcctcctaggatcacgcaattctcctgcctcagcctcctgagtagctgggattacaggcacacaccaccatgcgtggctaatttttttttttttttttttttttttgtatttttcgtagagacggggtttcactatgttggccagactggtctcgaactcctgacctcgtgatccgcccgactcggcctcccaaagtgctgggattacaggcacgagccaccccgcccagcctatgtagagtatttttacagtgctttactgtaggcaaagtccttgtacttctactctcttatttacttgtgagtgatttcaaatcagtgaaaaagctaaatagccacatatacacctggctatatcattaaaataacacagaatgttaaaatttctcctctgttatatttcatttatttaattggataagccatttttaaccaagtttaatttaattatggtgatcataattaatagtgattggaagaatacaactgtaaaacagttctatggtttgtataccttatttgtcttatatgtgttaatagaaaacatctcagtaatttcaaaactagtaatacgatatgggaacagtatgttatagcagaaagggccctgggcttgaaatcattattcagttcatgtttgtattcctacttctcttataatttggactatttaataggtattatcaaaattattttaaaaagtatttatttttatatgacatgtacacacacatgtgcattataaaaagccacacaatacttcaattatcttccactgatgatatattatctatagtgattgttacagaaaaataaatcttcaaaatgataaaacaagagtacagcctactcaagtcatagctatagaaatcaggtatatttacttaatcttcagattctcagttttattcatctgtgaaatagtgataaaatgctggtttacaactttccagagttattgggatctcatgagttgacagtaaattgccccattaagtggtacatatataaagtggttatactgaactcttaaacatgcacacatgcacacaaacaaaaatattcaaaaacaactttgcatatctcatgggaattcatctctgaaaatacctgactgctattaaaaatcttttaaatttcaatagttacatgccttaccactaaatagcaccacttagagtactttatatagaggaatgttttgtaaaacttctcaattggcagattcattgctctattagtgaaaggctacaaaatttatgttttcattctatattcttttaactaaggacttttaaaaatcaaaatgatttaatatttgcaatttagcagcctgaatgcctttagtcggaagaggtgtcttgcgtaccagaagttcatctacaatttgaaaggtgatctttctctaagaattctgaaatgctgtaataactttatatggctctgaactgtttcattctaaaatctcagggcttttctaatgtgacaggcttaacgaaattccaaggctccaatcttagtattttaagctaaattgataaattggacccttaactttaaaatttctaatcctaataaaaatatgaggtttagcaattccttcctggtcctgcaatatgcagaaattataaatgagtacagactttctttatttcctagctttctttctgtttcatatgaatctaaactagaaagcatattgaatcgatttaaactggaacccacagaaagaagctggctaaagacatggaggctaactcacagtctgtgaccagactggtttgtctaatgatgtagttgttgtcacaataaatggctacacgcacagatttctgtctggttagacatttggcttgaaataaacattcagagaattgaatccagacatcgactttaaggccaaaagttgccttaaactctgccaacctgatgctaattcaactaggagtaacatgcttttttgtttgtaacaaatgagtccttgaatctattaaactgaaactgatgatgatttcagaaacatgtttgatgaggtcataatctcattgcagtaggtctggaacctaattttcttgtcaaacgtcacttacgtactttggtatcctagaagtgaaaggaatgatccaagaactgggaaaggaaatactttgggtctgtaatttgatttataaaaaaggcctgtttaaccacttactttgtgaatgcctgttttacaagtttagagattattccttgtctgaaattagctctactccaccatcctaaagccttaagaaaagcagatactattagattagatacttagaaaagaaaatactattaatgaaaaatagtagtgtaactaaaaataatttaaatagggctctgtttgtgtgtgtcacttattttggcatgctgtatacctgtatttgcagatcttttattcaatacagttaaaggaaatagcatttagaaatcattggaaaatattagtaaataaagaacgtgacacataaagttctttggatggaagaaaaatatgctaaacaagagacttttccaaattacttgaagactaaaaggacatatatgtataaccaagaataaatgtatttatttagaagacattgatatactataatattttatgacaaaataaagagaaaatactgagttaaatatgaaaatgagtgtctagttaaatatcaccacaatattttcttaactgagtttctaatgctatttataattctcctctttaaaataatttacaaagtgctagttttctgtgttgatatccaaatgtggaatgactttttatttggaacatccaacgaatagaaagttttatttttccattcaaattatgatatcattcatgggtccagggcaagctacaaaatttgtggaactgagtgcaaaataaaaacatgaagccccttatttcttgaactaagaatttcaagacagcagcaacaaagcacgaatctcttcttaacacaggggcctgtgtaattacatacccacaaagctagccatgaatgggaccatcaacaaaactttctattgactcgcatttgtattgctagtgtgattgaagagacatgagaggtagttactaaagcatctttctgtacaaactaaatcaacggaaagttaccctccaaatgagtccacccatacctatttatctgccatatccaaatgaacaagctgttgaaaacatggcagcaagggcaaaaagtagaggaattaagatacacatcaagccctgcagcttcctgcctttgatagaaatgtacaatagtgtactgtttgcaacatcctttcattcctctgctagagagttctggctcacacccactggagccttgtgaaaagatgcaacccgtacttaggaaaggggtcagacatgtttgttcattttcaatatcttttctttttatattaaaaaaatagaataaagatctataaacctgaattaaaactcttgagtttcaaactgcctcgttcttaaatcttcaacctcacataatatattcgtataaaatacaaataaagcccttaagaccatgacaagattaatttaactcatatatattaatttcatgaaacaccaagttcaacccttacatcattattagcactgcagtacattactgacatatatatgtagtctggggtcacttcagaaattggcaaaggaaattactcccttaatgcagtctacaggcacacctcagtaacaatgacacctttatctttcacttattggcaagttttattcagtgtttcaaagcttgactaatccacaagataacatcagcatatttaaatccttaatctgatcaaatccaactttatttggtaaataaggatgattttcacttcctttcatccaaactctcatgataagggctttgataagatagtatcataaattactttcctacagggaatatgtttctaagaaaaagtatactacctaaaggagagggaaaatggatttatactttaaaagaaattttgaaaaattagcgttcaagatagaaagatcaagagatgggttttatcttcctaagttttgaactacatactatcagtccaatttgaaagctcattttagttttacctcgtacatcatcagttaaagcaaatggtagataaatatttattttgtaatttattttatacttcttagtcataagtatttgtggcagatgaagcaatatctatcagtttcttaaaagaaaaacaagtcaagattgtccacttcttcacttatactgtcttaaattaacaagaactaaatagtgatcagaaagagaaaaagtaactacacattgagtattcctaatccaaaaatctaaaatctgaaatgttacaacatccaaatttttttgagcgctgacattacactaataacaaatgcccattaaagcatttcagtctttggactttcagattaggtatggcaaaccactaaaattgtctactgactcatttttaccaaaaaatcccaaatctaaaacacatcttgtcccaagcattttggataagggatattcaacctgtaatgtcagtctgaagcataacaattagcttatgcagccaaggctaagctatattagaatcgtaatagttctcaatgaaaactatgagctcctcagtatctttgaaacctgataaactactttatcaattagtacctatgtactataacagatccttcataagaaataatttgctttaatgacacagaaataagttacactttaaatcagtattccttttcagctaactattaatatttgtattctctcaatattcatatactgaagctctaactcccatgggatagtattaagagatggggccttttagaaataattaggtttagatgcagtcataagggtgaagctctcatgatgaaattaatgcctttataaaaagagaaagaggcaccagagcttccctgtaaggatacaacaaaaaggcagccatcagcaagtcaggaagaaggcccttacaaataactgaatctattaacatcttggtcttggactttccagtcttctgaactgtgagaaataactgtattgttagccattcggtctatggtattttgatacagcagcctgagcagaccaagacagtactccagagaaaatttagaaagtatgctgacaaattcccaccatattaatactaagtaaaaatatcaatggtatatgaagaaatacttattaatattgtaaaatccagttcttggtaatttccagtctaattcacttagttaataacattttctagtgttttccatattcagcaagtacaatataatgcctaaatatatcctttagagtagtttaaggagtattgcttagagtaatccaaaattgtgtgttctccacctgctaagagtctaaattttcacactagttttattgtaattttcaatcaatagagtctgccttgctaaaataaaataaaataaaataaacatatatatatatatgtatatttgaagtccataaaataaaatgctttagttcccttgaatcataagaaccattataaaaacaaaaaaaattaaggaaagaaattaaatacactttttgaaaatgctaatttactaacttgagaaatgcttcttaacaaaagtaattgtgcctccctagattgtcaattaaataactataattagaaaaattttcctctttaaaaggcataaatgatttaccacaaaatcttcataataacaaattttaaacactagattttaatgtaaggcaagatgtatctggaaaataggtgtttctgaagtgttttaaccattcattagatcccattgacatggtcctacagagttcattttactataattaagtttattaaatactgaatttcaatgcaaacatgaaagcttcaaagaagcagagcatttaagctttccttaaaatgtattttcatacgtgtgaaaagagccataccctatactctgcctgtactttattcatattcgcacagtatttgctaacttcttactatgtatacagtactcttccttcattttttttttttaacatttcagttaagggcacattcaaaattcactctgtttctacccccaaattgctatagaaaaactgttgaactgaacgttcaaaattagtgtttttcagaccagacagataatgtggttttcaagtcaatctacgaatgacactacatgctgtaacatgtaatcactagatttggaagtgggaggcaaagagttgcctgcatttgaaagtagtgaagacaaacatattaaataggaaaatttgcagacatccattaaattgtgtatgtatgtgggttccaatagactgacattttcagaatcatactaaacatggaaataagccaaaacaaaagagagggatttgactttgaatgattcttcatcctaaattagacatactacctgtgttaagatactatgtatgtgtgtgtttgtatacatatacatataaatgtatatgcatatatttgcctttaatgcatattataatatgccctgttttcaagagttcaatgtcattaatgtagtaatttaattgattcacttattatttttacaatatttcatttaataatcattttgaggacctactgttgtgaggaatgaaatgtatttcattggcttttatatattttatgtttaagacatctgaatatattaggcaatcaatccatacatagaactgaattaacgtcctattcaatagttaatagtatccaaaatattttttatgtctgagattctttaaaccttcttgcattgaaacactgctatcagctctggtagatgatattttctactttaaaatataatctctacttgtttacactattttcctcaatgtatttcttaaatatcttgtgctatactaaaatgaattcattctaagtgcaaagttataaaaactatgttactgcatacattatgaaaactgaaacatctgctaagctttcataaaaggtgctgagaatatgacacattcatgcctttctttaatacataaatagatcattgtgatatgtattttcattttatagcattcattcctaaatccaaatttcagcaatgttatatacaatattcaccaaaagtacagccaattatgtcttcttatacattaatatatttctgaaaactgttccaagaagtaaattcaagactgcacgatttattttccatttaggagactaatgttaggcatataagaaatgatatgctatagccagcccacagttatgctcaggaatggccccgccatacaaataaaattgaaatcttaggtcacatacatttaaaaatgtttttctgtaggtcagattcatttatttgaattattttgaaaccataatgtctgccttatttggtcagttattatacttacctcttcaaagtcatgcatgtattttaattatgaaagaatgggatctgcccaagttttccaaatcaaaaaatcaaaagtttgaatcataagcacacaggcttttgtcttttcagaaaaggtttttgcttgttcgttgtaaccatatcctcttatagaagtttctttctgcatctgactcaaaggaacactctcactattctgaggtcctgctctagccttcctaataaaccatcctcaggcgttataaagaattttgcaaggtaacattcagacatccttcatgacatgcatcaaacttatcatttcttgctcaatggctgtctttccagacaaatgaagagcattatgaggacagaggatgttttattctcagcacacatcacagtgcttgggtcaataaatgtttactgaaagaatggctagatgaaagcaataattgtattgataatgtttttgtttttaggaatcttttggtttctgcaaacttggagattttactctggactgacacttgttttctagaagttataaatatgccatataattggacacatttgtctccagtttgtggtgatgttttttatttcctatagtcagaaatgaaaattttttaaagcctaaacataattcatcaaccacatatcttaaaagatgatatatttcaaagaatttcagtggaaattatgggtcaatatatttttaagaaggtccttacgaagacaatattgccttccctatgcctggttatatttgtttaattggacattctacacttttctagagattttgcttacttacaatcagatgaattgaaactcattggtttgtattccacattgttccttctggaaaccctttttagggtcacattgacagctgccagttttcagactaaaggctcttcatgctgataaactgcatacatatattgaaccaacaattccacaatttcaattgacttaacacttttcttatgtcatctagtcttgttttctatatctagtgtcacaagtagtacaaaatgttcaacatattatagtatatgagaaaccactttccttgggagctgtcattttgggatattgtcagtaagaatgaggaattctccatcatgcctggtttcttacactgttcaactgaaaattagtgtttttcaaaaatgtctttaagaaccactaagtggaagaagatggaagattgtcaaaactatccacatcactacactaggaaaatttgaagacatgaaaaatggtgtggttttctgtagggttctctgtttgaaaacacagaattctgacctgattgcatagctctggataataatgtattggagtcatctgtgtaatcaaaagagattaaaaattcaaccactaaagtgaatcaatgtgtttaggaatactgttgaaaaagtctaaataatttcaaatgaaaagtatattatctacacaactctaattcaaagtttgcattaagaagatatctaacgaacaaacatgcagaaaagagttattacttcagggaaggcaaatatgatgatgtggtgtcataagggaaacatgcagttttaaagatgtccacagtgataattcaccattgaaaagtatcccagatttagaatcttgtaatatgactaaatagcagatttctaattgctcaatgggataatacatcatctgtccttaatatttcctgaatgctggtgaattgtcacaaaagcattcatgattaagaaacaacagggaagcctgggagcagtggttcatgctttaatcgcagcactttgggaggccaaggcgggtggataactggaggtcagtagctcgagaccagtctggccaacatgctgaaaccctgtctctactaaaaatacaaaaattagtggtggtacatgcctgtagtcccagctactcaggaggttatggcaggagaactgcttgaacccgggaggcagaggttgcagcgagctgagatcatgcccctgcactccaggctgggcaacggtgtgagacttggactcaaaacacacacacacacacacacacacacacgaagcgggaaaaattctggtgcttcgcaaagtcatcacaatacaaatcaaaataaatttgtcttaagccacttagacaatactaaccaactttcaccaggtgtaatccatgcacaaccaaaaccttttactgtgagagcgaagctcttatggagttctacctcatcagtgatctaccattataagatataaaagactagtagattctattcatgaaaccatttttcttggcttggtattaattttggtaagagatgagttaccaagttagaaattagtgtggtcccaaattaaaacattaaaaagaaccacctaaggtaaatataaatatgtgatataaaattgtcaaaatgaatcctttcagaccttacatcattttcaatgggaagtatatatcagtcattgctaacagctggttaatattatgtgaaataccacagagtacaatagctttaaagaattttttattcttaatatatgaattctatattccatatttttagaagaaaccaaaataataacttgagtaagaggataaacgatgaaaaatgtaaagtaatctgtgtaaataaatactctgagtaaagctagtaacataaccatatctatgacacttaagtatatagggtttaggtaagtgaagggggcaaaaaaaaatgcaattataagcaaattcagaatgatcagcatacatagaggaacaattagtcatatgggctgaaaacacgttacagtcaccaaacacagcacaaagaaaagctttgtaacacagccactatctttctaaaaagtgacagcagaagatgccaaaagctacagtgattatctgaatcacagaaaaaagaggtgtcacctttgagctgaaagaagaccatgtatagaggttcaactagtaatgtcaagagttggtaaccattggcaaaataacatgcatcttcagggagaaaatgccatattgatcatttcagttcatactataagtagaaaagcagcaactaagtatgacacacatgtgccttatttttatctacatataagttgtctgctgtataaagcttctgggttagtgtacaaacatatatatgaaaatgattaaatgttaattgctacccatatagcataatcaaaataaaaataattgtaatactgcatgcatatctatttctaaaattctttaattgaagtctgtgcatttgatgctgtctcttgatagctttgtgtttgtatattcaaatttaaggaaggtgatacaccatgcaaacagaacccttcattaaggtatactttcacctgatgagagtagacactcacttgactttatgatttgaattactgaaccaatgctacaggagagtgtgcctatggcccagattttgtacatgaggtattttttcccaaattcccaaaagtttattattaaaacctaaataactttttggaattttatgtttaatcataagcttttaaaagtaataaattctaaaatacaatctacaattattaattaatcataatcattggcaataatggcttaatataagctatttcttattagatgttgtttagcattttatcttagaattcattttggtgtctgagtctccttggggctaatacaaagttgatgtataggatacatcaagtcatcctataatcaactacctacttagctattagaacctaagagactatctttgttttactttcaagacttcagactgatgagtcattaaataaatatgtactgaatgcctacctactctgtgtctggtactgtgtctggaccttacaatggtaggactttccctgccactagggagcctacagaatgagtgaaattctgtgccattcctgttgactccccttcaagctattccccatgcacatatatccacatatatccaaaagaaacaggtaaagtccatctatgcacataaaagcccacttattttttctcccaattataagagaacaacttttcaaggctatataaaaaagagagccttgctattttctaacacgtatttttacagacaagtagtacatagtatatatactaaaactttgctaaacaaatcaagttgatgtcttactggagcaatgaattgacctctaataacagctatagctcacctatagtaatcagataaaactagattaccctggattaacaaatttttttttgttttctttttttgtttgtttgtttgtttttggtgtagaaggggaatgttgtgaaagagaacagttggaaaacccaaaaatatacaaatccacaaatacttagtttatgtctataaacaaagaaaaagccttttacttatcttcagaaatgaaagtataagcacaaagacaattgatcaaattattaattgtggtcttctactggagactatgacccatgtcattttagttatacataaagaaaaataatggtgtaggtgatacctaatgttatccatgtatccgtgaagaaaaagtactgcacagaaatatgaacacaactaatcagatttatcttttatatatgacattttatagatgctagcagatttttctaagctttcttaaaactgtcattataaaatatttgtaatactaaagtcaagaatttaatttagtatcatggatctaattcattaactcttttgaagtaaaagtaaatcaaattttaataaactttagtctgacaatatttgctcacattaaaaaaattatttagaactttaacatgtgtgatatataataaataacagatatatattttacatataatatataatatatatgtgttggataaatatataaggatacatatatatgaacatatatgtatatgtatacatatatatgaacatatatgtatatgtatacatatatatgtatatacacacatatgtatccttatatatttatacaataatcagtatattattacaaagtaattgtatatttctccaaaaataaggaggcagtggttatttaaaacaataatatcaaaaagtctcctcaaaataaaacacatccatattttaacataattgcaatttggtcatattggttatagtataaacataatattgatttagaaggacacatttttcagatcttaggaaaattacaggtaacaaattcatcattcctccatctccctcttcccttcttggttacactgtatgtatctttatcacttcactatttataaagtgatctatcaatgaacaacatcttttaaatcactgtccttgcttcattctttttcctaacattttcttgctagttggtatccatcattcttacccacatttggggagatagaaaagtttttgtattcctcattttgttgtacctatccacctaatgccttaaaaatcaaattattaacatgcaggataagtcacctaatcatgagaattagcagctttttggtttaattataatcataaacttttcttctgaatcaatgttcacgtattcaatcatttatcttcagaaatgtcttcttatatcaaaaattcaaatctgagactttatctcctttcacattttacaatgtctgaacttctttataatctattttagactctaacaactttgtaaatatattacttgtcattgttctctacttttaagtttgaatgtgatatcactctttatagaaggctccaagcaaatctgagaataagttttgaattgatttagttactttttacgtgcatttatttccaaatgcacactaaaatattaggttggtgcaaaagtaattacagtttttgccattaaaagtaatgataaaaactgcaattatgttcgcaccaacctaatagttattagaaagatggtggttatacaaattagatctctttcgtcacacattttcttctaaatgtatattttcaagtgtcttagtaatttcttgcagctgaaatagagaagctgatatttttattaaatagttttcagaaaacctcaatctctttatctctaccactgctctttggctttctctaaacatacacctgtatgcaccataaatatatttattgtgaatatgaaagttcctcaaggttcctgcgtgtttatatctaacatcactgatctataaggcatatattaaactttagtgcttctttagtaataatgatgcgcttgtaccaccacctatccacactctcacacaatcaccccttttgaagtaaagcctatattttaaaaataaccattacagattgtgagtgcagtctaggatcacatagcagaactaaaagctaactggcccacccacaaagtaaatgtgagacagagggctcggggtagccatactctagccaagtagtactgacagataccaatagatataatcaaatgttacacatttgtgtttgcaaacgggataaatattttcctgaccaatctatacttttgatgattcaagctacaggataagttttaaaaatgtcttttgcacttatctacattacttaatagtatcttcttgtcatagacaactgttttacaccattttagtaggaaatcaatttgtcattcaattccattttctaatgcagtagtccaacccaacccagaatgcattattgatatggaaatgagtgtaattagcagcgtaaatgatctgttatttatgatacaagtcagagcagtaaatcaccattggctcactatcattactatgcaaatagaagaaagcagttaatggtccatgtgtttaaaacaggccacttgcttgctcatttgcaaatgaaaggcaagggtgagagtttaaggtagagatgacagtttatcatattgtcagtcctggtacttggacttaagaaaaccaagacacaccaatcattatgctagttttaaacgttatcccctttctctactgtatattctgcctcgaacctattcttacagcaccttcaaacttattttgggttccctgtgatttgcacattggaagtggaaataattgtgagagtgcttgtaagtgtttcgcactgtatgagatagtttttatgccatatgggaaaaacacaataaaaattcactattatgaaataaaatagcatcactggtcatataattcacttccttttcctacaaataaattttattttcttgtaaggagagaaactagcaataatttgagtagttagagaataaaggaaatatttgtgagccttactggaatttattcagtatacctgaaagaaattggtctgcctgtcctggttgctctcttttcgtttaatattccagggaatgtgagagcttgtggggaaacgtgagtgcattagcagcaggccaatgcttgcttagtgaaatgggaacaaaggcaagacacatgaaaagctagaggaagaagagggattgagggcaaatgcaaattctgcaagcttcacttgcatagatctgatcattttttaaagtatttgacagactttcagaaatacagaactgagaaagaataataatgtctttatattgaaggtgtacatagtagaaaggatctcaatctcacataaattatctccattttgcaaatatataaataaaactgacaaatcacttatgaaaccttattttggtttgttgttatttttattaagctatggattcaagaatgacatacaaattgggcatgaattttatatacaggaaatgataataatatttaaacagtagaaaatactttttcttataccaacattttttcttaaattatatgtacagagtggttggaacaatgctttaattcatctttcttatcagcttatgttttgtaaatattatgtttttctttaattccaaggaaatagctaggccattatatttccttgcctcattggtttttccagagataatcttccttcttggcttttgtttttgaaacctaaaccaggaagaaagattatatgaggaatctgaaaaagtcaaattcatagaaccaaagggtgaaatgatagttgtccaggactggagaggagaaaatgggaaatggctaatcaatgagcatgaagtttcagtaaagaaaaattaataagaaagtctacagatctggtgcaaaacattgtacctatagctaataataccacattgtatactaaaaatgtaagaaaatagatttcatgttgtgttcttatcacaataaaataaaatttaaataaataaagtaaaataaaaccttaagtccagtgagaagtttaagctagaggaaaggtagatggttttgggttgagcccatgcatttgttatcaagaagagaagagacaagtgcatactcactaagtctgggaaaggaagggacatctgtaggcataacagatagagggatacaagtgcactcccaggcagcactcaggaaatgaactgacttcaggggaggggttatgtggaaccccagtgtatcagtcagattcccagcaactactttatgagacattcaaattaggataatttaaagaatgttaatataaaagttattaattttaagagtttgagcaatgtaaaggaattactagggacagtgcaggaatgagagcagtttatttgagctggcattagccccaggcccagcaagactaaagcagggaagagagagattatagaacaaagagaaacttacaaatgcagcttccttcagagcagcaatgaccttcccttgaaagacacagattaagaagatctcacagagagggaaccaggagaacaaatacttagtttcactgtcctttctctctctctgattccctgctggggctttccaaatgggtcattggacaatcctaaacaaaacccagaaagcacaggagtctactgataatcatccacacaggccagcttccaacaatcagaacacaaagccaggatttctgaggacacagtggagctttctgtcttcaacggattatacaagtgtggatagctgagtatatcaaaggaggaggctgtcataaaccaaaaactaagaatccccctctaaaatttcatatgacagttaccaaaatttactacatttactaagttcttatgcccacggattatgctaagcactttatataaattttcttctcccttacagtattttcaggtaggtcctattattattcttttttgacaaaataagaaactgaggcacagagaggtaattatcttcctaaataacacatgatgaacacatgatgaaaccatggcagttagattcaaacctgtctaggtctgaccccagagcctgttcacctaatgacctcatataatgcttccctatatttgacataaatatgctgataagattcccaactgtggaaagtaattaaaataaaatgcgaaaatacttaaaactattcataatttgaattaataggttcttttaattaatatctgttatagtttgccttctacactgaaacattaagttggaagagaggcagaagtaatgggattcatacatatgcagaattgcaccattactttaaaatgaaatgaagatgagagaaccacttagacattatagttgttggacagattaaataatccactttcctaaaatgcaactggtaaagaaaataaataatgcttatgaaaggaactagattcaggtctattatttagcttggctttgaatattaattgtttttcctcttatacttgtgttttatatacatacatacgatgtgctttatttaagtagaaaccacgtgttaaaaatgtgtaagtaaaatataactagcagtcatattattaaaatctacaccatgtctatatcaaacatcttatttaagccagaagaacatttttaaaacataaaacctgttaataaagagaaattccataaaatgaaaaattgctttctatctacagtcagttatgtctctttgcaggttgcaattacttcgcatgttggtttttttttttttcttttcttttaaatgaagtctcgctttgttgcccaggctggagtgcagtggcgcgatcttggctcactgcagcctccacctcctgggttgaagcgattctcctgcctcagcctcccaagtagctgggattacaggtgcctaccaccacacctagctaattttttgtatttttagtagagatggggtttcaccatgttggccaggctggtctcaaactgcatgctgtttttatattcgaagaatattatgttgtatacatattgagatcccattaccaatcttgtttagcatgagacagctaagtcattgagtacagagttattttccaaaagtattcaatctcatgttgagaaagcaagaggaaagatgaggtgggagatgggggatgggggaagcaagagagagtgagagggagagacagagacagtgacacaaagacaaggagagacagagacaaagattgagattgtggtgctgagttttaatgaccttctgaccccaaacctggtcacattgatgtaaataataaatacgcggttgcactgcttttccttagaaggaaacatagacttactcctgtatctcttctcatatccttgatgttttctgaattttttattcagactgattgacactgattccctctttgacagacctctctccagaacctcacgctcctatatccaggaggacgaatgctactcagcctctctgtttggatggcaggtggcataataagcatatgtcacatgaactcctgatctcttggtctatattctcatctaaacagctcctttcatggtcttcttcatctcatctcagttgatggcaactccatccttccaactgctcatattaaaaaaaaaaaaaaaaaaaaaaaaccttcgtaactatttttattcttgttttctttgaaatttcatatcatatctctcagtaattcctgcaggctccctctccctttaaaacgtatacagaatctcattgcttctcaccacccccactgcttctactctggataaagtcaacacaatctcttacttggaatattgcatttgcctttgactctgttcagagtattcttaaccaaagagcaagagtaatcctcattgaatgtatatcagatcaggccactccacttcttagcattcctcaatggcttctcctatgtctgagaataaaagccaaagtctactacatacctttccttcccctattattctatgatgacatctctcatgacccttgcattttcttatcccatcaacatatagtgttaactgtttccttgaactgtcatcacagggccttcatacttgctgtttgattagtctgcaccatgctttcaccagcatcttcacttccctcagatctttactcaaatgccacttcttcagtaaatctctccatggggcaccctacgtgaaactataatctcccaacattcattgtcctctttcctaatttattattctccataatacttatagtctaggcttccatatgttttacttattttgtcaacttttaagaaaatataatctctaccaaatcaaggatttttcactactttgtccatgattgttttccaatgattagagcatgtattgaaatcaattaaaaggcaaatgaaaaacaggacctcactgtcattttgtaacccaggttgtctgttctttggtctatctctgttgctatcaccttgagggatggcctttcctgaaaggaggtggaatcaaaatttcaatggtcataataaaatactaatttttttaggcttgttaataaagataaacagaattttataatttacaaatgccattttagacaataattgtaaatgccttttcttccagagtgtaatattaaaaaacagtcagcaattttatgtttctgtgaaatatattactggttgcaatttgcttttaagttacttgtaatatgattaaatagtaaatagttaggatcatggtgttatacaacttttccagccaactgtgaatcagtttatgtctaaaactttaatgggtgctctctctatatataatgtgatcagaggtgcattctgctaagtgttaagtaacttgacttctgtaaatatagccttaaattttctaattttaaggcaaaattagatttcaatatgtctaaatatcaccaacagcaggaattagcagttatattagctcactgcaaattagttgataaggatcaaattagatttttaaatcatcattgcaaattatgaagctctattttcaagaaacacatttaacatcattaataacccacagaagttgtgaaaggtgaaaactcttttaaagaacgacttctgagagacaatcctttagtttgcccattcactgaagaatcactcatgtaattaacttgcctcatctcttccctgagttattcagatggtcggtgaggatagtaatggcagccacaaactctggaatcatctcgaagtctgatgatacagtgttacatggtattttctaccacataaccaaagctctggaatatatgaaggggtatctagtgcttacatttgtaacatcgaagggttatatgtaccccttcatatgtcccagagctttggtgtggtagaaaagttatttataacatacaaatccgatactacagtatagagagttacatattatgcattcttaaagcacaatattttagaaattttatactgcatttagctaaatacttcatttgtagatagagtagccttcataggataattaatattttctaaaaacttccactaactgacatttttacaatggattttgttatttaagtttcagtttacatcaattataagtgtgagaattcacatggaatctgtataaaagaagagaaaattttctttttaccttcctattacatgtagaactttttcttctactgagactaaaatattcctttaataaattcagaaatcattggttaatttcaaatttctcacccctgcaaaaattatatatgattttgaaaaggccaacatattcaatcacctgtatttttatagatcgaaaaatattcacatttaaaaattgccaaattacaaaaagttgcaaatggtgttcctttaatacaactttcaggcctcatttattccttacttgcataccaggttctcaacaagaacagctgatccaagaaaaaaataggtccttcgcaaaagttctttcttagaagagctatgactatatacacatcgttggtagtaaaatatatatattaatatcttgaaacattagaaaatatcatctatcttaattctatagtaaatcaacagaaagacacaataatcttcaacataacaaatcaaacacattgaactctctgtatgttgaggtgatgaatatattctacgcatggcagtgtgcattcaaattcaaagccttgtttaccagtgatttttgtcatgcactctaatagtgtcattacatggaagagggatgctcaaggagatactttaagtttgagaattattttcctctgttcagctgttaaactacctctcaggaaaccaataattcacaaagggaaattaagcaaggtgactcaattatgtgactttatgttccagttcctgtacatgcttttaaaaagcatgtttcagatcattttaccccttaggggtcagcaagagaataaccaatctaaaatagaatttaatagtgcaaattcacatccatgtaatctaaattgtgtcctctggagttttagagaccactaacagttaaagcatagtggatatagtaaattctgaaatcccaagaatgaatgaatacaaatatgatttcatatgactggacactgtttgaattacagagctgctagaaagccagagatacagtcaagtgaaaatatttttccctaaagtatctagatggtgcttatggatactacaagtcttctacaccttaaaacattatgtaaaattgctagaattcctattttccctatataatttggaatatcgaagaactaagtaacacatatttttctcacatagactctcaggtggtctttggggtaagagtagggggagtgtggggggaaaaataactacactgctttttaccacgacttggaatccacagagtcaagagataccacccatttatatacacacagagagacacgttcatcttagtaaacttcaaattctcaaagggaatcctctcttgtggcaggcctagttttaagaatcagaacatgttccattctccttcaatgttccagcagacacttcttttgtaatcttataatatggaatcagaacaacaaggtttcacattcttctattacgtagatcattcttattacatacaactgagaagagcaatgtaaatgtgcagctattctaacctgcctattggataaaaatgtaaaatatcaacaagtttactgctcaacattttccatcttttattcatttgcagaagaagaaaagaaaattttcaagaaacaaatgatttaaagtccagatttctttgatctgaagctgaactcaagcttttttctacttacaagcatatttaacaaataactgaaataattttttaggcattcattcatatttcttacaggaaagaaacaatttcatttctaagtctcataggaaattgtttttaaagctatgagtttagaagagaagatctgaaatcaagacatgaccagaggaaattacaaaaaaagatgacgttgatattccttctggtgccctcctgttttcagtgcccatctcctaccatactacctaatccccaggagaaaccttctccaggcctattaccacacaccttgatttccaagtatttcttttctagctaagggaatatcaacggagttgttgtcactctctgagtagcctccaagacttacaaaccatagacttgatgttaaattttggacaccataaataattctgggcaacacttgtagagagaagaagaattctacacaatgtgaacacctatttatttttatcacataatattgcctttctctggaattctaaatggtgatatcaaaagactcctgtttataagaaactaacatacattcttgttaatttttctatcagaggaacatggaataaatggcataattagaagaaatctatagtgcaagaataaaaacattaataaagccaatgataaaagctaaactttatcatgcacacacgaaatcccaggttctagatgaagtcttttccatgtatttcctaatttactcatatttgccccaagatatatgttaatattatttagataagaaaacatagtcttaaaattatacatggctcaagctccagacctaggatttgatcccagggttctctgaccccaaagctccagcttttaaaaattatattttaatactatgtaaattgacttagcacttataaatttatatttaaatattttggtgaaagaaaaaaaataaataataatcctttggtgtgtcccagaaaattcccagatatgccaggggttaaaaatgattctctattcagaatcaccctcaatgaatagaaaattcagtacatggcccaagacaacagagtaattataaccataaaagcaggaaaatgtgccatcaaaatttgtcaatcattgtatataacatagagaaaacgagaaattgatgaataaatgagtacatgtaatctctagaataagtttctagtcaacactgtcagccatataaacaggacatggtaaataaaaaacctcagaaaaagcaatcggtaagatcttaaaactgaactgaatcaattcatttagaaaccaaaaagtttatatccgctatagatcacatattaaaagaaataaatatgacatcattctacaaatgaaaaacaaaaaatttagaaaggcacattatctccaagtaggcatgactgacatccaccaaatatgataagaaaatatctacaataattaaaagacttagccagcttacactggtaggtgattcaatttccaggagaaatgcactgatatttcctcaagaggaaaaagaataagataaatatttactaagtagctatgtgatcttgtgtcaatctctcagagatttcatttctcctttctaagtctcagcttctctacattcaagttttaaatacaacagttttatagaatattatttgccatttttgacacatgggaagaaaatatataaatgaattctatatttattcagctcaagtaacaaaagttaaggttgacaaaataaaactcaaactatatttgccagtaaaccttcaaacagtaatcccatgaacataactagaatggccgaacctttctcaaaccaaagagacttttgcaggttagacttaagttaaatgcttcatcattaattccagcaggcaaagaatggaagtgggtagagcacaccagagacaagaataggttggaggccaggcaaactagaggttataaatggaagcactagaggctagaaaagagtgggttggagactaggtaaaccagaggattttagtacaagcaagagagtaaggctagagatcccagggccatgtaaacgccaaagactggttgtaaagcaaaccgtataatctcagggcaaggtaaattatctacaataaggacattcacaaaacctagcaaagaccaaatgtaaggtaaaagaacacttgcattgtgcccatccttggtggtcttttttctgcattccccccattaagtactgctcctaaataagtttggcttagaaaatacagagagattactaaacaaagcagtctgctagaacttattccagctctctgggatacaaggatttcccttactcctacctgctctcaaactaaaggatttcacattaatggtaaagttctcagctggagaatgaacttggcagtaaaatcagatggcttatgtagcaatttttgagttctaaagagctgtaataactagaattctcctttcctgtacaggaagtgataagccttttaacctatgctacttatattcatgttctgatacaaaaaaaaaaaaaaaggaagattggtcaaaagtaaatttttaggataaactcatttatctggccctgtctgcctaattatgcctccccttcccactaaaagctcttaagtattctctattgtacatgctacagaataatgttcaaatgcctttgtaggtcacaaaaggaactccataattgggttaacatctaccacctaggcctgattctgtagtgactttctgccttgctctttatgccttagaaacactgtactgtctatagggtagtttttgtccacaccattctgtttctttcctccatgacttttattctatgacttcctctaattagaatacctcatcttccttttcatctatcttatttattctttatgacttaccttaaaaaaatcaactccttaagaaagccaccctgatatttcatcacaatcactctctggttcctcacagtacctactcattctctagttctgcttacatagtatcctgggcataaatttagccctatgtaccatgttatctcatgtgtatctgttcgcacatgtttagagtgagttgtacatttatgaggctagccctatggtggctgctttgtttgtttgtttgtttctagactagtgctcataattcagataacatctaccaggtaaatttaatacatttttataactgtgaggacagatgtgatataacattctataatggaaagaaaaaaaaaatgtgttttggagccagacttagatagtactcctagctttaattattgcttactatataaattctagtaagttattatccactttcagttgtcttcacgtttataaataccaggagaaaaataccattaaatgttggttcttataagatgtcttatgaaaagctactggcaaaattcctggtgaacaaatatcgatcatttcctttaaactataagctccttgacggtaaagcataatgctgtgtgtgttgtgtatgaattttaatatctacaacaattagtaagcacacagtatgtgatataatatgggtaccctataagtgtttgtgaatgagtaaataattatgaataaacacatacataaaacaattacaagttaaattcctaataatcctaactttggaaaatataaattgtattgaatgaatggaagaactgagtaaatgcatatcaaactgttaatgataatataaacactttccttagcttcccgttaatctgtatatttaatataatttcaatcaaaattacaatttggtaagatggtggttttggagaagggatgaaatttgagggatattgtcattaaaccagaagaatgaatgtatagcaagagccattacatcttttaaaagttaaacattatgatactggctcaaagacagacaaatagaataaagaagcaaaacagggaatccagaaacagatttatgtatttatgtgaattaaacatgataaaagtagcataccaaaccagtgagacatggtgcgttttacaataaattgtgttagaaaaactggatgccctttcaatattcagacagaccaagtaactctccaataatcacactgttagaaagtaagtaagcactagctttgaaaggaacacactttcaacagtgtttcactacttctcaagatttgccttagatagtgtgtacaagtccttgctgagataggctcaaatttacagatgagtaaaatgaggccagaacacgtaaaagactgcttcgagattattctgctagtggttatgttgcaagaaatacagctggaatacctagctcatcagcatacaaaattaaatattctgcctcacttctacgtttgcaataaaatgtatctctaactttatcaggttttccattaactcaaccaaattatgaagacttgatctttaatacacaaattcagctatgacaaatgtaccgtctccaaacttactatctagaagacatccattggttatgaattaatggattctaggatatacctttctccccatgaaaaaaaaatctacacattcaggttactaaggtatgaaattctgctgctatagctttggtattttaatttaacactgttctctattgttgaaatgcattatttctgtaggtatgaaacttacaaaatattagtcatgtattattatgaagaaaacaataatgcgatacaaagtttctggtggggttaggataagaaagtttttggtttaataaaaataaccagaaacagccttctggaggaggtaacattagaatttattctaagaagatgcaggttgtcattccaacacctgaggaaagtatttacgaataaaaaaatataagaagccctgtataaatggccctgaaatttattaaaaatgagcttattttacatttgaaggacaaaaacaaggctagtatagtagcatggtaaatcaggggtggggagatgtacttgagtatactactacagagatattcaactatcggaatttggtgccctataggatataataatgagtttgcaactcaaaatctgaaagttcaaaggaggatttgtgtgcaacacatttagtagaaagatagtaacaataccatcactaacttatccaaagaaaagtagatgtccttaattagccaggtgtgatacttaatactgagtgtcaacttgattggattgaaggatataaagtattgatcctgggtgtgtctgtgagggtgttgccaaaagaggttaacatttgattcagtggcctggggaaggcagatccactcttaatctggtgggaacaatctaatcagctgccagcaaatacaaagcaggcagaaaaatgtgaaaaggagagactggcctagcatcccaggctacaactttctcccatgctggatgcttcctgccctcaaacattggactccaagttcttcaattttggtactcggactggctgtccttgctcctcatcttgcaggcagcctgttgtgggaccttgtgattgtgtaagttaatacttaatacattcatatatatcctattagttctatccctctagagaaccctgactaatacagattttggtaccaggagtggttctggaggaacagaatattaaggatggagttctttcatcagttttggggtttctagagttggctgcttaatatgactagaccccaaaatgctatggaatctccttctaatcatatggagaacactgatagtacttgacatgaactgtttagagagttatgcaaaataaatgcacttaacactcctgattcaccactcgtgagaggcaaagagtttagtgactctatacatacataacacctttgaccatatgtggagaaccaaggaacgtaatgaaactggttgcttgctcctaagtttagtggacaaagtgatgaaagaaaatgatgaactcagggattctgtctctgggctttagaagcagatactgagcctcagatctcctaagattgccctgagggagagtcttatctcctctagagaaagaactgaaattgtggaaaaatagacatgctatcatgtgagtggctgatctgcaacgaaagatgcatgcacagcctcaccaagtgtttattgttaaagtgagggcattgattggaaaagaatgagaccctgcatctcggaatgggcacatgtgggaggattctgatgaagctggggatactgagtttgtaaactctgatgaaccttttttgtcaaaaggaacagcttccccatccccagtagtggcaacatcccctcccaacccatgctgtcatcagcttttccatctttgtctgaggagataaaccctgtgctgcctgaggcaacagtgatagccttcctgctctgcgggaggcaatggtgatagcctcccctgaggcagttgccaggcatgataatgttgattctcctcaggagccacccccatcacctctgtttgcttctagacctataactagactaagttctggtaggtccctagagtttagtttgacaatgtgactcatgaggtgagctacactcaaaaagaactgtttgagttttctaatctatataagtagaaacctggagaacaggcatagaaatggatattaagggaatgggataatgatggaaggaacatagagttggatcaggctgaatttatttatttgagcccactaaataggggctctgcttttaatgttgcagcttggggagttaaaaaaaaaaggttctaatagtttatttgcttggttagctgaaatatggattaaaaggtggcccactgtgagtgagctggaaatgcctgatctcccttggtttaatgtagagaaaaggatccaaaggcttagggagactgggatggtggcgtggattaatcactttagacatactcatcccagctaggagggtccagaagatatatccttgacaaatgccttgtgaaacacatcggtgagggcagcacctgctctttgaagagcctgtaattgctcttctctgtatgtcagatctaagagtgggaaccacagtcactcaactacaaaatttaaatgcattagagataattgcactcaaccatcaaaggcaaggtgggcatggctaccataatggacagcagagacaaagcagcaataagaatagtctgactcgtgtagagctctggcattggctaattaatcaccgtgttcctagaagtgaaattgataggaagcctactgcattcctacttaatttatataaggagaaaacttctaggttgaatgaacaaaagactaatttgaattacaaaaaaagggaatcatggcccctcaacaaatttccatacttcagtcactttacactcccagaaccccttgaatgaaggggaggctgggtccctttgaggaaggaccccactacattactgacaatttatgcagtgcatctttctcccatccttccccaaggaaacttaaggccttttaccagggtaactgtgcacaggggaaagggaaatggtcagatattttggggactcctgggcactggctctgaactgacgttgattccaggagacccaaaagatcactgtggtcctccagttaaagtaaggtcttatggaggtcaggtaattaatggaattttagcttaggtcctacttacagtgggttcagggggtccccagactcatcctgcagtcaattttccccagtgccagaatgcataattggcatagacatacttagcaattggcagaacccccacactgactccctgactggtagggtgagggccattatggtgggaaaggccaaatggaacccattagagctgcctctacctagaaaaatcataaatcaaagacaatatcacatccctggaaggactgcagagattagcgccaccatcaaggacttgaagttgcaggggtagtgattcccaccacatccatgttcagctctcccatttgaccagtgcagaagacagatggatcttggagaaggacaatggattactgtaagcttaaccaaattgtgactccaattgcagctcttgtaccagatgtggtttcattgcttgagcaaattaacacatctcctggtacctggtatgcagccattgacttggcaaatgcctttttctccattcctgtccgtaaggcccaccagaagcaattttctttcagctggcaaggccagcaatgtacctttactgtcctacctcaggggtttatcaattctcccgctttgtgtcataatcttattctgacagaccttgatcacttttcatctccacaagatatcatattggtccattacattcatgacattatgctgattagatccagtgagcagaaaatagcaaacacactgaacttattggtgagatgtttgcataccagaggatgggaaataaatccaactaaaattcagggaccttccaacttcgtaaaatttccaggagcccagtagtctgggagtcctgttgagacattcctactaaggtgaagcataagttgctgcacttggcccctcctacaacccagaaagaggcacaacacctggtaggcctatatggattttggaggcaacacattcctcatttgggtgtgttactccggccaatttattgaatgaccaaaaggctgccagttttgagtggggtccagaacaggagaaggctctgcaacaggtccaggctgctgtgcaaactgctctgccacttgggccctgtgacccagcagatccaatggtgcttgaagtatcagtggcaaatagggatgctgtatgaagcctttggcaggtccccataggtgaatcacagcagaggcctctagaattttggagcaaggccctgccatgttctgcagataagtattctccttttgagagacagctcttggactattactgggctttggtggaaactgaacatttgaccataggtcatcaagtcaccatgtgacctgaattgcctatcatgaactgggtgctttctgacccatcaagccataaagtgggtcataaaaatcagcattccatcaccaaacggaagtggtatatacgtgactgggctcaagcaggtcctgaaggcacatgtaagttacatgaggaagtggctcaaatgcccatggtctccactcctgctaccctcctcctcttccccagcctgcaccaatggcttcatggtgagttccctatgatcagttgacagaggaagaaaagactagggcttggttcacagatggttctgcacaatatgcaagcactacctgaaagtggacagctgtagcactacagctcctttctaggataaccctgaaggacagcagtgaaggaaaattttcccagtgggcagaactttgagcagtacacctggttgtgcaccttgcatgggaggagaaatggccagatgtgcgattatatactgttcatgggtcatagccagtggtttggctggattgtcagggacttagacaaagcatgattagaaaattggtgacaaagaaatctggggaagaggtatgtgggtggacctcactgagtggtcaaaaactgtgaagatatttgtttcccatgtgagtgctcaccaatgggtgacctcagcagaggaggattttaataatcaagtggatatgatgatccattctatggatactcctcagcctctttccccagccacctccgtcattgcccaataggcccaggaacaaagtggccacggtggcagggatggaggttatgcatgggctcaacaacatggatttccactcaccaaggctgacctggctacagccactgctgaatgcccaatttggcagcagcagaaaccaatgctgagccctctgtaaggcaccattcctcagggtgatcagccagctacctggtggcaggttgattatattggacctcttccatcatggaaagggcagaggtttgtcctcactggaatagacacttactccaaatatgggtttgcctatcttgcatgccattcttctgccaaaactaatatctgtggactcgcagaatgccttatccaccatcatggtattccacaaagcattgtctctgaccaaggcactcactttatagctaaagaactgtggcagtgggctcatgctcatggaattcactggtcttaccatgttccccagcatcctgaggtagttggattgatagaacagtggaatggccttttgaagtcacaattacaatgctaactaggtgacaatattttgcagggctggggcaatgttctccagaacgccgtgtatgatctgaatcagcatccaatatatggtactgtttctcccatagccaggattcacgggtccaggaatcaaggggtagaagtaaaagtggcaacactcaccattaaccccagtgatccactagcaaaatttttgcttcctgttcctgcggcattacattctgctggcctagaggtcttcgatccagagggaggaatgctgccaccaggagacacaacaatgattcaattaaactggaagttaagattgccacctagacactttaggatcctcctacctttaagtcaacaggctaaggagggagttacagtgttggctggggtgactgacccggactatcaagatgaaatcagactactactccataatggaggtaaggaagcatatgcatggaatacaggagatccattagggcatagcttagtattaccatgccctatgattggggtcaatgggaaattacaacagcccaatccaggcaggactacaaatggtccagaccccgcaggaatgaaggtttgggtcactccaccaggggaaaaaacccacaacctgctgaggtacttgctgaagtcaaagagaatacagaatggatagtagaagaaggtagtcatcaacaccacctacaaccacatgaccagctgcagaaacgaggactgtaattgtcatgattatttcctctttcttttgctgaaaacatgtttgtgtatgtatacacttgtactaagaaaatatcttcattttatttccttttcctttatcatgtgacataagatttattgacttcgtatcagcatttaagtattgttaactttatgtaatagtatttgagttggggattggtgcttttccagttgtatgaaggatagttgtattatgttaggcataattatgaccttattgtctttacttggatatcatgtgtgatctcagcagatctgtatgggttcaagttgacaacggttggacttgtgatggttaatactgagtgtcaacttgattggattgaaggatacaaagtgttgatctagggtgtgtctgtaagggtgttgccagaagagattaacatttgagtcactgggctggggaaggcagatctacccttaatctggtgggcacaatctcatcagctgccagcaaatataaagcaggcagaaaaacgtgaaaaggagagactggcctagactctcagcctgcatctttctcctgagttggatgctttctgccctcagacatcgaactccacgttcttcagttttgggactcagaatggctctccttgcacctcagcttgcagacagcctattgtaggaccttgtgatcatgtaagttaatacttaataaactcccatatatatatatgtatatatatatatatatatatatatatatatatatatatatatatatcctattagttctgtccctctagagaaccctgactaatacaccagggtatgtgaaaacttagcatagcctttattataaagaaaaagtaaaattcagcatatttaggctccatgtgcttcactagtttttctaaaatctggtaattttaccaatggatgaaatgtaatttaattaggtaaagctgaagttcaaatatagagtggaactgataagtaataagcctaacccatatgattgtattcaatatatttgaaaagtgtcattggaagttaataggaggaaataatatgatcaattattttgtaaggaaaggaagtcaatggaaagaaaaaaatactaattaataccaaatttttcttttttttttttttttattttgacggagtctcgctgtgtcacctaggctagagtgcagtggcgcaatctcagctcactgcaagctccgcctcctaggttcacgccattctcctgcctcagcctcccaagtagctgggactacaggcacccgccaccatgcccggctaattttttgtattttttagtagagacggggtttcattgtgttagccaggatggtatcgatctcctgaccttgtgattcgtgcacctcggtctcccaaagtgctgggattacaggtgtgagccactgcacccagccaataccaaatttttcaaaaggtgaaaaaatacattccacttaacatttccagtcaacttctccactttgtcctacaaaaagctattttttctattttaaaaaaatgtgacttattaaactaatgagaactaataattactttttcccagaaaacaaagtcaagatttccaccctctcttttattatgagctagtatttgtagcatggaacatgtttttcataaacattcttaggtatccttaaaagttaatagttagtgtccatcctgaacattttacctttcatctgtattcaattaatccagttttcaaataagtaatcaacataataagcactatgatagaggtttaagaattacagaaattttaagtaagtgtatggatattctaatacacattccagtatgggccaatataagtataaagctaattctctgtcacttacatagtacactaaaatataactcttcataaaagattgtgtgtgtgtgtgtgtgtgtgtgtgtgtgtgtattcaacatgggcaactaacatttctttcttcaacattggtcttcaaactgccaaaactcttatactgtgttctaattattctcatatgcttagctgagacctttcacaaaaaaagctcttcaaaaattgtcattatatggaattgaatcaaatcacactattacttgtcatgaagtagaattcagtatcacatagaatgtcatgttaacctgtcctgtttcagactcaaatccagtgatttcagcggtattcacaactgactttttcaaaatattccataatgagaaggtacttaatatggtttctttaactgtaatctctaagataatattatcatgacatgtcagggtacaggcactcttttaaggtatacttgcacacaaacaaacagtaatgattttaatgcatgtgtcaaatctaaatctttgtccctactgttttgtgtacccaacagaggtgatttcaaaggaagaagactggaagagatacacacatgaattgcgtacatcagaatgaaatgtctatataattttgaaaatcaaactgtttatacactgtttgaaagattcatttcggccttacatttgctaatcgcacaagatgttacagaataccaccatttgttatctacaaatccaaagaacaaatgaataaactgtattcagccatgtgtataatcatccctcagttgatcctcagtgcatttatagcatagtgggagtgtggctttttctgcctcttctctgtaacatataaaaggtattaactttcacttaaaaaggaaataatgaaagaaagaagcagcagcttctgttggtacataaacatcaggcatggagattctatactgcatcctaggagaaaccagggaaccaaaataatgagcttaaaaccgcagaaatcattgtttatgattcaattatttgaaagcagttactaaaaaaaacttacatgatactagtatattttcctttgtaatatatgctactttgtttatccatcccagaaatttgtctttattttaattgctgttaagctctttgctggaggttttagtttcatcctctcatactcccaggttttctatttggactttgtagcttgtggtcactgaggttacatttgcttttcctcttttatgtttagcttcattgcctcaaacttttctttccactgaatgcatatgaggtcatttatctcttcatatttctattcagtctaagcacagattgtatgtgtgtgtgttttgttgcttgtttcttttaatagaagtgtggcttctatcattctttcctaactcattaaaatatccagatttcttttactagtgcttatttcttctttatcatggaatagcacaaaacatcaccactatgtattactttgaaatggatttagccatcagtttactgtatcttagaaatgtatttccagtttgttataaaatcaaatgcacattaatcaactaaaatacatcagcagaattattttattgccaacgataagtatcagcagacttctgaaattttattggtaggaagaggtacaaaatttactagacactagctgcttttggtaatttgtgattttaaaaagcaatttatataatagcaagtaaattttattgaaagaaaaagctaattaaatcaaatgtgcatttctgttaaaagattgcaggctgtatttaattacgtatagctttccccaataagatgataatgataaatattactctaaattacaattgctaccatattttttccaatctggtttgactacatttcacaatttttattattgcttttattgtcattatttgtatttacctaagcttctttgtagactatattagctattcacattgcattaatttttgacccacaagggcaaaaagtatcaaattctgttcactgatccatgagcagcatgaaaaatgacattcataggtataaaatattcttggacaggtaccaggcttggataaacaccccctactatcacaaatttttaaattataatttataattatagctactgatatagctataatattaatacagccaaaatagacacttattgtaggtttgagatatatgtaatttttgtaagcttattgtaatatccattcctttttctcccattcaaggcattagcagaaagagcataagttatgggaatgaccttgcctatacactaacgtgtttaaaaaggaatgaatcatttaaaaagtctggttacaaattacttgctatgcacttcagaggtgatgttgacatgctggtgtgcctcatgatcctaagaaccactaaaccagaattttatttcaaacacaacagaagaagaacaatggcaataataacctaaatagcaacagaatggggagaaaaagtatgactatatcaatgtccttgtgataggcagaataatggctctccaaaatgggcacacctcaatccttgtaatatgtgactatattaacttacatggcaatagggattttacagatacaataaatgtagggtgcctgagatgggaaattgtcctggattatctaagtgagcccagtataatccttttctgggtccttttttgggaaagaaaaagaaagttcagagttaagaggagatgtgaggacagaagcatactggagtgatgagattgctgactggaggccataagccaaggaacacagatagataggcaccagaagctgaaaaagaagaaactgattctttcctagaggctcaaaaaatacagttctgctgactccttgattttagtctaatgaaacccattttggacttctgacttccagataacaacatgtgtgttgtttgagccactatgttcttagtaatttgttaaagcagcaataagaaacctacacagtcttcaaaccagtaaaagcatattactatatactgactctatcttctgaatgacctactgcctaataagaattttgtcgataatgactccattacagatttaatgcaggaagatttcagccgagaaaaaaaaaaaaaaaaaaacaaggccaggcatggtggctcatgcccataatcacagcactttgggaggccaaggcaggaggacctcttgagcctaggagtttgagaccagcctgggcaacacagcaagatcctacctttacgaaaaaataaaataaaaaattagccaggtgtagtgtcacatccgtgtagtcctggctaatttttttatttttttgtaaaggtgatgactatatactaggctccctattatgaagtagaaagtagagaatgaagaatattttaagaagaatccgagaaggaggcagactttttatctcagtccagttggggagaaggccgtgaaaataaatgtatctatagaattgttgaggattatgacaaagacttggtatatgaataaaccagaaattttctgtgaagctggagagtatttcaaagaaaagttcatatttgcactgtgtatacaaaatgaaagtatgagaagaatttatagccatgtatcataatgttggaaaaatcataaactacttgttaagaccatttgatattagatagaatttaccgattgaaaatatcctcaaatagaactgaccaaattgatacaatcatgtctttgacctatgtaagggcctctttataatcagctatgaccacctgtcctcatatgttttgatgcaataaaaatcaaattatatagtcatcagtaagttgctgtggattaaaagagtagctctattttcattagttattaaattttaacttagtattaaaattgacacacacctagtttatctttaatagtgttttttaataacctaacagtgctacacaaataaattatagcaaaactagaaaacatatatttttaaaacttcaccacttcaaatattattaactctagtatctgaagtaatgttccgatattttccaacatttaagtatagccgaacatcaaccatgtagtaaaatactatactgcagacttaagcatacattcctttcatttctgtctagttgctacagggcgcagctattcatatctacaaagccagttagatttacatgtgaggggcaactgggttgaaatgaaggttgcatcaccagagaaagcatgtagcacaatagaacaacagaaggattgtctcaggcacctctttcctacattgcatggcttgtgagtgtgcaggtttttttttttttttttccagatatttatcagaggcagttactatcattctttttgttgtagaaaataaatggatgggtgggaaaaatgtcatgagtagagcagaaagttatgtgtggaatgaagggggaggatgaagggagggaataacttaccaaggttctttaaatcatgccagcctaatgaccttgcatattttattaacacatacactttccaacccccagagaaacttaaagccttgtgacaatgtcagtcttctgaaaagattaaactataattcttttaaacttaacattttaaaataagtaaaaataacatttaacagttttttgacacctttgtatatgaaaacatttgtgtctacaattttggtcagtttacaaattacaaatgttttaaactactacacacactcaaatgtgcaagggaatatgacctagaaaccaaaaacaaatttagctttcctggccaatatataagtcagtgaaatttaatggtagctcaggacatttttataggaatgcgtgggatgacatgagtaggaaaattagtatttaattggagagaatagaatctgttatcattttaatgcactcagacctacatatttaaaaataattttaacatatatacacaaacaatatgtataaaaatagagcttagaatcagcatttaaaactgcatcttacaatttgcttactctgtataagaatagaaaaaactgactctaagtttaaaattcatttgaccaattaattcctctccacagtgcttatctacatactagaaatattaaaataagagataaaaagttaaaatttgtttttaaaacataaatattttaagacatactacaattatttccattcaaggaaatgtaaaaggtagcattactaatatagttctcaaaactgtataatttctaatagaaaaatttagttctctgttaacatttgttaatttatcttactggaacaaatagaccctacaatgagataaaacatgttcaaactcttgctctgacattttaaagttgtataacttggggcaaatcactcgactagtcaaatacttcttttcaactagaaaacagggattatatctacatacccacaggattgttatgaggattttctgactataaaaatgttatatgatgataatcaagtatcaagcatataactctataggtgttgcttcttatatcttccccttaccccctccgcatatagactctaacccttgcaagtctactttgtaaagaaagacctacattgatttcccatttaaggtccatgggacaaaaagagatgctcaaaggcagacagaagtgatacaaactccttctgccttcaaaaatggagatattcaagaatgcacccaagctatatctagcaattgtactcattgatagaacaagtaagagaatttccaaaacaaataacacatgatcaacattgcacttgttaggttcagtgttttgttttttgtttaaatagggttcttatttaaatatattgcattgatatctaccaaaatttgatattaggttaatttcttttgtttttgtgagatttgtgttaagcaacttgtcacctctttgtatagcaaacgaggtatgctttttaatgtttccatatgattattacaccagggtcttttgttattgttgttattttaaaattttaaaatcattttacctagttaccatagaaatgttagttacacattgctaaaagaaatcatgaaatgagaatgtaggactacagattttaatcatgtttaacatatttaaacgtagttttatcaacctgtcagacatctttgacaaagagtactagaaaaagtattttctcttttctttccagaatcactgggtgcatgaattgcaaatcttccatatataaacagaaacaatactatattccttaactttttttttttttttagacaaagtctcactctattgcccaagctggaatgcagtggtgcgatctcagctcactgcaaccttcacctcccaggttcaagcgattctcctgcctcagcctccccagtagctgggactacaggcatgcaccaccatgcccagctaatttttgtatttttagtagagatggggtttcactatgttggccaggctggtctcaaactcctgacctcatggtctacccgcctcggcctcccaaagtgttggaattacaggcatgagccaccatgcctggctatattccttaacttctataacttactgtggtgacgcactaggaagttggcaatttgtcttcttttccactgagaagacagactaatttaagacaatttctctttcacacaacccaaaacatgctgtcatattgaaagactcaatgaatgcttagcatgaaaatgccaattttaaaagctagctattatctgtgggttttcccacctctgcacttgatatatttcagaggagagtatttatgcataaaccacagactttgttagaatctctataataatatgaaaacttttgatttgtgagctcctgtggaaaaatgaaaattatttctgcaataaataatattttatctgttctaaaatagcttaatgattcccataagtctattatgagaactcttcattaatcaaaattttcacttctagtagacataatcacaatctattaaatttatatttcctccagtgctaggagtaagagcagcaaataggaccaatgtaatcaagtattgtggagagcacatcaactgtataggtagttaaatcactttcactctaggtctgtttccacatcaacaaagtgaagcagttggactcaatttttgtgaaaaccagcttgattctacagttcctttaggttttttttttattcttcttcttttaataaaactcaggagaaatgaccgccacctcacttcattttagggaaaacaatgtgtgacacacattataaaacagaatgcaaagtgtcaatattattatgatattaagatgtaatattcatttagcatgacgaatttgatccaaatcaaataggtcgtgagaaattctccatcttcccacctttgggggctaagtcataacttaatggaccttgctgctgtatttgaattgaggacttcattacctttttccattcaagaaacagtagagacttttgtttacatgatgctattttctcatttttctcccacctttccaacaacctgatcaccttcaaggggttatttttaacacctaggtgcctcccaggatgtaaggcttcaatcattcaatcacctattatgcttctttccattctctcattaggtgatctcatgtatgaatatgcatcaccctcctaatcttatcgttttctcagtgtcagtagcagcctctagccctgagttagccagtagaactttctgcaatgatgaaaatattctctctgcattgtccaatatggtagccactagccacatggctgttgagcatgcaaaatgtggcaagtaaaaaactgaatgagaaactgaatattttattttgacactctaaattccttcaccttaaaaaaaaaagttttgctgtgtactcagctcctgctgctttccatcaccaaagatggaagagagagagattttgaataaaacttactcttactaaagtaaagaaagaaaattctaaacctcagatgcaaactattttttttactttattggatagaaaaatgagtttttaaagtgttactttttaaaatcttagttacaaagcaataggtaatacatttccattttatcctgtaagaataaaataagtatgaaaaaatttattgttaaaagtataacatttattcatttatttgtttaaaaaatatttattgagcacttattatgttcaagggaccatgctaggtgctgggcatcctgcagaaaaataaatgatcatccctgacctcaacacctttaacgtaatggcttcttcccccagctgtctttctttaatggtttaaaatttcaggtttatttcacccttgaaggagaattgaaaacaaaattaagaaaaaaaaagcataaatatttttatcttaaggaaataatggtttaccaagtaaactgtagtacacacttcctctagagcatttttaaaattaaatctgatttttatagcaacattttgcaatgaagaaaatgtaatttcaaaaacagcttcaaaataattcttctaactccctaacataaaataaaattggtataaagaatgacaacaatatgtagattaagaaaaatctgaattgatgtatttcacttttatcaaaatcactacaacaaaactgtatttcagtcatcagaaaatattgcatacactaaataagtgtaaaatatttttggagcccaaatctgatgggataaatagagtacaagattaagtgacaagtagaagaaatagaaatctgtaagagatgattaattattacagaattatattctcaactgattgttcttaagtataaaaagactgagtctgctgtttataaataccacaatgcttccttcattagttatcttcctctcttaaaaaaaaaaagaatatgaggttgattaatcgtgaaggttaggaaacaaatattcttctaggagtttttaaatgtagaactaactcatgattaaaataacagaaaaagtatagtgtcatttatatttaagggatacaatttttgcagagcttttaagagcaagaaatgttttttatcaatttatataaaaatatataaaaacaacatatatccattcagaaaattaaaaaataattattggtggtgtgttcaacaatatgttatcaaatagtaattgtaagctgtaattttcccattaagtagacagacaaaattgattataatggccttttttctcccctaaatattccatattttacatgttctattatacttaaggttttctttataactttgccccaaagtctgcacagctcatctaccacagtatttactctacaggtgccccaaaggacttttttcacagaaatgtgtaataactttcattatgccaacttgaaatggtaaaacggcaggggtacctaaaagatatcctagtaatatttaatgatacatcacaaaataaatatttttaaatgtttgtataaatcattcctacacctatgaaccatttcaggctaatagagacaggtgttgtttatatgtttttgctctaaatatatatatttttaagcccaaagccagaaataatataaacaaaatattttaggatttttgagattcccaatcatagcacatttctgttctcttccttcctacatgaatgtttgctggtttaattttctttatccaaccatctacactatctttcagatatttccaaccccttctttacagactgttccaaattttgttatatattacttgcactgttatcacacagagtatcctctcagaaatggataacccccaagctttctacgaaggtgataataagcttcatttcatgttaattgctttcttgctgattgtcctgtgatatctctagaattaataccattaaatcactacctatcactctattggcataatttggcttaattacttctacatctgttatctttaatactcacattaaaatttattcaacattgtttaagcaactcagacaaatttctccatgaattcctttctctttggctagaaccatttgaaaggatgattgagataacttcctggtaaagagtattgactagaattaggcctatatgtgaaatccaaacacaatattctttttaatttgcactaacatcctggaatcagagtaaagtcttgatcttaaagatcatttttaaaaataggatactggcaatatccgtaggcaccctagtaatatttacaaggatttttctttgctaaggtaaatatttattatttattattttttattattcagatttaatattatttatgatacacaaagtattcaccaaataatgttcttctattgtatgttctaatttaataggaaataatcagctagtgttctgcctgtcttgattccctactgttttttaaaataattcatgtcaacaaatattattagatacctactatgtgtcatatactttgccatttgctgagcatgtaaaaacaaagcagaaacattggaaagcaaatgagtggagcaggagagaatgattacgacaaaaaactgtaatatcttttgaaaggaccatgcaaaggcagccaaggggaaaattccatttttttttagggggtagggaatcaggaaaaaaatggtaagaattctctttttagttaggctctgaaagatatatagaaatctgtaagggacatatggtgaggaaaggtggattacggcattcaagtagagaaaggtgcatgcatgagaaagtgtatcatttgttaaagaaaactgagaaacccaattttgcaataaggaatgaatcaggcatatagagagaggaagatgagtcttgaaaggcagaatgccaagaggctgtgaaagacctgtaggttgtgcctagaaatttggacttgattctctgggcagtgaaagttttaggtacaagagtcacacaatcaggtctctactgaaaaaaaaaaaatcattcgagcacagtgtaagacagatttaatggggagatgctggagggactgatttggagacaatggattataagggttccagacagaaactactgtgggcaacaaataaggcagtagaagttaagaaggagagaaggaggtgaacagatgaggaaaatgtttagaaacaaaaattaataaactttgtagatatatttgggtcggaaaagaagagaataatttcaggagtgtcctaaggagaagaacatatcttgttcatgtttggacccattgtgtagcacaggcatattataggcattcaaatagctgagaatgaatgaatgagttacattcattcttaccattagacatttattaaaagctctatattttcattcgctaattagctcctttggataaccaaaatagaaaagggatttaagtataatcaaatgtttgacaagtaaatttgtacagggtgatttctgaggccatatatctgaaggcttttgggttttatatataagaaaactttagccttcatatatgaggacataattagtttgtactctttgagttgtttttttttattttatagtattagatgtacacagaatattcccataatcttatcaagttaattatttccccatacacaactgtcaatttattaaggaaagtcaggatgacaatctttggtaatcaaaactacacataatttacactagccacactaatgtaaaatacaaataaaatattaaaaggaataaatttaaacaagaaggtgaaagatctctaaaactgtaaagcactgatgaaaaaaattgaagaggacaaaaataatgaaaagacataccatattcatgaattgaaagtaataatactgtgaaaatgaccatactaccaaaagcagtctacatgttcaatacactctctctcaaaataccaatgacattcttcacaaaaatttctaaaaaattttgaatggaaccacaaaagacctcaaatagccaaagctatcttgaccaaaaaaagaacagtgctggaagcattatactaccttacttcaatttaatacaaagctgcagtatccaacatagcatggaaatggcataaaaacagacacgtaacccaatacaacagaatagagaacacagaaataaatccatatatttacagcctactaatgttcaacaaaggcaccagaacatccatgtgagaaaggacaatcttttcaaaaattttgctggaaaaactggatacccatatggaaaataataaaactagacccctactgatatgatttggctgtgtccccacccaaatctcatcttgaattcacatgtgttgtgggaggaacctgatgggaagtaactgaatcatgagggtaagtctttctcatgctgttctgatactgaataattctcacaagatctgatggttttaaaaagagtaattcccctgcacaagctctctctccttgcctgctgccatccacataagacatgacttgctcttccttgccttccaccatgattgtgaggctcccccagcatgtggaactgtaagtccaattaaacctctttcttttgtaaattgcccagtgtcaggtatgtctttattagcagcatgaaaatggatgaatacagcaaattggtaccagtagagtgaggcattgctgaaaagataccccaaaatgtggaagccaatttggaactgagttacaggcagaggttggaacagtttggagggctgataggaaaaatgtgggaaagtttggaacttcgtagagacttgttgaatggctttgacaaaaatgctgatagtgatacgaataataaggtccaggctgaggtggtctcagatggagatgaggaacttcttgggaactggagccaaggtgactcttgttatattttagcaaagaggctggcatcattttgcccctgccctagagatttgtgaaactttgaacttgagagagatgatttagggtatctggtggaagacatttctaagcagcaaagccttcgagaagtgacttagatgctgttaaagcactcagttttgtaaatagagaagagcatacaatttcagaaaatttccaactggacaatgccatagaaaagaaagtcccaatttctgaggagaaattccagctggctgcagaaatttccataagtaatgaggagtcgaatgttaatcaccaagacaatgaggaaaatgtctccagggaatgtcagaggtcttcatggcagcccctgctatcacaggcccagaggcctaagaggaaaaagtggtttcttgggcaggaaccagggtccccatgctgtttgcagcctagggagttggtgccatgcatttcagctgctacaatcatggctgaaagctgctagatttcagaagatgtatggaaactcctggatgtcgaggtagaagtttgctgcaggggaagggctctcatagacaccatctgctagggcagtatggaagagaaatgtggggtgggaaccccccctccacagagtccctactggggcaccacctagtggagctgtgagaagagggccaccatccaccagaccttagaatggtagacccagtgacggcttgcaccatgtgcctggaaaagtagcagacactcaaagccagcctgtgaaagcagccaggaaggaggctgtaccctgagaagccacatggacagagctgcccaagaccatgggaacccacctcttgcatcccactgtgacttggatgtaagagaaggggtcataaaagatcattttggagctttgtctgccccactggatttcagacatgcatgggacctgtagcccctttgttttggccaatttctccatttggaatgactgtatatacccaatgtttgtacccccactctatttaggaagtaagctaacctgcttttggtttcacatgctcataggtggaagggacttgccttgtctcagatgagacattggactgtggactctgagttaatgctgaaatgagttaagactttgggggactgttggggaggcataattggttccaaaatgtgaggatgtgagattggggaggggtcaagggcagaacgatatagtttggctctgtgtccccacccaaatctcatcttgaattcccacatgttgtgggagggacctggtgggagataactcagtcatgggggcaagtcttccccatgttgttctcatgatcgtgaataagtctcatgagatctgatggttttaaaaagagtagttcctgtgcacaagctctctctctttgcctgctgccatccatgtaagacgtgacttgctcttccttgctttctgccatgattgtgaggcttccctagccacgtggaactgtaagtgcaattaaacttctttctttttcaaattgcccagtgtcaggtatgtctttatcagcagtgtgaaaatggactaatacatctaccatatacaatatacaaaaaccaactttatctggaataaagacttaaatggaagacccaaaacaatgacactactagaagaaaacattggagaaacaacacttcaagacattggtctgggcaaagattttatagttaagctcttaaagcagaggcaacaaaagcaaaaatagacaaatgaaactatatcaaactaaaaagtttctgcatagtaaaagaaacaacaaattgaagagacaactggcagaacgggagagaatatttgcaaactattcatctgtcagggactaatatgcagaatatacaatgagctcaaacaactcaacagcaaaaaaataaataatccaatttcaagatgggtaaagtatctgaacagatatttctcaagagatgacatacaaatggcaaacaagcatataaatatgttcaatatcactacttattagataaatggaaatcaaaaccccaatgagatatcatcacaccccagttagaatgggtattctcaaaaagataaaaaataagaaataatgacagggatgccaaaaaaggagaattcttatacagtgtgagtggaaatataaattagtacaggcattatggaacacagtatggatgctcctcaaaaaagtaaagatataactaccatatgattcagcaattccactactgggtatatatctaaaggaaaggaaatcagtaagccaaaaacatatgtgcactgccatgtttattgcagcattattcacaattgccaagatgtggaatcaaactaagtatctattaacagataaataaataaagggaatatggtatttatacacaatagaatactcttcagccataaaaaagaatgaaatctgtcatttatggcaacatggatgagccaggaagaaattatgttaaattaaataagctaggcacacacacaaaataaatactgcatgttctcattcatgtcgaaattgaaaaagttgatcttatgttaagtatagagtagaacagtggtttgaaaggctggagaggatcatggaaggaggtatgggtagaggttggttaagggatgcaaaatcacagctaaataggaaacataagttctagtgttatatagcactgtagggtgactatagttaacgacaattatatattttcaaagagctaaatgagaggattttgaattttcccaacgcaaagaaagggtaaatgtttgaggtgatgaatatgctaattatcctggtttgatcactacatattgtgtaagtgtaaaatagcacaatgtactccagaatatgaacatttgtgtcaattaaaaataataattaaaaacacatatatgtatatatgctttagattaagatatatctatctaccatctctatatctctatctcactgggccatatactaatctcattattgacatgtttttctgattataaacattaaaattatttcatctaccataaaatttccatattatttttacatgttaaactttatttatacctgaaaaggcttatttgatagtaaaagaaaaaaagcctcagaagactgaaattattattctgcattagtgttcttctacgtggtaaaatgatacgttacaatgccccaatactgacaatctgagaggcacaaactaattattttgtgtgtaaccccagccagtttcattcgattagcttcatgaatcagttcaaaaggtgattaattggccctgtttcatattgcagaattaccatcctatttaggatacatggaaagacattgagaaactttaaatttaagtttaatcaccttgtctaaatattaaagagaaataaaaggaagggtaactgacatgcaaaccttctcttagctagaacaatttcctacctgctcttacccagtgatacattctgcacacaatatacaatatcagcagtcaacacctctgcaagtggaatacagaaactgccacttctgcttaactagttggagtgatgtgacaaggattagttatgcgtgagagggtatcagtagacccatgtggtctcaaaataatgactttccttcttaccctgaaatcaaatcatcttagctgggaatgattaaaaatatttaattattgctttgaaatcaagtatgttatttggttctacttttttcactattgtgtcatatttttaactataattttaagaacctcacaaaaaatattggtataattccatatatactgtaaacagatttatttctgagaccagaagctctcttttttatgggtaagtaaatatttgcaagcatggttccattccggtagaatcattttgcagtcatttgttttgtttgttgttcattatttttgttttatacatttgtaaacaggtaagaacagatttttttcatagcaattatgaaattaatacttagacattttaacatgggagtgccagtttagctgcctgagaaccaataaagaatttaatttcctattctcattttcacatttcatggatcgtagtttcaaaggagttctaattataagagtaccaatgtctgtcaattagtaattcaatttgacatagctagaagtacattatatattttaagcaactatgtcagttttctagagtgaaacttcgagcctattgaccccaaataagttttgttacctacaaagtttaaactgtttctttcccacaaaacaaatggtggtcaattaataatgacttttgaaaacagcaacaatgatttacatatagtcggcactcaaaactatttgttttaatcaaagatcataaaggttttgcaatctatttagaaagggaaacatcacacacacacacacacacacacacacacacacaccccttagaaactaacacagtacaaattgacagtcaaagacaatcagaaatattataatacaacgatagtaaaactctgctcttgcctagttctgccaacatctacctatgtgagattttccaagccacacacttgaaataaatgtaaagtgaagcggacagaattacaatattgaagaattagcccaggaggctaggaaataagataccttggttagcagtccagcatttatataattctctctagacttgtttcccgattttaaaaggagggttgaacaaaatgacctcctaggtcttttccatctcaagaatgataaattttcatgaagagaccaagaccaatggcataatcaaaattgctaaagttaagccctgacaacttcctaagtttgattttacttaaaatttgctgaagaaggcaaatatgaataaatgaaagggaaagcgaacagtcatggtcacagcgcacctctttgctgaatggatgaggaagcagaatcagaatgacaatgataatctatattttcatatctctgtataatttacaaagtgttttcctacaaaatatacacacacctattttagcctaaaataactatttaaaaaacttagtaagcaaattacctaggatcactaaagcatatgaaaattggagccaaatttcaaagcaaagcgtttatagtctagccttgctgttaaccatagtagctgtgactcaaatcagtacctttttctccacttcctattttcttgctcctcaaagcttcattacctccctaaccaatatatttttgtgctttccaccatttatacctaaagtagtcatcccctggctatgtgtctcaaatattgacatacatccattttattgtcctcttttccccatccacagtctattctctaacctagtttgctacaaacaaacttcgaatgttaagtggaatttcaaatagaagaaatacttgaagttcttctatttgaaattctatttaacattcaaaagtaacacaatagctaataagttaagctctgtgttctgacggcaaataataaaaaactttaagtgagactagatataagaaccagagccaccaatttctacacatcctgaaagcatcttaaaattttgcaagacactttactgttttaaatcaatgtgttttacaccaatattcaagaaactattattattcaactttaaaagcttaaaatcataattataattccaacagtagtgacttttgttgtattattccatcttcattaaacataaaattactgttgacccttgaacaacacaggtttgaactgcatgggtccacttatacgtggattctcctcaaccaaatgtggattgaaaatactgtatttgcaagatttgaaacccaaatatatgaaggaccaacttttgtatatacttggtgatatggtttggctctgtgtccccacccaaatatcttcttgtagcttccaaaattcccatgttgtggaagggacctggtgggagatgactgaatcacgggagtgggtctttcctgtgctgttcttatgatagtgaatgggtctcatgagatctggtggttttaaaaatgagagtttctctgcactagctctcttagcctgctgccatccaagtaagatatgacttgctcctacttgccttctgccatgattgtgaggcctccacagccatgtggaactgtaagtccaataaacctctttcttttgtaaattgcccagtctcagttatgtctttatcagcaggtgaaaatggactaatgcagtacattggtaccagtagagtggggcactgcagaaaagataccccaaaatgtggaagccaatttggaaccaggcaacaggcagaggtttgaacaggttagagggctgaaaagacagcaaaatgtgggaaagtttggaacttcctagagaattgttgaatggctttgacaaaaatgctgagagtgatatgaacaataaagttcaggctgaggtggtttcagatggagatgaacttgttcagaactgtagcaaaggtgactcttgttatgttttagcaaagagactggcaggattttgcccctgccctagagatttgtggaactttgaacttgagataaatgatttagggtatctggcggaagacatatctaagcaacaaaacattcaaaatgtgacttgggtgttgtcaagggcattcagtttcaaaaggaaaacagagtataaaagtttggaaaatttgcaacctgaaaatgcagtagaaaagaaaatcccatattctgaagagaaattcaagctggctgcagaaatttgcataagtaatgaggagccgaatgttaatcaccaagacaatggggaaaatgtctccagtgcaagtcagagacctctgcagcagccccttccatcacaggcccagaggcttgagaggaaaaagtggtttcatgggccaggcccagagtccctatgctgtgtacagcctagagatttggtgccctgcatcccaggttggcccctttcagctgttccagatgtggctgaagggccaacatagagctcaggctgtgacttcagagggtgcaagccttaggccttggcagcttccatgtgatgttgagcccgccagtgcacataagtcaagaattgagattggggaacctctgcctagatttcagaagatgtatggaaatgcctggatgcccaggcagaagtttgctgtagaggtgggatgctcatggagaacctctgctagggcaatgcagaagggaaatgtggggtggaatcctccacacacagttcctactggggcaccacctagtggagctgtgagaagagggccaccgtcctccagaccccagaatggtagatctgctgacagcttgcactgtgcacctggaaaaactgcagatgctcaacacccgcccatgaaagcagctggaaggaggctgtatcctgcaaagccataagggcagagctgttcaagaccattggaatctacctcttgcatcagcatgacctggatgtgagacatggagtcaaaggagatcattttaaagctgtaagatttgactgccctgctggattctggatatgcctgggtcctgtagcccctttgttttggccaatttctcccatttgggatggctgtatttacccaattcctgtacccccattgtatctaggaagtgactaacttgcttttgattttacaggctcataggcagaaggtacttgccttgtctcaggtgagacgttggactgtgaacttttgagttaaggctgaaacgagttaaggctttgggggactgttgggaaaacatgaatggttttgaaatgtgaggacatgagatttgggaggggccaggggtggaatgatatggtttggctctgtgtccccacccaaatctcattttgtacctcccataattcccatgcactgtgggagggacccggtggaagatgattgaatcatggggtgagctgttcttgtaacagcaaatgggtctcacacaatctgatggttttaaaaatgggagtttctctgcacaagctctctcttagcctgccgccatccacataaaatatgacttgcccctccttgctttccaccatgattgtgaggcctccccagccatgtggaactgtaagtccaataaacttctttattttgtaaattgtcccgtctcaggtatatctttatcagcagtgtgaaaacagactaatacactcagtttctcaaggctgacttcaggacctggtatatgcacattttggtatttcacgagagtggtagaaccaatgctgggagtatatcctaggagaaccgtactttttttgtgggcaagactgaaaactgtcagttcaaaggagaattataaacatccagcagaattcaaaattcaacacaaccatttgaacaggacaggatatatttcctttataagttatctgccacattaccaatttacaaatacaattattcaatgattacaaattgttcccttattaggaaaaaaattatcttctctctgtatcagtaggccattgttgatttgtagactgctatggggatcaatcaaatcttatttttctaaaatgttaactgtgtttcaatatttaatatttcaaaaggtgaatcaaaagaaatcaaatatccaagaaatagatttctttctttatatcatttaactcactaaaaagaagtgattttcaaaatctacatataatacagtgatggtatttttcaactactaaacatctgaataatctgattgctaaaaatagtatcctttcagtatttatagacataacataaaataatcttttaaatgtttagggccaaaaatacttcaaagttttctcacataatgaaaccattatgaaatttctacatttgaatgtctctttcaaaaacatagttttataagattaggcacttagaactacttaggacaaatttaaatggatttatatttctacactaactgtaaacttccttttcagtctatgtcctgataatgatgcatctgctacatatatattactggaactctttgaatgtcattgctagttcagagaaatgtgattgtcactttttagtggctgttctaaaaagatattatgtcttgcgttccaacagtatgcttagcaccataaaaagctttttgaattctcttatttcctcaataactgcacaggtaaatctcttacagctattcatgatattactgatattactgttttttaattttttggagagtactacctcaaatttgagaccaaacagtatatttttttaacaatatgcacacattcagatttttcaatgccttccaaaattctagtgtgatcatgcatacttaatctttttttccacaacaatttccaacactacaatggaccagtctcatggtttttggcacatcctgcacctattcctgtttctaaaatattccctatgctcctcttttcggatggaacatcagttatctttagctctttagctctaattattaatactgtattattctaagttaagtcaaactgaacttttcaaaaccttcagaagactatagcacatagtaatcctgaaattctctgaaaattctattgtacatacagtcttcaatatcacataagttcacaatatattttttttaaatgtccggtttgtctgttatacacctacaagtagattataaatttctggtgaataaaggcaaagactgctaattcattatttgttgtcacccatacccaaccaagatataattagctgtaagccctcatactgcttcaaataaagtaaagattatgttcttacaacacatctatctggaaaatagtgccagcctctctgtgcttcttcacccagtaactggcctatcatcattagctttgaggtgaaaaaaaaatacgtgccttatttgaggaacctattttctgcttactccaactacgtgattaaaataaggattgcctatcataggaccaactcctcccagccacacatacagttttacaatgagacctgggccaatcagagaccttctctgaggttttccaaattggaattaagggaagaagagaaccttattctttgaatggcaaagttaagaagatatgagactggaagatgttggcagctattgtccaactttgtagagttaatctgtgagaataacactaacacatggtgaaaagcatagatagatgagaaggaagaagagtggtttctggattttctagttcctgtttcagttatttctgaggtcccgaaatgtctttgcccgttattagctgggtaacttcaaccctttgggggaatatacactaaagggctaacaatctaaaagaagagattatggattatctcaatgtatttcttttttattgtggtcttttcctaaatttaattcaaggaacatttctttaaaaagaagcagataccaataaaagctatcaattaacatgtaaattacattactatttataagtaaaatagtgtaatagatcaaactaatactctttcctacaactaacctagatgctttataaagtatggaaagacaagaaaatactacacaggacctagacaagaataacaacattcatgtgaatctttgctatgattaacataactcaaacatgagagagaatgagggcaactactttgccttcaacccaatgttttggctagagacatatttcacaaagaaaatatgattgaagtggtgcctttgtctgtaacagtaaccttcattcttgaatcaaaattaatatcttacaatccatttcatattggagaaatgttctaactggtttttagaaatattttattacttaaatagtattgtgctcattgtctatgttcatcaacaaacttctaagaaagagactctttgcagagtctttagcctttaatcttaaaatatccctgccaactagacaaatagaaatccattaatacagaaatacaataatctactataattaagaaattgtccaaaatattcttgcaattgctattactatgattactacaaccaataaatcgagatctctgcaacattgaaaattaagtatgatctatccaatgccttcaattttactttctagagcagtcctttcttatccatctgtgcaaagaaacaacctagcttattttagtggataagaccagattgtttttaaaatctgttactataatataaatgaaaacgcacaactttctaaaaataatctattcctttttgcacttattgctgttgttattagttctggaacaaaaatcataaagaagattcaaagttacattttgcatatgtaaattattttgcaggtaatttgttaatgctaataacactgctatagtatatttaataataattgttttctgttttgatgacagccaaaagcaaatctagattatatttaccaaattatccagtcagttaacaagaaaatgaaaggttttaacacctgttgtttgtcacctcctctgactcaaattaggggcaatgtcacaagtacttgaaactctctcatacttaagtaagtaacatctattttctgtaataaaaattaggaaatccatttgtaaatcaactatcattttataactagttgtaacttattaaatatttaatcatgcaaaatccaacacgtcatcaatcaaatatgttcaacataaattaatagtgttcatgcttctcaattgtggtttgttcaataaatgagtatagtacattataaaatgtgtatctataaatattctttattattcaactttcctactaaaaggaagagacccaggagagagaggacgctaaaatgcactgaaacctaaaatatattggcacaacaaccttttaccatagacgttattatctccatttacaattagggaaatagaggctcaagaaatgtaaataaattgcccccaattgcacagctagaaagtaatatagcttatttgaatccagatgtacgtggctcttaagcctttcttttcttttttgctattgcttcctgacttctcatactccttacaaatagacagataataaaaagttattaagcaatttgagatgttttgagttccatattaaaaaaaaaacctaccttaagtaattcttaatgaaggcaaatgcagagaggtagaaagtatataattggaaagagcggtacttctcaaactatctacacgtaaaggaatagtttgttttagtttgaaactgctactctacaacactttttaaatatagtaaaaataaattactagaaaaaatgtcatgtgtttgcatgttataacaatgtcaaacttatataaaatttcctaaatagtctcaattttagtacttatatcatagaagagcagcaccaatctgtggtccatactttcagtaatactgagctatatgatgaatgagaataagccaataatgttaacgtatattaacttgtatattaaaagtatattatgcatctagcttttattgaaataaaaagtgattcctatcccccaaacaattgttgcaaattcttcttacttcattaagctgctgttcatgctaatttagtatgaaaaaacacaaaggtctgtttaagaaagttgaatatagaataaaatgtatactgtcttaataaaccaggtagagagaaaaaatggagacctgtcaattctgatgatgttcatttttgttttgattttatatatattattgttaataagcattaacattgctaattaattttgaatatggtttattattattctgtagttaaaatcatttcatctttctgacaggctcgggggtgtgaattattcttactgaatatattgataatcactgcaatgggaaaataagatgactactgttgtctttatcctttctgtcaaagctggcacataaaaagaggtttccacacttgccattttccaaaacatggcagcagttcataatacatccctaactgcattttgacaaagtgaaaatttgttttacatcataagatctgggcaatgattctaggaaaaaagtgccaattaaatgaagaaaacagaaaaacatgaaatagatttttcccatagcatagtaagtagctttgtatatcatactacataacaacactgtgattcaatttttaattttctttttcaaatgttactaaccatagagtatactttaacaacaatgcatatggtaatgagatcagtatttactggttaccttaaataattatccattttttataactttggaataaaactatcttattaattttggtatatggataaaactacagcttactgatattggaatcttcatttatttcatattttctttttctcagagttcataagatatctaatatgagtttatggtaaagttttgaattaaccaaatagcatccatcaaaatctatgcagagctatattatgaaaataacctttcatgacaacatgaaatttaaccattatatgttttaatatccatattaatcctgaataggaaaaaaggtggctttgacaagtacttcataatagctaacaaaattcaaccaattgtagaaaattccttaaaattatactttgatagtgaaatacaatattaaagtttgaaaatcataaaatagataacgaacacttttttcagttattttgtagatgacactatttccacttgattgtcccaaataaagaaaatagtaaatttgagatgatacagaagccaattaatggaccaatatgactcaaaaaatacaggcaaaatagtgatttttttttttttagtatttgctcagtgatgtcacaaatatggtactttgcaaataggggtccagtaaatgattgtttaattgaaacattttaatataggaggcataaacgagtaataaggttcaaagtagctattttctggttactgaagtgacactgactgtgcctgtctcacactggtattaacttcatattgtgttggcagagaaaagctttaactgatgttagtattactgaaatggccagcatggtatggtattagtatgtctcagaagccaaaaaaataacgtggcacagaaacaacttgtcccaagcttcaaggggggcatgggctttggagacctgtattctgtattaaaggcttctatgaataaactttctgagagtcttgaggttcctgaaggttttgtccttgtcttgctcctcctctccgtctttttgacccactcatctactttataatttccacatccacaagactctctagccttagtctctcctaacacagtcaagttcttatgttgggtaggcatttccaatagaatactccagagatatcttaaaataaacttgccaaaacataaactaatcaccatttcctgacacccggccattcttttttttttttttttttgtcaagacaaggtcttgctctattgtccttcaacctcctgatgggctcaaggattcctagcagctcagcctccagagtagcagggaccactggctcacacctccatgcccagctattggtctcaaactcctggccttaaaaggtcctcccgcttaggctttcccaaactgctggaatcacaggtttgagccaccacaatgggaccattctccatcttatagcctctatttctgttggttgcgtcaatatcacctaagccctcaagtagaaagcttacaaatctcaattcttctttcttcatagtctacatctccaacttactactagcacctctagctatgccagctttatagacaggcaacctgtgcagtcacacagagtcccttgcttggaagggtccagtgcttctctgtgctctcagttgttctctgctctgcagtcatcatgaatcacttcttaacaagaagctctgcattttcttgcacgaggccctgcaaattacagagccagtcccgtctcccatgtccttcatcctctgtaaaatatgtgttagcctctaatcatgccattaaatttctcacttccctatctttgtgttcattttccctctgctgagaatgttccatttgctgatcaaatcctcaaatacacatttctggtgccacctcctccagcaagccttctctgcataattaagctaggttaagcactcacataataattctatcatttcaattataagaatatgctattattacctactcatgaatctctttcattctatgaggggaagaagtaggaattatttcacaactaagctagtgacatgcaaaaaacacacaattatgtgttattgtatgaatgaataacatgatgaaaaaataatataactctgctattaagtcttatgaattagaacaaaagttattggggttttattttttatttaaaagaaaataataataataattgtattaccaattctatatcctaaacagttttggtatctatccacttctccctagtcccttctttacccttactcagtccaatcactttcatctctgaactatattattgtaatggactctcttgccttcccccagtcctttccccacaatacagcaagagggatcttttgaaatacaaatcagactgtgtacccatagcaattattctttgcctatatcctccatatttcagcttaaatattacttcctcagtgatgcctggaaaagttacttagccccataaattaaaacatgccacatccccaccaaacacacatacatactctctctctctctctctgtcacacacacacacacacacacacacctttaatgactttcattgcattttctctttttaacatttagctgactttgtaatttataaatttaataacttaataaagtttgtctccctcactagagcaaaaactttaagttaggaattatgtctacttggcttgctattctatcactagtatacctagcagatagtaggtgtcaaaaaacattttgtcaaattaatgtgcatagcagtattaggtaaacacacggcatagaaattttaaaaaactcaaaaatgtacatatcctgatgtcaaaatattattctctctaccctcttcaatataatggtttatgttggttatactgattcatggtacttcatattgcattgaatgaaactgcaactattttaggtatttctgaagatttctaaaaattattaggtagtgtctttgtttagattgtatgtctcagtttttccctgaagacgctattgagcagatgagaatttaagggaactaatgccaaaggtaccaaacaaaactttatgaagagtaaatactactttcctcatatatacattaacacaaattaaaaagttttataactatgcaactgggatccataaaaatattttcctatatcaaactgggcttcaaacattatttttaagtatataccctcaagacagccacttgagcatacaataactcttgcatcatcacgaagcaaaaccaaaagacaataccactctagcagtctatatagaattatgaagatcttattaactatttttagcttctgttcttttcataatggcctttggaacattgattcttccacattctaactgcctaagcgtcagtttcctcatctataaaatggtatagtaatggtacccacatcatagtgtaattaaaaagattaaatgaaatgatctatgtgaaacacttagcataatgtttgccaacttgtgagtatccaataaatctgaacaataataactactcaaaacttcattagggtctagaaatcacagaaatagaaataaaaatgacaaagtagtacaaaggtctagctggaaggcaaaactcaaagattaaagagtgtctgtgtctgtcaggcagttttactggttctcattagctactttctggcacgtttttcttcctatacttctgccactttgatagccaggcaaaattacacctccaatgtaatcagataaggaatgcgaaaggaaccgttacaattaatctgactgaaaagtagacatggacgataaatgtgcagtacaccctcaggaccacaaacactttacatttatctgtatttatccacatgtcaattaaggaaccaacttgctgtaagtcttttaataagaagtattcatttccaactaaagttgccaaattcctataattcaaatctgtatttgctggtgacttttaaatgataagaaaacatgtttttaaaagcaatgttcccttcttgaatatttccactttattgcttttgaatcgctcaagttgaaatgagacaattaaatgctgtgtctttttttgttcagaggcgagatgaaggtaatttgctgcttcatgcatctgtttcctcatcagcacagtgaggactaggctaattaggggatgaaaacaatatggtcatatggataggccagattgcttgtcactcagttattcaatatgtgggctctgttttgaggacaggaaacagataatgattctctggcatctctcttgcaatgtgtgaaaagaaagaacagggaagtgttcagatgtttacctgcttatttttagccttcatcctagaaataatcttattgggctgtgtcattcattttgtctttacaagaataatctttattagaaagctttgaccatggccagtaacatccaaagagaatgcaagaacccaatcaactaacttgagttctgttcaactcattcaagttcattattctgtaatattctatgggccagaaaaattttgtccaaacacaagtaaatgtgccccaatttcagaaagtctaatttacctaaatagatttagcaagaaaaaaattaacatttgaaagtatgagattaattacagagcttgtaccaggcatgttttctggtaccagtctgtcctcagtcatttataacggggagaattcagactcaaggacagcctttcccaggcctggcttggaaaggtgaattagtacaactagattctctttcagctatttgaactacgaaatcccaaagaaagttgaaaatatgcattgagagtttcataggtaagcacaagcaaaagttatgaataaatataaaatataagtgagcgagagtattcagtgatagaagtctagaacagatgcacagaaataagcagaaacattctgagacagagagagagatgaggaaagggaaagaacaattcctatttctgaaagctttaggttcccattgtcctgaaagttccaggtccctgatgccaggaagcctataaatatcagttccaatgggcctgaccattctggatgccctatctttgaattttccagagaccactgtctctcttattaataatatcataacctaaatgccaccaagacctccaactggataaggtcaccagtttctcaaaagataagtaaaaactggctgacataccttcatctcaaatattgtcagagactctgcatctctccccaaatctccaaagatgagtttgtgggcaggaatgatgatttagcttgtcttcttcagctctggctttgggttcccacttttcctacattctctaactgcaccctaaatttcacttacagcattgctatgcttttgttgtatcattattgccccactgggcactatgccaagcccttcattccacaaagtgtcatatatttagggatgtttgtatggctgactctattaaaatctggaaccagaatgattgttacattacagccaataacttcaatgccaggcatccctattcttaaaatttctcagtcattcttatcataaaggaacttctattcattatcttctctacttaagccccatcttcctgccatgttgacagactccctttatctcccctgattgcctctttaaagcccccaattccttatagatctcttagagctacctctttctctctctttctctttctctttctcatagccacccaggctatgaccagggcatcctatacttgtaaaccatgaaggataccaattaaaccatgctctgaaacatagtaccttgtacccccaagaggacttcttaatttgcaatttaagaaaagcaactttttataaacacaagagcacccaatattgagtacttactgtgcgccgagcactacgcttgaaagtcattaactcattaaattcctctctctctcttagtatgaaggttctattaacatccctactttaatgattaaaatttgtgtgcagctcacaatattaggaagtaacagcatctgaactagaaccaaaatatccactcacaatcaccgtaattctgcctgtctggttgccctacatgtaacattacaacaaagctgtgtgctgatgatagaaaatgcatttaaaatttatctgagatatatgtttggtggaaaccattagctctaaaactggcaagagactagaattgaaagaggtagcacacagagaggttctgatgaaagtgaatgtcattttaacagaggacttcatgatgattgctgcctaatggtaggtcatggcctcacaaagaaaatctccaatgtacattcctgcatttatgataattctacttttttctgttatgttgacaaacaaaaaaaagtcctatacgtatttcttcatatttgaacttctcaattaaagcaccattaaattctcacttttaactcttgtgggaattaattattacttagatgaagaacttattttcaactctgtctctaggcaagtgaacaacctcaaaggaagatggtacttaaaatacctgataacaatttataaaaaatattttatctattcaataaaatatgacatttcattgaacatctatgtaaaacaaagactcctgttacttgtgaaattggaccttattaatatatgtatactatcaagtacactttactggaaagaaacagtatgtaaaaagcttggcacattgaaaaaaccaaaaagaggccagtgtggctgtagcacaggaaagaggagcaaaagaaagataagaaggcaccagattatggatgcaaggctttctcggccacgatggagattttggatactgtttaaagaaacaaatataaaacttctaaggatagcttgatagtattttccttgagtcttgaaataagaactaaagagctactctattcttatcccagccattcaaagatagtgcctccttatataatgtgtgccatgcagcatgtaagtatcatgtctgtgaattgaattgtagtgtgctgttgcttgtgccaatagcagggagacaccgcagcaaggcaaacaagcaagccatatgtgctgttggcaacattgacacactgtacagttatggcatatgccttgagtatctcaaaattatgttgttggtagtttcattgctatatttgattatgtatttaagtttatttgaaggcttttaaaaggaaatgatttcacactactaatcttatgattatgcacttagcagctaataacaatgtgctatttgctggaaggaatatatgtttgtagacaagtttcctgaattagctttttaatttacataaacataattgccctctcaattttaaagcctttaaaattttgtcattttgaacaaaatttagtatgctgatgtaaagtcactttaaacatctattctaaaaccttgactaatgttggattaagtgtacatgtgtgcatacaacacatatatacatataaatacacatgtgagttataggtattgtattatatatctctttatatcacatttatgttatagaatatatctgtaaattacatacaacaaattatatcatatatgttatatatgtaagttatatatacatctttaagttatagatatatatctcatacacacacatacatgactttgtatacccatatatatgaatgctttttgaaagcagcttttaatgcattagtatgttaaacatcttccaaaggtacaatttgctcattattttatttaaaaaatcactctatgcaaattttataccaaaggataaattctaaacagaaagcacaaagaggggtactttttaatcctagcataaagagattctagtagaacatttctttctttctctgccaaataaaacaaatgagaagctctaaaagaagtcactgacccttgaatcaaattccaatttctctaataccaagtatgtgaccaatgggaaatgtaccccttgagctccaatcttttcaacgctaaaacaacaatatatttgcaaagctgcagtaagattaaaggagataatgcctgacacccagaagaagcacaacaaatactaattttcttctcatctagtttggaaaatgtcttcagcagcattccacaaaaaagtattcatagcaatgtttctcaaagatgaagtacccacaaacaatacctgcaaaccgttgcagagctgtaaagtatttaaagaaagctgaaaaaattacattttcatccatatatttccagattgacatattgcatgtttaaaagagttcagcaccagcaaattacacttagctatttagagagttattgcttttaagtcttctctatacagcaggcctggtaatggtagcagcaattgagtcttgtgcacccaaaatgtaaacctaagttaataaggcaatggcacacatcccacttctctataaacagtctggagatttactcttcagtttaggtacatttctttgaacatttagagtaaatttcaaactgtgttgacactgaccacactacagactttcaattcataagcatgttggtaaataagatgtgcttcacttgcaaatgatcgaatgctggctgagctaaatttaaaaacccaaatcaaaaacaaaccaacaaaaactcccaccatgccgctgattgaatgtgttaaagtctgcagaaataaatccacaactgagttttcttaggaaatagaatacttcttcagctactgagagaatatgaataagggtttgaaataagaggaaatgtggtatatcaatcagccataacttccacaatttggatagtattttagaattattttaaaatctttaatctcatttgattcttgccaacatcctgagatgaattttattattttacaaatgaaaacctgagactccaaaaggtttagtaacactttggggattatgcaaggtaaataaaccttaggagaaatttaacaagatacttgtagttagaaggaagtaaaatatttaactcaacttctttgtttgtttgtttgttttctgagacgaagacttgctctgttgccaggctggagtgcagtggtgctatctcagctcactgcaacctctatctcctgggttcaagggattcccctgcctcagcctcttgagtagctgggactataggcatgggtcaccatgcccggcaaatttttctttttttgtattttaatagaaatagggtttcaccatgttggccaggatggcctcgatctcctgacctagtgatctgcccgcctcagcctcccaaagtgctgggactacaggcgtgaaccactgtgcccactcccttgttattttttgacaacttaaaaatttgattaggattagataggtactagaataagcaccttctgtttcccagcctagcattcttgccaccatatagttctgccttgtgagcagatagatagaacaggatgaatggccagagaggccaatcatttccctactctcagtgagcttaaaacaaaaagacaggtacccacagagtgaccacttaacccactcaactctcaaagcaaaggtcgtaccatctgctgagcttctatccctgtcttcctgtgaaattcactggaacagatgactgacgtgatgctctcagtgctcataatttttgcaggaggaaaattaaacagataattaagtaaagagcattcaggattcataagtattgttgattacattttagaggtgaatccacatcaatcagaggtaattctcactgaatttccctttttacaatacttctttttatctaaagaaaagttatctggagtgtcttttcctaatgttagacttttttgacattaagtttttaaaaacctcataagtgctaaggacgctttctaaatttcttacgtatttgtacctagtaaatgaagttcttaactaaaatatttcagacccaatagccaatgctccacatttctccatagaaagtatctatatagttcagaaactaaatgttttctcttctctttgtctaaagagaatatcttgatttaggcctttaactccttctggaactctttcaagaagcctcacccattgactctttctaaatctgctattaatttcaaaagcatagaatctaatcttgtcatcatggtcttttttttgagactgagtcttgctctattgcccaggctggagtgcagtggcgcgatctcagctcactgcaagctccgccttcagggttcacgccattctcctgcctcagcctcccgagtagctgggactacaagcgcctgcaaccacgcccctctaatttttttaatttttaatagagacggagtttcaccgtgttagccagcatggtctccatctcctgacctcgtgatccgcccacctcggcctcccaaagtgttaggattacaggcatgagccaccgcgcctgacctgtcatcatgttctttaaacacttttcagttgcttctggagaggtattaatgttcttttacatttttctatacatatgctgtatttcaatgaaaaaaaagctaaaaataaaaactcagtgttctaaatcccagttgtgacttctggaccatcacttgaaaccttctataaaatacttgtttcatttaactaagtgaagggacaataatagaacgtaatctaaagttcagtcttccctaaactcaaagtaagatttgcttgtggatagtagttacttcctctccttgcatgaaccaagttgcttgtattttctctaatctttttatgagttacccgttcacatatataatagaatctagaaaaaatagaacatttattgtaaggtgaacatataagattgtcagaaagcatcaatattttgaggttactctttaaatgaaaggaatgcatcttttgttgctatcttaatttttcaaatcagctactcaaattctcttttctgattccacagagaaaatcatttttaataaggtaaaaaggtttttaaaatagtgttgtacataataaaagttatttgactaaaacaaacaaacaaaaacctcagtgtctcctttgactggaaaataaaagaaaactgccttggcattgcttcaaaggctttttaaggttaggcctacctcaccctttccatctttatctctgtctccttcctactcacacgacccacacgcctcaagtattctggtaacactaaaccatttactgtttctaaaacttcattttcacccctcctggacttcatttctttcacatgctgcccctgctgcctggaatgttgtggtggcccctgccttttcccagggctccttccacccacaactcttagaacatgactcgttggaccaaataaccacatagtgctccctttctctggccacagtgacaattccagagatgtgcacatcatcaaagtacagccttctgaggtcctgctccaatattttatcctagagggaacaggaaagctataagattacgatttcattaacagtaaaaccagagaataaagatgagccagaaagcagcagagaaagaaacagcgaccattttagtagcagcaagactctgattccagtcaccggagttccaggaaataccctattttctatagttttttttcttcaattctattagctccacatcacctgccctgggaagccctctctgaccatctttatttccagttctttacaaaggtagagtcagtccctgctctgtatcactatgcctctctcataaataacacaaaactgaagttatttgttttacttttctacattctcaactagaaatataaactcttggaaggcatgcattaatgtcaggcctaatgtatcctttgttcttagcacacaagagaaggctgaacagctacggaatgaattgtcaaaatgaactaaccagaaagagaatatagaaactggatgacagcagcagtaagtgaagacagcaggggaatttcaagtactccaagatgaatatgtcagtaataacatggtgctgttaaaaaatttattataaaaactacaatagttttcatttaaccagcacattatcttagcccactcaggctgctataacaaaaaataccataaactgggtggtttacaaacaaataagtttattattatttctcagagctgtgtatgccgggaagttcaaggtcaaggtacctgcagatttagggtccagtaagggctttctcataggtggcaccttctcactgtgtcctcacatgctgaaaggtgcaaggtacctctctggggcctcttttataaaggcactaatcctattcatgaggactccatgctcatgaccaaaccacctctcaaaaggccccatctcctaataccactgcctcagtaattaggttttcaacatatatattggggtgggagacctcaacattaaggccacagcatacgtgatgagaaagaacatgccagtaatcacactactactcaagaaacattggcccttaaaattgcacaacagtttggcagtttggaaactttatggggatggtggaaaaacaaaagcaaatattaagaaaaaacatgcaaacaaaataagggaggtataataataataaagagataaaaacaaaacttttaggacattaaagtaactgggggtgtataacttggtaaaatgaggggagaaggagagattacaaaaaacataaaacacatgaagctaaaatatctacagtaaaaaggcagataatgcaagatttttattagaactaaagtaaaatctttaggtcataatgcacggaaaatcaatatttctcaaataaggcgggggaggtggcatctatgagctttcaatataaataatgttgtatttgttttcatgttcagggtaatctgaataatcaataagagcatcattactctaagttttaattaagtttgccccacacttcagggactgaatttgcagctcccattgcctctaggtagtaccttttttactgtaatgtattaatgataaaagaaaagtaggagttctaagacacagataaatttgaaccaagtaaaatggggatgaaaagcacattataaaaaacgtgtagtattctggatggagaaagtggtgggaaaacaaatcatctcagggcagacagaaatataaacacaacagagtgaaatccaaagactctgggtctatggcagtcaggaccacagttaccttgtaagcagcaatttggtttcagaaaaataacactactgctttaaagtacagatgttcttttgtattctgttggttttattattttatttgaaagctataatacatttataattagctttttaagttatactactacattaaaaataacattttaaaacacaagatcttaaaacaatagtacagagaagaaataactccccactttggttttgcacattttccttctgaagtttttactgttactcatgtttgtgaaaaatatctcttaagcatttttttaaaataccatgggactagaggcaactactaaattagataatcccttgatatttcttttaattctctgattctacaaagacagtactgtgccagaaatgcttggtttgctttgactggggagagggaggcaagggattgtaacagcattaaatattctgtttaaagctgtaattcagtaatataaaacatgtcctaattatatattgtaatattttatataccaaataatttttccatttctatttccctgaagtttagaataaataaaaaataacttttatgtcttatctcatggaaaaacactataaaatccttatcagaatataaaattcactttagcaaacttttttttataggaaggaaacttaaaatggggaggtgcgacaaataaaaaattaagttttaaaagttctgtacagacagagctgaaacaccatagagaagaagaaattaacatttactacactcccaccaggttaggcatgtattttttttttttcaaaaattcagcaaatatgtgttgagaacctatatgtggctgcaatattccaagaactaggaatgcaactgtgaatataatccatattacatgccatcaaagaaatgagaggctaaaggaagaacgagagaaataacaaatgtctatttgctataatagcataaaagaggagcaccaaaaagtgcagtctaaaatatcaagcattgagcttagcctaccttattctctaccctcacaaacaccttgtgatgtggatactgttattccagttttactgatgagaaaattatgatgtatttgtcttaaatcatgactttgctccacttactttctagcttcctcaaatttttcatactttgtgtctctaattagtggcttctatatttttcactttgctcaataacacgtgctctcttctcagccaagttcattggaaaagaaacctgcattttgtcaagttgctcacctccaaatcagtcctctgaaatgtggcttctaaccctaccatttcacctgaattgctcccagttcactgataacctccaaacctccaaactctatggatgatatctaattttaattcttcttgccctctctgtgctatttgaccctttgaatcactccttttatccctttgaatgtgtgacccttggaatcaccatttgcaactcctctcttggcttcttgaataccactctgctttgctttttttcctacctattttcacttttttctaagtttcctcgctcctctctctctctctctctctctctcctctctctcacaatatgctaaaaataacattggccttttaattatagtcatccctctagttttaacctctatagtctgtcatccatattgttgtaaaaatgattttctaaatcacaaatctcatcaggtcacttcttcactaatgcctgggaatagtttgtgatctaacagaaataatttgtagacactatacttcaaggcaccctagcaaattgcagtcaagatttgggttacaaaggatagagactgactctggttaactagagcagacaaaaaatttattagaatgttaccaggtatctcaccaaatgaacagtaagtttggacaaccaagctccaacaagaatcaaaggaggcaaggccaaaattcctaccacagaaatactctctgcttataattaccccattgttacaatggtcactggacaccgatgacctcatgaacagctgttcactaccttgtctctaaactcttgagttcattgcaaatatattgaaaaatctctactgaaccttcccacttgtggtcactccctcaaactgtaagtctcagcaggaggatctaactggtcagcaagagagagagggaataacttcccacttcgccattcatactagatggccagaacctgccacctaccttttttaggataccccccaaagaagaattgcatttgtatggtaggcaattgataaaagttaattgcacattcccatatggctcaaccaaattaagtactctaaagctaaagaaaaaagaaaaggcattcagaagtttaaagaaataatagttaagtataaaataagacagaattggcacaaatgaccttttccccttatatcccacacgtagatctgacgcccatgaagatattttcttaagagtagatggaacttgtgagagatatcgtattaccaacccaacatgacttgcttttccctgtcagctcattcttagttgttttcttgtcctcataggtaacaaggcttgaggctcaattaagactgaaaacctcactaaataagaaggatacttaccaagagaaccctactaaccaagactcaagtccttatagtactttttctattgctcactcccccaaactctgagccataaaattaaaatcaacattccatgggatattcttcctcaagtccattaaatcagaaatgaagtattaagtagaggatgtttgtatttctttgggtcatcagattcaccaatgtaagaaatataaatatttatcttgctagctcctgatagccaataaaaattaactctaacgtatggtatatttaaatagaaacaattatctgaaccttaaatatcagtggagctaggacttctctttttgggaattgagggaaaaaatatatacatatatatatatattattctatagaagaacagttcagcagagttctcacatgctgtatttaattcacattctcaagtgtaaatatgaactttaagaaactgtctaataatatacaacttcctctgtgacttaaaaccaagtctccccattgcttaaagggccatgctcctttttatggtcacagaaacctcctggtctaaaatctcgagttgtcttttactacttccttcatttttctttcagtgtgtttctaacaatattatgttctaagaatattgaactacttgcagtttcccaaacccattatactgtttctagccccatctcttaccactacctagaatgatctgggctaattagaccttctgtctaattcataaatatcttgcaagagcacctttgtaaaggtttctctttcttgtctcctgggtgtgggatgactaatcattttctttgttctatctctatttcacacgcatatttctattaatctatatactatagtttgtcataactgaagtctacatcttatccattgtttcatctccagcttctagcacaatgccttgcacatagcgaactgtcaaatacacaacaaacagatcaaataactgtttgacagcattgccactgtttctctttccctctgcttttcattccttttattaatttcactttgatattttcatgccctcactgtctagttcttttccccttgtattctacccagaaaattacatctgaagttttacatctctgtatctgattagtatattattttttactctagagttaaaaaaccagagtcctcactatttaatgacagtttgagaaagtgttttgaatcaaattcaaaatgaatttttgaataaattatattctctatacaatctgaatagtgtgtgaaagacattttctataagtaaatttgatctgcacatttgatagtgttgtcaaacataaaaagtatcctaacggtcttggaaatatggtgaagttcaataatattcaagattttcatgtaaaatcttttcttgtataattaactacgggctttaatagcccttgcatagtttatgttaagagcaatcaaacagtaactttagcagtgtttagtaaatggctttaaggcctccacaaactaaataagcctctactacagtttttaaaacatttggaaattactgatactcttgaaagtgaatagtatttttgttttgaaatcaatccaatttcttattcttttgagtcagtctaaactgatttttttcagtcttctccttttcacagatgctgttattactatctttctctttttttaaaagtaagataatcaactattaaagagtagtgtttcaaggtattctagcatctgaggctgtctctgtaactaaatcaaatggactgaatgatcataagtataagaaaggacccaaacgtctgtattgttttagccctagaacttgtgaggttcgcaaatcagtttactgccaagtatttctagaaactgatgtatttgcatacagaacctattatgtataaactttttaaaaaagcaataataagaattcattttgtttcctagactcactttatttcattaatatttaacattacagaatcaaagttagggtcaacacacgacctttataactcaggatccccaccattttgaaggcaatagattcttcttacaagtacagtaacatgttgtttaatttgtgtttttccctttgtaccataaaaggaaaggaactcatttcacagaggttactgattgaattcactgctttaaaggaggtggactttgaaaaacattatgcttgaaataggtctatcttggtagatataatttcagtggaacatttaaatttctctacagagtatacggagaaatagattactgcctttcattgattcactgtctagaattttcttctttcaaaattatagtctagtaagttatttttattcctactatttaaaatctatcatttttggcatgctcatccctcagtttctacgatttcttctaatttacaaacttaggtgcaatgctgttacttattttatcaccctaagcaatatgaacattcaaaactattgacattccaaagatcacataaaaatctggattatatgaattttctaatgctggtctccatttcacaatgttcctgaataccctccctgtcataagaacagacattctttgttgtacacaatgttccatacaaagacatttataagcagattcttataatactactttaaaaaataccaattttggcatgctcttttaagcagagacaaaacagatattttgccaggaggattcagtagcagagaacaaaaataacgtaaatttggtggaatcagaaaatacatcttataaaaacaaatataaaactctgaagaaataatgcaatttacttaggtaaaatatgaaattggataggatgttgaaagctgtgtacccaaataagattatctatatcttcaccaaaatgtgaatatctaacgaagagcaacatatattgaattttaaaataatagaattttcaaagaaatagaccagattatatcatacagtgcttaatgaccaaaattagattaattttattggaattaaaaaattatagcactacctggaatctggtcattaatctaaaataaatttaaaaaataattttcaaactccataatatgtaatttcatacatgtagcaataaattattctacataaaagaaagaaaattaattgcctacatttaatattaggactggattactaagtacatgttgatttaaatgtaattgaaaatagtatggcctatgtctttatgtacaaaaatgataaatcataagcaaaataaaggtatcctgaattaacatgcctttaaaatgatcagatctaatatgtttcaactataaaactcaggtataggataaaggtgtcaggtatggagaaaaaaaccctatgcttcagttttagcactagacctataattttggaactctgaataagccatttaatttctcaatttgagtcatccatttactaaaagagaatatgtttctttggcagaaagaagctaaaagtactttatagactccacaacacatggtaaatataaggaaacaagctgttacagtaaaagtagaggtaattaattttttactccatacagtagtcatttattaaatattttacagaagaatcagtttcaattataatcattgaattttgttggggttttggtgtttagaagtctgctaacttctgtcaatgtttatttcttatgttaaatccttcagtgaacgtatggtgttaaatacattctgattatttggttcacatttcttgaaatctaggtgtacctatacttataaataataaagaaccaaagttattatctaaatactcaatagcaaaaaggctaaattttatgcttaaaatgactttagttatttattgaaagctgcttttataaatgtgtcgctatgtatacacaacacacatataaataaatgtactttattttccatagtaacttccactaattaaaaatcatcttatatatattcaaattttattaatatttaatgcaaagaaatagacaagtatagaagtgttatgtagagataatattaacatcatcaagtatttttaaataaaaatacaaacatttccaggacttacaaacatatttattatgatatggtaaatattgctaatattgtttatgtttaagcttcattactctgcaaatataacaattattccacatactaaaaaacttggctcagtatcagtcatatttaggatacagattacttcgcagacacatagttcaaatttcataaagcaaatttaacttcagcaatttttaatttatgttctttgaatttagtcaagcattaacattagaattcactaaaatcaaatcaacacaattccttctgtcttgacagtagcaatttatgtgctaacactcattaaattaaaacttttatgtaactttgccttttagcttctttatgtaatgtcttcattacaaaatgtgattttaagtagtaatctcagaatttttgttaatcgattactctcttcagtctgaataagcccatttaactttggactttttacagtagaaattagtagcacattaataaaaacaaagaaatgagtattattagaatataccactaagagaaacacaaggaaaattcttattcttattacggattaaaattcttattaagaattcttacctctaatttaaattcttattaaatttttattctttgcatcacaaagaatagtggccagtataactattatatgtatactggatacaaatattacacatagctgataacaaaggcaatctttttccacattgaaacaaggaaaaaattagtaatacagataagaatcaacaacacacatatgtctatcaaatgtactaactgacaaacccaagtaaatcaatgcctttgtgtattggttttactatttgaacatgtccttctcatcaaacaggttttattctaagtatcgtaggtatgttccacactaattgagtgcttatattaaaaagaggtaactttgaaatgtgcacacagaaagactccatagatatttctcattattgggtatgtttcaagataataaaattgacctgggattaatattaaaatagttgaatacattttttttcttaccataaaaaaatgacctcagttagaagaaattcctagggattagtgaccaactgaggttaatggcctgagactatactttaggcaattaactccacccagctattcattaatccccaggaaatgcccaggtctacaactgttactgcttaattataacccgaatggaaccatgagagttgagactggcaatgtgattcactaatgtacaagaattaagttctccatgactgctttgtacatatcaattaaaattgcatcacccttaaaaaaatccacatgcctgtatttcttttctagttttagtttataatagcaataatgacttcaatgctgggcattttctagaaattaatggccagcagatgttaatggcccttggctgtaccttgagctatctactcctccctgttagtcattaatccctatgaaatgcccagctattgcttaattaactttacaatagagttaatgcagatatgacacaatggcaagatttttatttataagcttccaaagaaaaataaaccttcaactccaaaaatacttataaaaattagtttcctatttctgaaacttacattgaaaattaagaatgggaagaaccatgggatataatgtatttaagactgcacttcagacgacctcaactacctttcaaggaaggagattctagcccatggtgaaatattatcctatttcccttagttacttatttctattgttatttaacatcatcatgtttgtcaagattgttttttcctcattaaaaccttgttgaaataaaaaagaaagagtactgttcttatgtaataaaatcccctgtctctcacccatgtgcttttcctctgtgccctgtgattcagagtttgcaaacaattccaggagtgggaatcacttagttgtgtcagagtagtttaaacttggtaagttttagcacccattcttcctcaaaggaaaaaaataaattgctttaaattatgaacctactattttatttgcctattaaaagggcattttcaaccctactagcaactaattaaaggaacactgtatgtgtcttaaaccatctggtcccaagtttgtattgacaaaaaaagtatatgtagctgaaactttttcagttaataaatacttggccccaatagaaatgtacctggcgaggcacgtgctatgtctcacctgacagcatttgtgagagccccattgatgcctaaaattagccctggcacataattatagccttcaggaaagatcagctccagaatacattatctttcctacaaaatcagatcccttaaattacatagacgaatgtcatacaggtacagaattggaaagttaggattctatttttacctattaagcgtatagactacaaagataacggtgtaatatgtagttactatttatggtgcttaataatttatacagctctctatgattacttactttgctgattctccctcacaaaaataacaaccagagatttgtgatttttgtaattatataaagtgctatttccctatatttggtattacttgatacggcatcaggtagaatttttatcaaattttcaaagattctcttagataaacctttgtattttggttgaataatagttatccaattgtagtaatgatcaaattgcagttaccaaactttcagaggttgtcttagagaaatctttataatttgtttaaaacatttcactttaaacattttaggatgtttaaaacattttaggatgaaaaattttcaagcagaaaaccagaataaagaatcagtctaaatatggaacagacaaagtatatcgattgttgattgacctggtaaaaaaaaaaaacaaaaaaacagacatacatcatgtagattatattcttcatgtgcacgtgcatgcatacacacacatacacatatataatcaatttaagtcattcatggatcttcaatggatcacaccattacttgcaaatattattgttgctaattggacaaagtattaaaaaagtagactctgataaaaacttacgggcattatatattgaacagagacatctggcaacccaaaattctgatgaactagagttcacaatagttattttttaacctttcctaacacacatattataatgggagactactataagataaaattttgtccttgtgtaacattcacgatacattatttgaagatactggtaaataagcatttgatacacaagctttattttcccaagttttagaaaatttgtcagtctccgtgagtcgtcaagagtatctatctctatgctgacttcataaaattactttgatggaaaataatatggtttaaagagttactaatgttttttcctaatcctgcttatgctctatatcctgcattttctcttctgtttcttggaccacagtcaatactttatttgctttttaaaaataactatatttttagccaggtgaggtggttcactcctgtaatcccagcactttgggaggccgatgggggtggatcacctgaggtcaagagtttgagatcagcctggccaacatggtgaaatcctgtctctactaaaaaatatgaaaattagctggtggtggcatgcgcctgtaatcccagctactcggaaggctgaggcaagagaatcacttcaacccaggaggcggaggttgcagtgagccgagatcacaccattgcactccagcctgggtgacaagagcaaaactccatctcaaaaaaaaaaaaaaaaaaaccctatatttttaaaagttaaacaaatttaaaaaaacaatatttatagtcaactatttgaatactaatttttatttaattatgtttattttgaaacaggctctcactctgttgcccaggttggagtccagtagtgtgatctttctatttgaaatactggttttattctgtttttctttatcaaaatgagattcaatcttaattgagaattctcatatttgaatcctaagttttctgtccattcattaacttagacactagctgctgaagacgtgacagtgcagtgatataggcaatgtgaatagtattgatagattgaacatgaataaacttttagccaaatacctttgttaatgatgtaagttctctggatgaaggtctagaaagccaaccacctttactttcaatctccttttggaacatacaagtcctacattccagtttcgtttcatgaagggaatattactcttcccttcacagcttatctaaagtatcaattagtcaaataaatgactacaagatctgtgaaagaaataaaaaaagatattcacatgtacacaattccaagaatacctaagggcacaatacagcaggcggaacattggaagccagtgaccaaattcagccagttcatgtgctgcttttcctgcataaagagtaaaaattgaataagttgtggacattttaaacttgggtatatttacataaaatttcatatttccaaatgtattttttgaaaaattactaaatttgtaacaataaattggcactgtttagagtccttccctttagataggaccagcactcagttcctaccacttttattgcttccctaatatattttatttagccaatcattatttacattttcatcctacagggaaacaaaagcctttctattgtgtgtgtgtgcatatctatgtgtgtgtgtgtgtgtgtatgtgtgcacagccgtgtacacaatgggatttttgatgagtgtaaagattttgtaataaccccttccccaacttcctgcaagtcccttttttgaacctccagtctttcaaatggaagtatccaaggatcaaagaggctacagctttactaaacaaagacggggattaatttttcttggtttttaatgttggaaagtgacttaccatttcccaacttgactaatttaccattatatttaagctatttaaatcctaaaatctattagaatatgctttagccaatgtagaataaataattaaaaatgcctttcaatctctagaagactctccaaaggattgagatacattcctattgcaaaaacagttcaagtattttcagttaacttctattattttcactttcttatatattccacctagggacaggattttcatcatgattaatacttttagtccaagcaattatgattaattatattatttcattcttggagtcacccaaaatgtagtgaaataatgtttttattaaaatatattaatatttagacattttgggaaatacatcaggatatttgagaattctacaagaaatgactcataatctttactttccctaccagtccatctacaaaaatgtgcttttcttcagattgaaagaccctaactactagtagtaattaattaatagtggtctaatgaaggagaagtatacaggggcagtacatctctaaactagctgagcatcagaatattcttgagtaactacaaaaatatactcctaagccctatctttgaagattctggacaagtggatctgagtaagtcaataaatccaaataacccacagcagggtcatggcaacaatattttatttaaagatcttcatataattacaatttcagtaggggtcgccggactagataaaagcaataatatgaaaattcctttcctgaattattcagattatattcataaaatgaaagttcttagttcaagtaatcagttgttaattggttttgttgaaaccgcattaaatgctacagtaggttcctaagaagtccttcccatccttgagggactctacagtctaaaacgggaagtggtgagacttactatgcattaaatagtattacaaagttcatttcagtaattttttattatctataatattaaatatataaagtgctaaatctctgtgaatcctttcttgtttcatagtggttaggtagtaccaacttaatgaagaccttgaaattgaggcagaatgttttatatattttactcttgatgtaataatgaaagaaatattttttaatgtagaggaatcaggtataaatccactgttccctatttaaataattatttagagacatgagaatatttagtcagcaacagctgttgcagtagcttagctgtgagcctgtgggaatctggataggaatgatagcccaaatggagataaaggtactggtatacgaaatttgccaaaagatgactgacagaaagaggaggatgatagcataaaatcaataactataaccatccatgtttgaaggaatgttgaagtggtggttcccttggcagagaggagaacatagaaatttggtaaagaagctggtctggtgaggaaattggattcgtttagaactgttgaagttaaaagtgatgggacacacttaattggaaatattcagaggataactgcagatgtagaaaaggagctcaagtaaaaaactgaagacacagaaaagaatagggatttattcatcctgtctctgtgcctcaagtctcagccatatttcatatgacaaatgtcacctgataagtgatttctcatgagatgacaccatacattaacacacatgttaaatacaaaacatgttgaacactgattgctaacatataatccctttccccggaatttatttttttctcatagaaacgataaagtgtagttcacaaataaatggtgactttagcatttcaaacttactttttattgatcaaatgagtaaaaggatatagactgcctcaggtaaattatctaccatttcactgaagcagtttattcacatggcctttctgtatttatttcataggtttgcataataaggattcacatacacagttgagctctccttccttcgggctagttacctagctgtcctaatcacccggtaattaaaacaaaacccactccagataattggcagttttctctaattgaaaactgggtagacaataatttggtctagggaaatgccctactctcatactgtaatatgaattaccatctgtccattaaattagccaccgtaaaatattaacatataaatgactactatagggctattcttaaagtggccctaacatttaattttttttttcattttgttgactcacccatttctttctagggaacaataaggaactgtattctagggttgatggcaggaaagggcaataacttttgtcccacaatgcagacatgttaagaatatttagaatatctaaccttgctacacaaagtatttgctctttagtgaataacatgaacattgaaccaagaagatagaacaaattacacaaaaatattcaatccatctatcaatatacagctgagagatcctaaatgcttcacatactactacacatttactctcagtggaagtaaaagaggaaaagaaggagatttaaaaaagcaacctgctaatcttagaaaatgtccagtagttcagaaaattcttggaatacacctggcatatattgagaaaatattctaactcttcaatatactaactctgttcttccttaaagggtgattttatttgaatgagaaaagggggaaattcataaatatcaaaagactctcaagggaacaatagacattatcgaaggaacaacctgattttgtgttctctgtagacagatgggtaagctacacaactctctcttcagacacatttgtacacagcaaataacaccagtagcagagtctttaattagagaggacaaagatacacagccacacatctaatgacacaaagtacaccaaagcagcatgaatatattttcctttcctggtcacaggcaatcctagcatgaaaagaatgtttccccaaaagttctctgtggtgactttctgctgacatcttaggatgcctgatttgtctgtttgctggcaaggagtgagccttgtgaaatgtataacagaattagaatgtaaactgatgatacttcagacaaggtcaaaccctgatccatgtaaatactcatcaattgattaggcagaaattattaagacactggataagtcaaacaatagctcaagagctgcataacaaatccagggaaaacacaacagcagtgaaagtgaggaaaactcccaaccacagacttcgttgaccagccacagaaaagaaattttcaggattttttatttaaaacacaaatatttgtaataaggattaagtatgtaccctgaaaatcatacctgtcttgaaatatttgctccagtctaagcatagaataatcactctgctacctaccattcatcgcccactgcaatgaaaaggttgagctccatcttggactttcttcacagaacctgacataaactttagtgtactctagagacttggtgatgataagatgttatgtttcaatacaaagacaaactccataataaatcattttatcaattaagatgaagaaagccatcgaaatataaaactacaaatgaaatgatcaaaatttatacatggccaaaaacctggggtttctgaaagttaaacagaaatctgaattttattcagttattaaaataaatattttatatttttatacttagttttaatgtctttttctcaagattattttatatacaaaaacaagtagtataaaaatcaacttatttctgttaattaatgaaaagttgtgctttccctataagtaaattctcatggattgtttacactataaatcccaggacattaaagtacagagcacatttttctcctttattaatgtataactatataatgagctatagcttattatgcataaaataattctcttttttaaaaactgctctggtgttgaagtaagctaatgtcaaattaaattatatttattaagaatcatcatagaaaaaagtgtattacttaacaataaaaattaaaaccatcattttcaaatgtttaaaacttgccctgtattgtgctgggcaatttatacaaattatatcatttaatctttatattactcctgtgaggtaggtattattttcctgttctataacttagcatactatggcaaacagaagagtaatcatttactcagtgtcacttggctcaaaaatgaccaagctatatttttaccttaaggctgactgacctcaaatcaaaatctctctgatgcaacagaacctccccttgttaaatttcctatagcagagactgctggctgttaaccaaacccaattctaagcacacagcttgatcatatttctcttagagttgggtatgtcaatgaactaaattctagccaagagaatatgggaaaaaataacatgtcatttttgtctaagagccaaccttagctcttaaaaactttccacatgccaccttccattctttctttttcattgtttttttgagacagggtctcactctgtcaccctgcccaggtatagtggtaccatcaggactcagtgcagcctcaacctcctgggctcaggtgatcctcctacctcagcctcctgagtagctgggactacaggaacatgccaccatgcccagctaatttttcgtacagacagggttttggcatgttgcccaagctggtctctaactcctgggctcatgtgatccacccacctcaacctcccaaaatgctgggattacaaaggcaaccttccattctttttcccccatttggcctcagactttcaccaggctatactgagaatctggtgcaaatggtcctagggagaaattcagccagaaacatctgcattgaactgttagtaatgagaaataaactcttactgggttaagctactgtaacacagggtttttgttgttgttttgttctatcagctagtattattcttaactactacaagttatatcattttagagttaccaaatcaaaatatgatgttaaggtttttaattaaaatctctcagttaaaacttaaaatatatttccctgccagtctaaatgttgtcctccacaatatccagtaataatatagcctcttttcctactggcaaacacaggtgttaagtaaaaatggtaacataaagacagaaaatccaaatggactgcatttatatcacttcaactgcaaatagcatctcaatgcagttttgaagtgatatctagatactttttgttaccaaattcaggtgtcaggaataataaaggaatcgtttacttgatgcatataatactttaaagaaatcagtgcaagcccccaaaggaaaaaaccaacagcatactcaggagcatatcatcttgaagttgatgtaacaatgctgacaagtacaaaagataactactttgttctgtcatgctgtgtcatgttgtagaaaacacaaagcattacgtgacctttagaggaacagtcaaaagtagcttactttgtggtatttaccacgggtgtttttgaatttttgaaggtcctgtcttttgccagttacagccagagttatgtcttaagggatctcaaacaaaaagagaaaaaaaaaatgctgatgcattaaacaagtgtaagagtaaggtgaaatactaggaggaaaattcactcctagtagaaaacaaaactatttgttaagtatctatatgtttgtagacaccttgaaaatgtccatctatttaacatccagttccaaaattagcttaaatggatgtatatgggccatagttggcctgagaccatagagagacgagtattgactaattttatgctcttacatactgattagagactactactgcaattttcctgaattctagttgtattaaactttagtataatgcagagtcctcagatatcagaaggtggtatacataagccatagattgctattaaatcttatttttagacatcatctctactcctcaaaaccatagctgcatttttatttatttattaaattgtatttattttcttctacattaagtccttaactcaaaggaataactagtatagcaagatttcagccccctaaattagtattccttaaaggaagtttatagataatcacactggaattacttaaatatatatgtcttaatctctagagtaaccattaaaaaataatacaaaaagagatcctgaaaaagcctatagagaaatagaaaaaaaaaattttcgttaatctcaaagaaggaagaaaagcatgaacaaaggaataaatgaccaatggaacaaatagaaaataattaacaatgtcaacgtatattaaatgtaaatgaaccaaactcccaaataaaattgaagatacatagtctgaaccataacgtatagaatggaatctgtttctgcagctgagcccagcgatttaaaattttaacaaatatattagttttttatgtacaataaagtttgattatgatttgattattatctgagctatttctgagttgtgtttgcatatgatttagagttaccaaatcaccttctctccaagctatttgaatagggaataaaatatggatagtatcaatgaagttggtacatgtgtgccaggaaagtaatactgtaatattttaattaaaaaaactgaaaaatatgtatgtaaagttatggttgtagatttttgtaattataactaaaatactagtaatacaatgcattcttagaaagggatttgaaacattaccagataactccattaaacaaatatacaactgtttgtttcttactcttgcttttgtttttgtttcttttgtttgtttggttggttgtttttgagacagactcttgctctgttgcccaggctggagtgcagtggcacaatcgaagctcactgcaacctctgcctcccgggttcaagcgattctcctgcctcagcctcccgagtagcggggattagagacacacaccaccatgcctggctaatttttgtatttttagtagagacagggtttcactgtgttggccaggctggtctcaaactcctgacctcaggtgatccatccccatcggcctcccaaagtgctgggactacagacatgcgccatcacacccggcctgtttctcactcttgaagagagtgagtattaaacatcaagtgaggacacaatgaggtcatatgtgtaaaaactctttgtaagcaggaaaatgttataaaattggaaagtatcattgggaaacacagtcttccaaagggtctcctgtgcatctacacatcttgctggctatgccaaaaaggcgatgcctctttatctgagctatttctgagctgtgtttgcagtgagaaaccttgacggatgatataatgtctcctacagggacaaacagcaggcttgtttgattgctgtaaaagtaggggataccccaaagtcagtgttgcctataatacaattaggcaagaaaaattcatacaagcatgccaatgcttatcttgcttgctgcaacatgagtaataaaagtcctttgtttctgactcagtactctcatatcttctgacaccatctacgacacagtacaaggctacttagtaggaggtatatagggtaaaataaaatcccagatcaaacatttaggcatatctcattttattgtgcttcactttattgtgccttgcagatactgatttttacagatttagagcttgtggcaaccccgcatagaacaagtttgtcagcaccatttttccaacaacatatgttaattctgcatctctggacacatagaattttgtgaattttggaaattctcacaatatttcaaactttattattatatctattatggtgatctgtaatcagtgatctttgatgttactattgtaattgttttgaggagccacaaatcatacccaaacttaattaataaataggtgtgtgttctgactgcttcactaggccatttccccatctctctccctctccttgggtttcccaattccctgagatgaaataattataaattaggccaattaataaccatacaatggtctttaagtgttcaagtaaaaagaattgcatgtctctcacttgaaatcaaaagctagaaatgattaagtttagcaaggaaggcatatcaagagagccaaggcaggcaaaagctaggccttgtgtgtcaaacagccaaattgtgaatgcaaaggaaaagttattgaagaaaattaaaagtgctgctccagtgaacacacaaatgataacaaaaaaaaaaaaaagtcaaacagccttattgctcatatggagaaaagttttaatagtctggatagaagatcaaaccagccacaactttccctgaagctaaagcctaacccagagaaaggccccaagcctcctcaattccacgaaggctgagagaggtgaggcagctgtaaaagaaaagttggaagctagccgagattggttcatgaggtttaaggatagaagctggttcatgaggtttaaggatagaagctgtctccataacaaaaagcaaggtgaactaacaagtgctgatgtagaatctgcagcaagttatctggaagatctagttaatattattaatgaaggtagatacactaaacaacagattttccatggagataagacagccttctattaaaagaaatgccatctagcactttcatagaaagaagtcaatgcctggcttcaaagtttcaaaggacaggctgactgtttttcagggactaatgcagacaggacttgaagttgaggccaatgctcatttaccattccaaaatcctaaagcccttaataattatcctaaatctactctgcctgtgctctatatggaacaactagcctagttgacaacacatctgttgacagcattgttatgacagcatgaatattttaaacctactattggagacctattgctcagaaaaaaaaaaaaagattcctttcaaaatattactgctcattgacaatgaacctactaaccaaagagttctcgtggagatctacaaggagaataatgctgttttcatgcctggtaatacaacatctattctgccgctcattactttgaatcaagaagtaactttaactttcaattcttattatttatgaaatatacttcataaggctgtacctgccagagacaggattcctctgatggaactgagcaaagtaaaattaaaactttctagaaagaattcaccattctagataccattaaaaatattaatgattcattggcgaaggttaaaatatcaacatttataggagttcggaagaagttgatttcaacccccatggatgacttggaggaattcaaaactacagtggaggaaacagctacagatgaggtagaaagagaactagatatagagcctaaatatgtgactgaattgctgcaatctcatgatcaaatgaacagatgaggaattgcttcttatggatgaacaaagaaagttgttttttgacatggaaaccattcctggtgaatatactataaacatggttgaaatgacaacgaaagatttacaatactatataaactcagttgaaaaagcagcagcagggtttgaaataattgattccaactttgaaaagagttatattgtgcgtaaaatgctacaaaacagcatcacatgctggagagacatttttcatgaaaggaagagtcaacaaatgaggcaaatttcattgtcttatattaagaaattgccacagccaccacaacccttcagcaaccaccaccctgattggtcagcaaccatcaacagccaagcaagaccctcccccagcaaaatgattacaacccattgaaggctcagatgattgttagcattttttagcaataactgtttttaaattaaggtattcatattgtatttttggacataattgtacactttacagataacagtatagtagaaacataacttttatatgtgtggggaaaaaattgttgacttgctttattgtgatactcagcttattgtggtggtctgaaactgaatctgcaatatctcttaggtatgccttcatattattatatagaaataaagttggatcaattttaaactgatcaaactgaccaggccatacacaaaaacaaactaataaatataaattacttatgggtttatgcattgtgttataatttagaggtcacattttatgaatcaattatcttgagataatttttaaacttctgatttttcagacacatgtctaaaaaagaagctaaactcacatttaaaggcataagtttctctatatacttatgaaaaacttatataagaatcaacagttgaaatacaattagagagagaacacaagcctaccttaaatttaatttttcaaatggtgtacagaatccaggggcatctaaatatatatcttcagaatataaatagcagtagtgggtaattatcctaatttcagcattctggaacattttctttagtagtctttctaaaagactcttaataatcacaatagcagttatgtaatcttcctcctagcatttctcttaagctttaaaaatgagtatatttttgacatttttccactattgcttttattgcatctccaaatttctttgtcattgtcatctgccaatttcaataattgattacttctatactttcatgtctgccaaaaacctctgaaaaactgtaaggctttgaattaatgtggtaattatttattttctaatgtccttaagacttataccatttcttcttacacctttccgtacatgctgaaattttagttccttcttcttaaagtttctctttccagaatattcccataacttagaagctgagaatagcctaaataaaactttgcttccagtattttgccaatccatttggaattgttgatgtgtaagtaattaaaaaccctactattcatggataaggccaaagcaaataattgtaaactttttaaaaatctcagagtgaaaatatgtgagagtaaatgagattcggaagtttttaaatgatatgttgtacaatcattttcccattatgactcttgtgtccatttggtatgtgtttttcataagattgctttcgtacataagtgatactaaggtcttaattaatagtaaggcggtcaaattctgttggtgttattattgggcaaatttcaaataccctcctcagcctgtaatcacgataggttaacaatcttaacatatttatttaattttgtataaaaattattacatgttctgtgatcctacatcatgcattgttactattaagaattacctgtaaataatttaatttaaataagtttatgttccatattcctaatatagaatatgaaaatgggaataactatacctaggctttggagtcacacaaatttcaattctgcctcctgttcagattcaaatgaaatcttgtttatgaagcatctatcacagagcccctgcttcagaaactgtaggaaaagccaccattgttaccattgatattgttcactgattaaattattagatgtataaaaagctgttgaacttacagtcagttagtttctatgtattaagttatgatatgagtttcattttcattagtgcttatctaatccttatgaaatattttattaaatttgtagtcttcagactactttcaatgcttaattaacagttaaccatgaaatatcccaaaattttgttgtaaaatgtcagcacgtagcatgtatttatcaattagaaacattttaaacccaaaaagatataccacagctatttcagttcgccttgcagtcaaatgtatacactaacataaatagttacatacagaacgtttaactactagacatgacacagaaaggtaagatgtgtgtgtatatatatacatataaatatatatatatataaaagcctaaaaacaccttccatcctaaccacacagtatatatatatatatatatatatatataactactcccatccaatgtattcatacaacaacttgagtgatttccaatactattgcacaatataaataaaacaagtgtacagaaggctacatgtttatataaactatagaagtaataacctggtttgacaaggtgcagaagaaaggggaaaatgtctacaggtaggtaaagcattttaaaacacttggagactaagaccttactgaccttgtcacctcacatcccacttttctgttttaaataggatttggctaaagggttttccataatccaatgatatgattttactgggcatttaaaaagttataggaaaaacaattaaactttaaataaaacatcatgtcatggtaggatcaaaatgaattatcacgctatgaaaatccttaactaataggagatcacataattgtgagtagatagaataacagggcacttcaaaatttgtacattatacttatctgattgaaaagcctaacatcctatcaattttcaacatataagtgggacatctgttaacatgacataatatttcattcatattccaccaataaaatgtctatctggaaaaataatctatgaaacaaagtaatagccattttgtagttcaagtgcccgttaataaatagaaaactaaagaaagattattttccaagtacatgtgggatccccaggaatgtccaacgacattattttcatgactatttgatttatagccagtaaaattataataacaaaatactaataagaatatatgaccccaaaaatggaatgcaatgatatatgtaaatgactaggccaatttcttatacatggcatgtactcaaaaaaacggatattttagacaaggaaggaaaaagttaatattctttctctaaattattttacctgcaaatacactgaaaagattgacataatatagatgtatagaagaattaaagatgccactgtaacttttttgtcttgtcttacctcattttagaccttcggcaaacagagtatcttttcattgaaagctgatgagcattccctattaggcttccaaaggaaacattttgtgggcacaaaacaccttccatcctaaccacacagtttttatgagaatcaaatagcttcacctaaaattcaagtgcagtgttcagtggataatcaacacttaaaaatgggcacatccaaagaaagagtcgcttagtttattatttctcttgaaactattacaaaatttaggacaattttaaagcacaatgaaattatattattgtacaacagcttggtaatttataactgtgttccttataatcttaggtaacctaccagtcttcactctttattttcacgtctctttcagaccaagattctgtgaaacgaatagatacttattttttttcaaacgtatttatttctttctaatgaccaagaagggggagtcaacttaaaggaagaggaatatatttgaatgaatctgctacttaggtaactgaacaagtaagccaaggtattgtaattgaacatttagggcttgtattaagtaaaataatttggccataaacgtggcttaaaaattagagatttaatgtcttgcatgtaaaaattcagaagctcgacaatgtcatgaagaatccattttgcctttttggggatggcattcgtgtcaccatccagtaccaaaggatgggctgccagttccaggtgtcatatgcagacataatgatctttagctaaaatgggtagtgcttcccctgtgtttctcttttcattagagagtttctctggaagcctgccagatttcccctttcattgatcagaattctatcccattttcactactgaactggcatgagaaatgaaatgacgataataggcttagaacaataatgattctctccccagggatgggggacaattgaattaaagtttattctgccagcaaggaagaggtaaaggaagtaatcattgaaataccctctaatagtttctacactacacctttggagtcaggggaaagttgacttaaatcctgacttcatacctttagaactctttatataagtacttaacctctctttatattgggagaaaaatatacatattgagtatatatatatatacacacaaatatatatatatacacaaaaaaaaacaaatatgatacaggtattttaaacaggtctgtgttgtcaggaatgtgtaatttatgcaaaaatacctagcacagaacctgatacatggcagaacccaataaatagtatttaaaactgtttgcatggtttttgtttgtttgtttgtttccatttctaggccctcctcatttcttgccttctcacaacaaagcccaatacctttctgagaagtatggcctaaagtgattattcaatctctgcaaaattctcagttttaaaaagtattttacttgatattttcctatttcattctgcatatatcaccgactattagggttgtcaaatactagtttgatagggtatcatgcaccttgattataacacacataaattttccttatcagataattccataaatcaaatcagcatataaaataccatcaattattttaagaaaaaaatgaaagaggaaaaagaaaagcccctagcagaacatgaaagttcccgtggcctgtttctacatttcactctcttcctttgtgcctgacatctttatgctttaatcactctaaataaattgtccaaattacatcttgagattatttctttcaaaactattgttgcagtttcccctatcagaaacatcctccgcaccacttttccactcttcatctaattcttatcatcttcataactcatttcagaaactgtctttcccagaagagttttccagactttagttatactaagttattccagagtaacttttgcttaccatttaccataaaatttggaaagtatctatttttgcatctgtcttcctcactagattgtttaataaactcctgatgcctttactggtatggaagtagccacgcaataagtatgtgctgaatgaaatgaaataaattgatttgttttatatattcagcactctaaaatggaatactaaagacaaatctcctaaaatactgagatgataaaaaatagcattaaaaagttaccgcctttatagaaaaatacagtaacatttcacaagtatttacagcgagtgaaatgtcatgctaaataccttatacatatttttcaatttagccatcagaacagccctgagaagtaaaagtatcttccccattttaaatatgagagtaaaacacaaagaagttaattaagttttcaaggcctggcgtggtggctcacgcctataatcccagcactttgggaggccgaggcgggtggatcaagaggtcaggagatcgagaccatcttggctaacacggtgaagcccgtctctactaaaaatacaaaaaattagccgggcgtagtggccagcgcctgtagtcccagctactccgggaggctgaggcaggagaatggcatgaacccaggaggcggagcttgcagtgcgccaagatcccgccactgcactccagcctgggcgacacggcgagactccgtctcaaaaaataaataaataaataaataaaaagaacaatttaagttttcaaagaccatacaactagcaagtcccaaatctgaaacttgaactcaggtttgtcgactctaaagtgtatgttttagttactacactccaaaatacagaccactttccacatgctactttattttttacccattcctaataagaagtggtcttaaatagctccaagtcatctaaatttcataacaaaacaaaacaaaaaaacacttctatagacaggagaagacatgatagcattttgttccaattcacttttttctcactttatttaaaatcttgtttgctcactatcaacagtaactgtgtcaatgcattgcactgaaattgtgtaaaaaaaaaaaaagctttgctgcactgtgataaaacttcccaaaaaaccattgacaacatatttccttaaacaaaatgcccaactttttcacatggtaaaagtatttttcacatacttaaaagtagaatgtcaatgattacatttgttacaaataaagttaacaaggtacttaaaagtaatgatataaatgcctataaaagttacactttattgtttaaatattatcctgtatttacataatttttcagcattattcaaatacattagttgtcatgtatacccatgaaatattatatacatacatcaactctagtaatgtgtgttaaaataaattcattgctaggctgggcacggtggctcatgcctgtaatcccagcactttgggaggctgaggcgggcggatcacgaggtcaagagatcaagaccatcctggccaacatggtaaaaccccgtctctactaaaaatacaaaaattaactgggcatggtggcgtgcacctgtagtctcagctactctggaggctgaggcaagagaatcttctgaacccgggaggcagaggttgcagtgagcagagatcgcaccactgtactccagcctggtgacagaccaagactccatctcaatcaatcagtcaatcaattcattgctacactgagaagtaaactgatgcaaaaggaaaaacaacagaacagggagaaagcaacaacatggagtcggtcacaaatacatattattgcaaacatttcattaattttgaaagattaacagcttcttgtatgagggaaaaatgtgaaaatatttttaaaaggagcatatatttaatttctaaatatagtagtaaacattcactgatttatataataggaaatataaaatgataaaatagaaatgactgcaacttcataaatgtcaaaatctgagtatgaaggaaaggaaagctgaaacacttttggttatgtgtgcatatggctcagtgctttgactacacagaacacagagattacttgtaatggtgaaagtattaatttatgaaaaacattttcaatatcagttcatcactattcagttaaataaattatcatatttagcaattcgtacatgagagcaggttggatttttaaaaatacttaatcctcacataactggtttgtagtccacagattaattgaacattcaagtttacaaatttgaggaaaaaggaaagaaaatctttttatttccttttcagtgttaaatttaaaaaagatataataaacttaggaaatataaatgttttaatagaatctcagaattcatgctatcatataaaacaatactataaaacagatattttaaaatcaattaaattaaagataaccctcagtatatataattcttaagactactatatccaggaaataacatttatatttcacatatctctatatgaagataaaaaataaagaaaaggttcactagtatattgatattcaaattattcattgatatttgtattcacctaagaaaacttaaattttaaaaaaacaaaaaaaattttgaaatcaattgttaaatgggtagcagcaaagtaaatttacgcaaactttcttcagggtaatgaaccattaaataccaaaagcttaaattcttaatttttgaccttgcaaatatttattctgaggaaatcataattacctgtaaagatgtaactcaaaagagttatctccagcttcttaaacataaaagagtaattaaaaatgaaaaataaaacaataaaagcataaaggacaacattaaaggaagtgaataagtaaactgatttcatataataattctaaaaattgtatcactaaatgtgttggtccaaataagaatttcagaaattaaaatttggggtataaaataagtacaaaacctggttattaaacataatagaaagcatatcattttgtaagtagtactatagacacacacacagacacatacactcatgtgcacatcaagaaagtatttacaaacatgtgcaaaatgttattagtacaaagtactaatagtagtgattatttctaagtgataagattacaaataatattttcttcatttttgctatatgtatttctcaatatttctgaaatatattattttaataataacataaaagttacctattaaatgtacaaaataaatccagtataagaactctaaagtgatctattatttctcctccatttgtatggagtaattctttgggcagtagaaaaatgtcagacaacatgagttccagtctctgccactgactggcaacctattcttaggcaaataacatctctaaatcttacacttattttctgtaaaataactggaaaagatgatcatataagagctcttccagcaaacagtcccatgtctcatatatattagaaacagagctaacgttaaaatgtatttaacacagtgagaaaataatctgcaacctcattagagtgtgttgaatttatatgtgtttatgtttaaaatcacccagatgttgtggatatttaaagagttgctgctgatgttgttttgtgaatagtgaatgtattaaactctatactcttgacgtcccatatagattcaaatcattgaattaaggagctagggccaaatattcttggtctttgtctttgtacatcaggctgtctgatttcactgctatgcaaggcctgtgaggtattgaagaaatgaatgtctaggcagaatgtgttgaatgtctatgcagaatgaactgaattccattgaactatgtttgcacgacttccacaaatttcaaagtgagataactcttagtaaaggctttaatttcaggcccacaatcactgcaaaagttttctatattctctccacaacatctgttcaaagtcttagaataaaataagagtttgtgaattacagatgaaattcgaaattaacaaacattttgaaattttcattgagaaagaatttaaaggccttaactttggtttgctcaacagcatatttcttattcttcctttctttatacaacatttccatgtttacaattcatggcctgtgtcagaaagagtagacagcaatgtgaagtagatgatattgtcttatcctgaattacagaagtttaaacatacattgcattcttgcccagaaatggtatttgtaatgactgcatctttatattcaatcagtaaaaccttttcagtacaatatttgggcaactgatgaaacattaatagaaaattatatagaattaagggacatggcaaaagactgtttactatattcccaccacaccattattatcaatgattatcccaatacttagagtacaagggttatttgcaatgtgttgagtggtaagttcaatgtagtaaaaatagtcagttgaaactcccccttgttagcatgagagtgactgcattccaaggttgctcttttctttcattctcttctttcttcttctccttccagccatggaaatagagttcagttatttctgcatggatgcaaggtgaatgaggctgtcgcttctccttgcagtgctattgattacaggtcactgacataatacagctattttttaatgaaaaaagttatatagcattatctcacttacttgggtatctgaaaggaatgtgtggagtgttatttatttatacagaaatctgccaaatgagaggcatcatcttgctttgaggggcctcctgctggcaaagtgagcaaccttgttattataagaattaaatgctgtacactgtatgaaataaaacacaaaacaatccttcagagtagagctgtgctgattttcaacctgtaaaaatacattattctaatataggaaaacttagaaaactccaaagtgttattaatatcacttgttaaggccacctagttttcattgttctcaactacaagatacatatttaatttatagtttctgatgaaaatgtcaatagatctatttaatttgaccataaatcagtctaaaacactataagctaattgataaggaactgattttctagataagcacaataagcacacgtcagcttgcagttttcaagggacatagtttgtacatagaaaaataaccttagaaaacataattctaataattgtctctgatctcaatcatgagagtaattagttcttccttcataaagccgtcactgcaaattatattcaagaatgaatattatgtctcagttacaaattatatgatttaatctcaaaatttcccaagacccatttaaaaaccttgggagataactgaacatttaataacgtcagggttattaaatatccttcaacatttgcatacttgtaaaaactatatagcatagcaaaaggtactaacagaattgccatgatgcatgaaaccactaagaatcaaatatttgtgtaaaaattaaccatttatggtaccacaagcccctattagaaaaaaatgtgatctttttttgcgaagatcaatcttgacaatctacttatacttaataatttccaaagagtttagaaaacagacagcccaagttgttaaatgcacttgtttagagttaaaatacaggaacgggaggggaggaataagtactgtgttgagataatatctgctaacacagtatctccatccaatatctaactccttctggacaaacagtgattccagggagaaagtagggcagggagtaaatgtcaggtctggggacctgaatagttgcatgtcaggcaataatcctagagaagatttttttcacagtcctgagactactccaaatagggatcacaggcaaaaaggacagctgttatatcatctcccctgaaaaaatgttatatgggactattactaatgccatcctgtgtgtacccagaatcacaggcactggtgttctaatcaagacttctgactgggaaaaatgaaaaacttacaaaacctaaactgcgtttctacactctttttctcaaagcacaaataaatccagagaggcttactagccttctcagaaataagaatgtagtatagatctcagtcatccctgaattgtttcttaaaagtacaacaaattctatttaatttgaatgcttaaaaaaaatcttaataccattagaaaagtgagagacatgattcaactttgagttacaggttttatgtaatataaatacactaaaatttaatcaagcaatatatacaatttcccaattatcttcctggaaaaattacaaatcatcatattctttttcaagaatgtattgatggctacagtggtctgggtaatattaaagctactgcacaaaatgataaaggataaataaaatggctgttagtcatgaacacagggaggggaacatcacacaccagggcatatcagggggcggggggctagaggagggatagcattaggataaatacctaatgtagatgactattcagccattaagaaaataatgaaattgtttcatttggggcaacctgggtgaatctgtcggacattacgttaagagaaataacttaggcacagaaaggtaaatacaaggagctaaaaaaatgagctcataatagtggagagtagaattttggttattggaggctgggaagaataaggcacaggggaatatagagagaggttggttaaagaatacaaaattatagctagataggaataaagttctagtgttctgtagcaatgcagagtaaatatgtttagtaatttattgtatattttcaaaaagttaagagaaaattttgagtattcacaattcaagaaaatgataaatgtttgagttgatggataggttaattattctaatttaattattatacaacatatgcaggtactgaaaaatcactctgtatcccataaatatggacaattattatttatcaaccaaaaacaaaagaaacatatatcaggataccttaattggaaaaatataatttaaacatatttgtcttaaaatatgttgttaacacttctgtcttctatttatgatcaatcattggttaaacagaatgtcataataatgctaaataatacaacggatggaggaaaatcagttgtattgattttaattatagtttaatactccaatttattgctttgcagtaaagtaaaaagttgagttgaaactacatgaaaacttcatcccagtctagttcaatgcctgcatctaaaacacatttaaaatgtataaggttatttgcatgtaaaaattattttattgggttactattcttgcacataaaaatttcggtaattcaactactacattaaaaggtttttatcttaaaggtatagctcatggtttgtcccagaaactgatggaaatctaatcacacatccccactgcccatattgttctggagcaccacctgtcagctgaataagataatgacatgtggtggagcttgtatacaaaatttctacctatctctcagtctaaaaaaatagctttcattgttaaatttgttcttatcttttgcaaaaatgaagaattcacagcatccttgaaaaagtttccacattggttgataggagaaataactttttagaaattctaacccacggactgtagggagtttgaggttgttgcaaaaaagcaagcactcaactgtagaagagcagaaatcgcccttgccattactaatatcttttttaagcatgtacggttttgtggcacatcaatgttaattagcaagtggacaccactggcatagctctgtgaagtttatgatgtcatgcatagcctttacctgattccttaataaatgtgaaaaactgtaatatagggaaagcacttaataatcacaacaatttacagattatcttctatgtgacaaattctgtcagtgtttgtgtatagatgtggatgattctgctctagcatgcagaaatttttccaaaaatacattcagtcatacattgttttagttgtgtcctatattgaagtttaaatgcctataaaatgtaacataaaaagttatctcatgaatttgattaaaaaccattttctcttgaaggcactttaaaaaacaataaggatgaaaggacagaggatttgagtttgccaggtaaacataaatctttggaacaaaactgtctctctaagctctttttttaataccaaaactataaaaacagaatatgaagaaaaaaaggatttgagaaaactgcccttcagagagagccaaattcttcctcaaatagtctacttaaagttctcatgacagtccatgtgtacaataattctataaaccattattgtatcacctgtttatattcataggacacacaaaagtcaagttcaaattatgaaaaagagaaagttcatgctcttctcatatttaacgttttctaactttaaatttatgatgtttctattttgcctttaactgccctagttctctcctactactactatagcatacaaaatataattaacatttattgggcacttactatgtacctgatgctattttatatgcatttacatgcatttcatttaaccttcacaactatgaggttaacattaatattcaattccctttttagatgggatgattgaagcttaaaaagattaagtaattcacctatactcacatggtggactcaaacctgcactatttaaattctcagattcctctattttactccttgcaaagttttacttcgcatgatcaattccaaaaagttactgcaatggttactctatttgagttattataaatataatgaaaccacaatgttaagttagaagagtggcacctattgttaatatacttgatcccatttccatatttgatatattcacaaatattcctggttatttagaattattatgagtatcaagcaaaatcactgtcaatgacctaaaatacttaagaaattcatctatgttgccagcatacttcttaggagttttcatttatcgccatatataaaatgttgatatttagactatgtgaatttaataggagcctaggcattgctgatcagccacctgcacaagtgtggccatttgcaagttatttaatttctccgagcttctgtttccttgtttgtaaaataaggatggtagtgtccatattgttaaggtcaggtgagatattgtataagaagtgcctagcacacttcctgatacagttggcctttaataagtactagatattatgatttcttggctttttaccaatgaagagttaatgtgtgatgtacagaagtttataacaattaagataggaaaagcacattaaattatgaaaagcgataagtaaaacgttgaatagcttgagtcggagatgctgtgacatatccaagtggagatatcgagcaggcagtagaaacaggaaggtttagagctctgtataggggtaagagcttagaataatctacgcagaggtaagacaggggagggcatctggacagtaagaaaaagatgaagaggaccacagccagacagaagcattggatagacttacttcttgttgagtgcattacctttattcattgcctccttaaaaatagtaaattaaaatctaagtctaatatacacccaataatagccaaattgattgttagaatatcgcctctgttgagaaatagctgtgtgatttgtccaattacataactgagtctcattttctttatctatgacagaggattaataccatctaccacgcaggtttaaggaggcaccagacgtaatgcataaaagtaccagcaacgggcttggtgcctcctggcattaaagtggatatagactgtagaaagtgaggagaggtggtagatcagaaagcctaaaacagaacgtaggcatcacagaaatgcagtcttcatacaggggaaccaaaaataatgttaaaagaatggccacaaatggaaaaagcaaaacattttatttagaaggtttatagtgtagatccaaaagtggtagtaaaagagaaatgtcaaaggccttaaaatatttccaaagctgactaataaaggtctactttatttgtaattacgccaggcatgcatatgtacatctgtctttttatctccttttgattttcagtttccctaggaaagtgcttctcttttgctgttatttcttaacattttatctcccagccacaaatgcaggcccagttttctaaattcctgctgtgcctaactatgttcccaccttcctatatatttctccttccagtttagttaaatcagtatttagttataaatacctgctggcataaactgaagagcaaagtaaagtgtatatattttaagcttgtatgcttatattctctattgttttttaaattgagaatgattaattggtgataatataatggatcagaagtgtgaatatctaatatgaagactgttaagaaaaaggcaaaatgtttatttaagaatgacaattaaaaaaaatccttcacaaatctactaatctatgaagagcaggtaggatgatgaggagcagatgggtgggaatcctagccatagagacttgaaggatgggtttcatctgctctaatttttagaggctatgaaaagatacttgggcacagtgtgcttacgacaagttctcagaaatcacagaactcaatcctcacccccaacattgtggaccagttgttcctcagctgcctcactcatttcttatcatcatagaagaggttagatcagagcttaccaccccacacatgaaggaactcactaactcctgggacagaccattccgactttggttagctccaggagaaactccttgatggtgtttaactgaaatctgatgccttacaatttcaaacagctgttaatgtttctgttctccaaggctatacagaacattgctaatccctcgtatatgtaacagccctccctagctattgaagacagttatcatgtccccttcccaagcctcctcttttccatgcctggcatctccttatttctttaatcattcttcaaattaaatagtatgctattattctgttgtaatatgaaatttaaaaaacacatgtccaaatctaagttaccaaaattataataattaagctgacgttcataatttctaccataatattgtattttaactttgtaaaaataaaagttttaattttaattttttcctctccttatctaccacaaatgaaaattgtagatgtagtgacctccagggatagtcccatatctaatacacacacctgcagcagctaataccttgccaggtaactattcattctgactaataatatgagcatgtgatatggttatcaccacatagatgatagtcatcatatattcaaactattgtgagtacttgcagcctaatttatagacacaaatgacccatcagcactcatactcactcttgggaaaatgtatagcatttgctttaaatgtggacagaacacccctgtccacatactaaattacatgggtgattttctcctaggcctcactcatatgattttctcctaggctaattcaatatgtgggcagtggcatcctgtctgttgtgtttaagtcattttttttaacttcaactcacataaaacaggtgtctatgctgtgatacacttatctcagaaaaatgcatttctcgaaccggctaatacttaattgtggcaaagttactgtgacactattcatatttctattattttaaaacacttatggaaaaattatttttatatgtaacagtaatatttacagtatttagtgaccgtaatgtcaaaggcacattagaatggatcatagcatatgccagagaagagatatgaaggtccatcattgtgccacgtattaactctttacttgtttgattgggttaagtcagagaaaggggttccagggaaggtaccagggaaactcaatcaggtaaaacagcatttcaatgttttaacaatcagtaaagttgtaagaaatacactacttgaatattaatcctggtatggaatatactttgttcatcacatcctacacaagggtttacggaaatttgaaaacgtcaaaaagaggctccacattcctagtagaaagaaaaaaataaacagtaaagttattttttttcatatatttgagtagaaaagcattggaaaacatttcaccttgactggttacaaaatcaaagatgtcttcaagtttaaagcatacatgtgctatcagcacatgtacaattactgaaaaccttaatcaacagagaagctatctgaaaaaaattaaccttgaaataaccactggaaatatgatgagatgaacaattcatgaatgagaattattctctacagtgaacttgattatggagaatatagtctgaagtcatgacaaatccttaacagatatataaataacattacaactctgaatactctacaattcactgtgctacaaaaggctgttaggaacacatcttgacattccccaatatagatattattgtacaaattccaggttttctctagaaccacatttccacaaatgttacacatctggtgaacattttctcacactagttaaacctcattaagaaatttcactaaagtttactctgttggataatacttttccacaaaaataaggttttgagttttgtttgttttgttttaagcaacttcctgattattacagtggattctattctgttggctcatctggcaggtgaatgactacttttagaatatgaaattctaccagattcaaatcacaaaattatcataaaataatgggatttctgactgactcacaagtagtaaaactcttgaataccaaaagtccactacaaatgtccttgaaacaaagctattactgatattttgacatacaggtattttattttctgcagatctggaacaattgaaatatttttggttctccttttttttcattaataaatctgccttcacagagctcatcctgccagtaagaaatatgttacttatagaaatttatttttatatagcctataaatattgagtgaaagctgttaaactgtgggagacaaacttcatctgtacttctcaaagagtgactgagtcagtttgtaggagtgaaatagcatgtatcggatctaaatttgccaaacaaaattagctacatgccattctatttgtcttatctttttctctggctcatggtgtgctaattctggccacaagcaatacagtaagcacagaaaaaaataatgaatgccccttttaccaacagttgcataaaatgttttgtctatttcaatatatcttgaagctttttatactttcaatttttatcctgtatttagaagaaagaaaagggccactaaagaattatatctgaataccaatcacttcaatttccattaattccgaatacgtttttaaaggtttcaatatatcaccagggacaatgggctgctaaatttgaagttaacaactgggaaatattattaactgtttagttgatatttttttaaaactgtgacttgaaatactaatctttttattgtttcttaaatttgttaacatattagttaaaaatattaccaaagatctacactctctattattttaactgaaatgcattgtttcattcatggctagcaatggtatctattctagttaaaattttttaaatgacattaaaagaatactttaggtagtaaaacattagtggatgttaattgtctccccacctatatttatgggtgttagcgcaactgctttgctagttgcacagctgtattatcagagtaaacgtgtatttgtaaactgtatgggaactaaaaattaggaataaagccattttcttattttaaagaatggtcacatttaacttagcctgagggtaaaagtcaaaagttgacttttatccactctaaataacaaatgattaaaaatccagcgagtccagtaagctatatttcaaggggtaagaccttaataatatagctcttgtatatccaaactggcagggttcctttaaagtacatccaaccattataaactacagtactgtgtaagggacagtactaaataaaccatcttaaaaacataatgtcaagaaaatagatatatacctggattaggcatactcatatttagagagaaaatattctaaaaattatctctatatagtacattatttcatccaaagatatacccaggtactttacagtgtgattttacactacgtaatattaggttggtgtaaaagtaattgtgatttctgccactacttttgcaccaacttaataattttcttccagagcaatgcattcttcctcattaataatggacactaactacatgcactagaaaaaattacaaaaaaattgtataatgacacccaaaattcacagttaatggaagagcaatattcctaaaatgtgtaattttcaaccataggcagacttaccacaaagtttctaaaacagcttcagcttcagaacccctctattgtactggtacttcacaagaccctgtacttaatttgtatttctatttcaatactgtttttaaacaggttccccaagttgtataaatgcagatccccaaatcttttatttatttatttatttatttattattatactttaagttttagggtacctgtgcacaatgtgcaggttagttacatatgtatacatgtgccatgctggtgtgctgcaccattaacttgtcatttagcattaggtatatctcctaatgctatccctcccccctccccccaccccacaacagtccccagagtgtgatgttccccttcctgtgtccctgtgttctcattgtccaattcccatctatgagtgagaacatgtggtgtttggttttttgtccttgcgacagtttactgagaatgatgatttccaaatcttgcatacgcccctgattcgaagttttctcaagataaggcttaaatggcaaagaaagaaatctgaagaatacaatggaggagggaaactacagggtaacctaaagtagaactccttaactgatagatttattagacaagtttcttcatgtagctatagggaaagcaaaaagagctgctgacctgaaggcactaagatctggcatgctaagcatccctttcttgcacagtgggcaggtagagtggagaaaccatgcctttgagaagcataactagcctctgccgccgtgagaaagtcgtgcaagaggctgagaagcagaaggcagagccagctggctctcaggacagggcagatatgtaactggaccagactagtgcaccagttaggcttcaccattacatactacttcgtatctctagtccctcatctacaaaataggagcatctacaaaataatccctgactcaaactttcttctcatggattcttaaagtaaaaaaggtcaggaaagttctaaaagaacttcaggcaaagtttctaatatctccattcccaattttctcattaatagattactcggcagactgttaggtaattttgaaagttacattaactcttttaggcaaatataaattaaggtacaattagtgcaccctagtggcctagaaatgttgacagttctttagaatctggtaacctgaaaagaaatgtctagaagtgcattttccctggtagactctgactctataaataatataattatttcaccattttcagaacgtagagtgaatcatctaaaagagcaactaagagaatccccatcacctctcagttcagttatactgcaagtgcttcctttataggatccttttaaaatggtaagcatatgtctagttgtctattttaagatactgagaaatcttagctataacaaagttgtattatcacatatatctaggaatagaaaatgccagattctatctggaaccctttttcatgaaatatttattaacattttatctggaggcaaatattcctcccaagagtctgcaaaatcacttaataacatatttttgtattgtgttttattggcctcatctattcttctttaaagaaagaaaaagctggcatcttgagcttcttatatttcctcttcagttcctaacatggtcctgaaatacacactggtggatcagtacatgcttattgcttaaattgattaaatgtttaaatggcagataagtaagaaatagcaaaataatagccattaacattaaaatactgaactacaaaatatttacatgtttaaaagtggtatccacattccacatatatttaacttgccagaaataaaaccaacagaaattgcaccatatttatgggtagattctaaaaatggggatagggatgaatgatagcgtcttagaaacacaccacttgaagaaataccctaggaagctcaagaaagcaactaaagaaatttgcagggtaaacatgcccaatagctattattaagaattctataattatgttattcaaacagcttactttgtgcactatatggtttaattacaaataataaccattcatgaacgagcttaaaattgttcctgcaaatgtatgctattcattcatgtaaaaaaaatttttaaagagcttatatgtatgtggcaccacattagtctctgcagagtataaaaacattggtacttaaaaagtcaaaactattggttggtttgattaaatgccagataagtgatattgataaggactactggctagagtagccagtgaaggaagatgtaacaaagacgtataatttaaagtaaaacttaaaagattcaaaagtttggccaagtaaaagcaccaagtaagccacaaattccaggaaaagggatcagcaaaagtaaggacaataaggaaggcatagtcatgagatattgactaggtcagtctggtttttagacagagtacatgttaacagactctatgatggatttaaaaagaaattgaagacagttttagcaggctttgaacattacaagagggatccatgaaaagtttcagaataaaaactaagataatattagaaatggtaatctgacagtgacaggaaggagattttagaggtttgaggacgtggaagaagaagaatacccataaagaggatcttgcaataaccctgcctgaggtttctaaggaccagatgatgcttataaaaatcttggggagtagcttttaacatacctatgcagtcaactttcctttaaaacaaacttatttaactgctctgttctagacaaaattaccagacaaaaggaattcctgaaaatgaaagtatgtgtataaaagaaatattatcctgttgtatttttatttggttttcataggtccctatagaaacccatattctcacattctttaagcctacagagaaggacaggaaataatgacaaagatttcagtaagagtttgcctagagcaaaatagtcactgccacccatgatctctattaggcatccccttgatagtgattgggacccatcctgaaatagaagactgtgccacttattgctcaagtcacagctatacttgatatagtcacagagcctggagaatctgttgtcaattattttcagtcctaaccagccatgagataaccccagcagaggagagaaaacaagcacacgcattttttgaaagcaggtttatgatccccacttgtattcaaaagattaacacttggatatccacctatactagaagcacatgggaccaggagtaagtaaaggtcagcagagcagtaaagatttagcaggtgaaaccgattgtttacaagtctaatctttgtggaaaataaaagagtgtttattgtaccattcactttcttctctttcaacacatttaaactatgttcgaaatgaaatatattataaatcttcaatcggtcttgagtccttttaatttaactctcaggactcagaaactggatcttgcatattcctattggtgtttagtacgcttcagtaacccctacaatattggaaataatgtgattaatagtaatgatcctgtgttacttctcatgggagaggcttaatgatattgcacaggaagtttcatggtgtttatgttaatcttttacgggggtccactttcatctccaatttctatcaggaaatgactcttcttgccaaaacaagtttcaaacttcccttctttcacatgggcccatgagaacacttatcatgcccaagacggctgaggcacatgagggaactcagctacaaccagagagcattaagtttaggtcaaaaatattgcagtcaaaaggcccagaggtagcatcttacagaagccaactagagtgaggcaaaggtgctatagaaataaatttatagtcagtacttaaagctttgcttatgctcttgctcaaagaatagaactatgtcttagttagggccatgatgaaagaggatggcccaacaaagaccatagaaattatcatttcatgtcatatcttaggtccaaggacaggcctagatgaatctgaagtattctcatggatttcctggttaaaggtctccatcaactaactggtgatgaggaacccactgtttatcctttacaatccatcttatttcagcattcatagtacttattttaaaaatgaaaaaataagcattttctgctgactggacatcttcataaagcccaggttaaaaaaaaacaaaaagaaagaaaagaaactcttaaaagtgctattatatacagatagtactgtgggctcctgtgtgacttttagggaattcaagattctatgtctccataggcctaaccaggtaaagaaatcctcttatagaacgatgtctttaaaaagttgctttatttctttactcctcatgtgccataacttatcaatgcaatcaatgattactctccaaatataaattaaagatgatcatgaggatcccactgtctttcttttagaaagaactacacaatatggtaattaggagtgtggatccaagccatttgtcttcatttcagtttctcaattctctttaatgcaacataaccttttatttgtttccttatttttttatgtgtcagtggtttttcaaatacttctatgtgtgctacagaaaatgatattggtgtcaggagctgccactagtttatattatctaatttccttgcgctgtcagtttccttacctaaaacataagatgactggattacatcagtggtttctagtgccggacttctatgacaccagtgcaggagagtagaggcaacagtgaaaggaaagtgagggaatgtcaacggcaggggcctcaaagctgcctcctccctgcagcttaactacacagctctctttttattttaccctttcagctgttttagaaactagggctatgcctatgacttcacttggaacaacaacaacaaaaaagaggtccacttacaaaaataattaaaaaccaataaactttttttctaaaaagtctaaactttccatttctaattaattgaattattaaaaacattcaagatgttaatagcttaggcatgacttttagctacactaataaaggtaaggcgattgagacagaagcaagtagtctaatcccagatcacataacaaatgattgtatgaccagaatccaaacctcctaacttttagtgctttattcgctagcatcacacaatagcaaggctgttgctgtactacccacagctaaggcatgcactattcctattaaagtctatgtggctgctgccccctggagttgtgcaaagtgacaggcctgcagaacaattcaaaatggaaataactctaaaacaattattacatgctacatagcctctttagaattagttaacaaaacatccacatatttcaactccatattgtaaaagggacagctttcctctcttgaaaagtttgtataaatataaagcactagtttaagtatcaagtgtgaaaacaaggaagtggccttaaatcttgattacagaattggaaaatacggcaatttatttaataaatatttcagaataaccaacaactcagaaaaaataaaagagaccatagaacaattctgaaaataatattttggggaaattgccctcaaatacaaatgcctttgagttaataagctctttatttcattagacaggtactcttttgatagagacagtttgctagaaagtttacattatgtttcttaatataggtatacatgttttagattacatgtgcaatttagattacatctataaaaacaatttagtggaatgtatctcaatatcaaagactttaaagttattttcataaaactgtacagtgcagaaatagtgcattatatgcatttctctcccaggcagagaagccaagtcacaaagagatgcagtgagttgctgaaggtattaagaaactcgagaactgtctctgcaaggtagaaatcctgatttaaacaatgtgactacgtcccatgtcccatttaaccacaaaataggcaattaaagtctccctcaaattatgttgaagacatacagtttcaggaaacattgacctacaattttttcataaaaaggggttatttttcattataaactgaaaactccagtcaatagctgtattagaaatcataaaaagtaaggttttaactctgactgccaatatttataatacttcagaaaatgagtattagataaaacatgtaatttggttccatatggtgaaatgtaacataatagagcatctctaaaatgatataacctggagaaaagttgttaatatgattaaattctaccctgcacaggatactcagtagatcactgtaaaagataacagtggaatatgcttggtgattaatttctgtagaacagatgtaggcttgaacctctaaaaactaatttcagtacaaatattagcatctcaacaaagcagtatctctcaaaactggtaaaattaaacagagcaagtaccaacaagtttgtaggtatcagaaaatccgttttgatcatttatttcatttatgttttaggcacttacaaactatacatggatatccaacagtagcagaacactataatataaagccaaaacttatggctatttttaagaacatgttaacttttcctaataaccagcttgatataacacaaaaataataccgctttaaagcattgcaatgtttaagccatcctaattcaatttattgtctaaaatatgcactgtgcatagccattaatctcaaggtggctctaatcaagcttccaagagtacttagaaagagcacaattcattgcctcactagcattttttaaatagcagtggtccaccttccttccttggtcaagaggggaaaagaaagaaagaaaaagggtaagagggacttctctgtggaaaggtttggccttggagtcaaggcttttaagatgtgccagtgatcttggatcgatgcctttttattttctttcaggaataaatctgagcaatggaatggcttgtgattgtctggccaaccagccatatcagatttatcagaaagaatgaaaactggctcagaggactcctgcagtggctgagtggcaggttactgggaaagacacaaacaaaaacaatatacttagtggcggaagggaaaatatatattaacacatgtaaactcaataaatactaagatgtaaagagagaatctatagtaacagaaagggtgaatgcataagacagatgataaatagtacttctatttaaaaaccaaagggatgaaagctcatgaatactacatatttgaatccactttgaggaggaaatacgattttccatcaaataaatgcaaactctaaaaatcagccaatgcaaacttactgtgttcaggttagaataaaaaatgcataaatcttccacaaagttcatgctctgataaatattctaatgtaatttcttaattaagacacatttccagtgactaaatgaaaatatatatataaagcagtaagtgccttgattttcaacaaaatttcactttctatgcatacatgattaaaataaataaaagcagttgagtttaagagcaaaaaaaaggaatactgatataactggagtcatttcatcacaacagaacagttatagtatttccaagcgatttgcagttatactaacagatatttatttagacatattgtgaagaaaaaaataacaccttcttctaaaaagcccccttttatatatatatatatgagaatttcaaattaaaaagaaaacattgtaccgatagatgtgcttacagtaaacacttgtaagaaagagaattgatgctttcttgaaaatatatttaacacctttttcaccacttaacttttattaacatttttcttctcaaatgaaaaataaccccatgattttggagatataatgatgtatcttaaatatgtacgaaagctatatgtacttttatagaatgaaaagcaagactgagttacctgcaaaaaagaaatgggaactgaacttgttcatcgtttatctactaaggtatataagagtaccacctcaatgctactatacattttcttcaataccaaggcaatattgataattttccattatacaaggaagacgaattttagaaccattcctttggttagcaaaggctttataattgccatataaagggactttggctatatctagatatatctaaataaaatgcataattgaaaatgagacaaagtcctttagaatttctaaaaaacatcctctctaatgctgaatttttttccaagcaaaagaaaaaagaggttctcttctgttacaattaagaaatatcttaaagatctatacaacagcatcccccgccctatatttttattctgttcacatagagcagtaaataaggtgcattccttctgcttaagaaattagcatttcaaaaatatgccactttcccctgaactccaagcgtgtctaataatgcgagaagcagattgtcttccctcgtttccttaatttgtttcatctaaaagcaattcactcaacatcttgtcgccctctggcagcttagtttacttatccgcacttaatttctcatttggaccaaaacaaactcctccaaactgctactgactgctaaccgcgagaggggagacgcgcaatatgtatttagttgggaacacacagccacacacatacataggcacaaacacacacagcctcactcataccccagacagtaacttgtttttataatagcactgcattaaaaccagctgaactttccctgccaggtgcggcagggtgggggtgggggaggatgaaaaacgaagtcccccggggcatttacagtttccaatggatcaccttagtatgcgtgttgcaattataccagggatgcacccgagagcttttctttgtgcggccctttcatctggatcactttgtgttttgaacaagtgaggctcgcctttgtgcccccagaatttcaagtacagagtcacacacggaacaacaatggcacgctaatcctcgcgctctaaatgggctcacttgtgggtctgacaattcgcccagggaaacgagaagagacgaagcgagggcgcgagctagtgtcgcctgagacgaggaagaggacagctgcagaactaatttggattacattccttgcagaaattctgaaaagggcttttcggcatagctcaactcggagccgcacagttaataccaaattgctgcggactcggagcggggtcccccagtggcagaggctgaaccagacagcccccagtaggtcgcctcgtagaaattcctctcggctaagcctgcatgtcggtcgccaatgcctttgaatgggtcaatgtgcataatcaacccattgagggaaaatatgaagggactcgaagtggggagggagataaaaagagatgtatctaagaggccgcttggaatgtcaagtccgtgttggtgtgattccggaggtggctggagcgcgggacctggtatgcgtgaagaatttcggagtaattgggagggtgcaaacggccagcacaaacgcctcacatgtgccattcgaaggtcattttgaaagactcgataattgtaacttgttatttactaggcaaaggaggcggcggcggcggcggcggcggagcgggaaaactacagctagccgttttcttggtgaggtcagaaggacaccctccgggggcctaaagcgctccctatcgccactcccgggggctttatcacctcaagctacttcccacgctccagtcaccatccctggatggtttcggaaatctctctggctctccaaaaggcaccccttggccacgtcaagacaccggtcctcctcagacctctcccgtcccactttcatccccaggaaactctagtgtcagaaactttgagctccattgcactgcaggtgctgtcattagtcctgcaagccgtggcgggccagccccgccgcgctgcctctcggggtcaattagccctttgcctgcccaggtacctggggctcgagctctccagcaagcagtggccgcgcacccatcgccgctgccgctttcgcctcgggtggatccagtgacccgcaggctcggcagcctggccgggcagtaaacagacaagtttgaaggactccggccaatagcaagttgaactacaggaagaactcttcccggagccaaacacggcaaccgacgggaaggccgggcttctggctcaagtgtgccaagcctttttttttttttttaagaggtcaggcaggcgagtaagcgcccctcaagtcaatggggagagggctccgggaagccggcggaagaggcccagaactccgggccccggaccgaggcgcgcccgcctgctgcactccggctgcccgggctgggcgcgagttgcgtctgacgccacaaggctcgggcgactgggggcgcagcggtcgccagcagcacacacaggtgcaaagcccgattttctgagcgccgctctccaccgcccttcgggctcggctcgggagaggcccagccagcaccgccccaggaccgcggccccggcggtgcgggttctgccctcggggacccgacagggacagaagagtctcctctgactggggatttgggtctcccatgtcccgaacaacaggcgccaccagaagggatcccgcttaggctcccaaacaaaacgctcgggaaagaaaagcagggggttaaggagagaaaagagggactcagagtgatttttcacgataaataaagcaaacgcacacatacagggtaagtttcaaatggaaagaggggtgaccgaaagcccagggaagaggccccggtcaagcggtccctccacgcctcccgggatgggtgaagagggcaggggagccactcgaggcagccccgccggcggctgcaggttcggcgaccggagtgccagaaggaacccacctgactgagaatcgctgggctggacggtccccgccgccacgagaaggctcacccagacccaaagtcctgtcgccggcttcattttttggaagtctcagatcccgtgctgacaattacatgtccaaatggcatatccccctttcgggcacgcggaggagatcccccagccgggcgcgcgtg

SEQ ID NO: 84 - DNA, 1162912 bp, Homo sapiens; identical to SEQ ID NO: 83
